United States Patent 8,541,208 (PROCESS FOR THE PRODUCTION OF FINE CHEMICALS) - sequence listing, part 3

SEQ ID NO: 4693 - protein, 1835 aa, Saccharomyces cerevisiae
MTVSSDTTAEISLGWSIQDWIDFHKSSSSQASLRLLESLLDSQNVAPVDNAWISLISKENLLHQFQILKSRENKETLPLYGVPIAVKDNIDVRGLPTTAACPSFAYEPSKDSKVVELLRNAGAIIVGKTNLDQFATGLVGTRSPYGKTPCAFSKEHVSGGSSAGSASVVARGIVPIALGTDTAGSGRVPAALNNLIGLKPTKGVFSCQGVVPACKSLDCVSIFALNLSDAERCFRIMCQPDPDNDEYSRPYVSNPLKKFSSNVTIAIPKNIPWYGETKNPVLFSNAVENLSRTGANVIEIDFEPLLELARCLYEGTWVAERYQAIQSFLDSKPPKESLDPTVISIIEGAKKYSAVDCFSFEYKRQGILQKVRRLLESVDVLCVPTCPLNPTMQQVADEPVLVNSRQGTWTNFVNLADLAALAVPAGFRDDGLPNGITLIGKKFTDYALLELANRYFQNIFPNGSRTYGTFTSSSVKPANDQLVGPDYDPSTSIKLAVVGAHLKGLPLHWQLEKVNATYLCTTKTSKAYQLFALPKNGPVLKPGLRRVQDSNGSQIELEVYSVPKELFGAFISMVPEPLGIGSVELESGEWIKSFICEESGYKAKGTVDITKYGGFRAYFEMLKKKESQKKKLFDTVLIANRGEIAVRIIKTLKKLGIRSVAVYSDPDKYSQHVTDADVSVPLHGTTAAQTYLDMNKIIDAAKQTNAQAIIPGYGFLSENADFSDACTSAGITFVGPSGDIIRGLGLKHSARQIAQKAGVPLVPGSLLITSVEEAKKVAAELEYPVMVKSTAGGGGIGLQKVDSEEDIEHIFETVKHQGETFFGDAGVFLERFIENARHVEVQLMGDGFGKAIALGERDCSLQRRNQKVIEETPAPNLPEKTRLALRKAAESLGSLLNYKCAGTVEFIYDEKKDEFYFLEVNTRLQVEHPITEMVTGLDLVEWMIRIAANDAPDFDSTKVEVNGVSMEARLYAENPLKNFRPSPGLLVDVKFPDWARVDTWVKKGTNISPEYDPTLAKIIVHGKDRDDAISKLNQALEETKVYGCITNIDYLKSIITSDFFAKAKVSTNILNSYQYEPTAIEITLPGAHTSIQDYPGRVGYWRIGVPPSGPMDAYSFRLANRIVGNDYRTPAIEVTLTGPSIVFHCETVIAITGGTALCTLDGQEIPQHKPVEVKRGSTLSIGKLTSGCRAYLGIRGGIDVPKYLGSYSTFTLGNVGGYNGRVLKLGDVLFLPSNEENKSVECLPQNIPQSLIPQISETKEWRIGVTCGPHGSPDFFKPESIEEFFSEKWKVHYNSNRFGVRLIGPKPKWARSNGGEGGMHPSNTHDYVYSLGAINFTGDEPVIITCDGPSLGGFVCQAVVPEAELWKVGQVKPGDSIQFVPLSYESSRSLKESQDVAIKSLDGTKLRRLDSVSILPSFETPILAQMEKVNELSPKVVYRQAGDRYVLVEYGDNEMNFNISYRIECLISLVKKNKTIGIVEMSQGVRSVLIEFDGYKVTQKELLKVLVAYETEIQFDENWKITSNIIRLPMAFEDSKTLACVQRYQETIRSSAPWLPNNVDFIANVNGISRNEVYDMLYSARFMVLGLGDVFLGSPCAVPLDPRHRFLGSKYNPSRTYTERGAVGIGGMYMCIYAANSPGGYQLVGRTIPIWDKLCLAASSEVPWLMNPFDQVEFYPVSEEDLDKMTEDCDNGVYKVNIEKSVFDHQEYLRWINANKDSITAFQEGQLGERAEEFAKLIQNANSELKESVTVKPDEEEDFPEGAEIVYSEYSGRFWKSIASVGDVIEAGQGLLIIEAMKAEMIISAPKSGKIIKICHGNGDMVDSGDIVAVIETLA

SEQ ID NO: 4694 - DNA, 4315 bp, Saccharomyces cerevisiae
  CDS (676)..(4218)
gatctttttatgtactacaggaagcagaaacaaaatgagatatcaataccagtgtaaatctgttaatgagaatcatcacattatcccagttttttccatgcaagggaaaaatatactatacgacatttctatactttaattatcaattaaggtcatctttctgtacgaaaactaaccacgattgtcactaacgacgtgtcccttacccgacgcagctgctgatagctaccgcacaggcacagccagctcttctgtgattggcagagaggggtccttcctgcggaagacgccgcaaaggcacatatgactaaccttttttttttcgcaattaattttctaatagtttttcattttttttttacaattttggcagttacgtctcgagctatttattataagagtcagaattggcgcagggagtgttaagtaagaagtactccccatcggatatttcctattgtgtttctgtgatttttagtccttttttcttttctcttactttcggtatccttacttgattacatacataaacaagcccctcttttcttccaaactcttgtagcttactatctgtggcccgtcatttgagtttgatttttttgccaattactatattgcaaaataaaggacagttactaggagagaaaataagggacatagagaacaaaataaaatatgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaatggacgagatcatcgaaattgcaaagaagcataaggtggatttcatccatccaggttatgggttcttgtctgaaaattcggaatttgccgacaaagtagtgaaggccggtatcacttggatcggccctccagctgaagttattgactctgtgggtgacaaagtctctgccagacacttggcagcaagagctaacgttcctaccgttcccggtactccaggacctatcgaaactgtgcaagaggcacttgacttcgttaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggctgataaccacggaaacgtggttcatcttttcgaaagagactgttctgtgcaaagaagacaccaaaaagttgtcgaagtcgctccagcaaagactttgccccgtgaagttcgtgacgctattttgacagatgctgttaaattagctaaggtatgtggttacagaaacgcaggtaccgccgaattcttggttgacaaccaaaacagacactatttcattgaaattaatccaagaattcaagtggagcataccatcactgaagaaatcaccggtattgacattgtttctgcccaaatccagattgccgcaggtgccactttgactcaactaggtctattacaggataaaatcaccacccgtgggttttccatccaatgtcgtattaccactgaagatccctctaagaatttccaaccggataccggtcgcctggaggtctatcgttctgccggtggtaatggtgtgagattggacggtggtaacgcttatgcaggtgctactatctcgcctcactacgactcaatgctggtcaaatgttcatgctctggttctacttatgaaatcgtccgtaggaagatgattcgtgccctgatcgaattcagaatcagaggtgttaagaccaacattcccttcctattgactcttttgaccaatccagtttttattgagggtacatactggacgacttttattgacgacaccccacaactgttccaaatggtatcgtcacaaaacagagcgcaaaaactgttacactatttggcagacttggcagttaacggttcttctattaagggtcaaattggcttgccaaaactaaaatcaaatccaagtgtcccccatttgcacgatgctcagggcaatgtcatcaacgttacaaagtctgcaccaccatccggatggagacaagtgctactggaaaagggaccatctgaatttgccaagcaagtcagacagttcaatggtactctactgatggacaccacctggagagacgctcatcaatctctacttgcaacaagagtcagaacccacgatttggctacaatcgctccaacaaccgcacatgcccttgcaggtgctttcgctttagaatgttggggtggtgctacattcgacgttgcaatgagattcttgcatgaggatccatgggaacgtctgagaaaattaagatctctggtgcctaatattccattccaaatgttattacgtggtgccaacggtgtggcttactcttcattacctgacaatgctattgaccattttgtcaagcaagccaaggataatggtgttgatatatttagagtttttgatgccttgaatgatttagaacaattaaaagttggtgtgaatgctgtcaagaaggccggtggtgttgtcgaagctactgtttgttactctggtgacatgcttcagccaggtaagaaatacaacttagactactacctagaagttgttgaaaaaatagttcaaatgggtacacatatcttgggtattaaggatatggcaggtactatgaaaccggccgctgccaaattattaattggctccctaagaaccagatatccggatttaccaattcatgttcacagtcatgactccgcaggtactgctgttgcgtctatgactgcatgtgccctagcaggtgctgatgttgtcgatgtagctatcaattcaatgtcgggcttaacttcccaaccatcaattaatgcactgttggcttcattagaaggtaacattgatactgggattaacgttgagcatgttcgtgaattagatgcatactgggccgaaatgagactgttgtattcttgtttcgaggccgacttgaagggaccagatccagaagtttaccaacatgaaatcccaggtggtcaattgactaacttgttattccaagctcaacaactgggtcttggtgaacaatgggctgaaactaaaagagcttacagagaagccaattacctactgggagatattgttaaagttaccccaacttctaaggttgtcggtgatttagctcaattcatggtttctaacaaactgacttccgacgatattagacgtttagctaattctttggactttcctgactctgttatggacttttttgaaggtttaattggtcaaccatacggtgggttcccagaaccattaagatctgatgtattgagaaacaagagaagaaagttgacgtgccgtccaggtttagaattagaaccatttgatctcgaaaaaattagagaagacttgcagaacagattcggtgatattgatgaatgcgatgttgcttcttacaatatgtatccaagggtctatgaagatttccaaaagatcagagaaacatacggtgatttatcagttctaccaaccaaaaatttcctagcaccagcagaacctgatgaagaaatcgaagtcaccatcgaacaaggtaagactttgattatcaaattgcaagctgttggtgacttaaataagaaaactgggcaaagagaagtgtattttgaattgaacggtgaattaagaaagatcagagttgcagacaagtcacaaaacatacaatctgttgctaaaccaaaggctgatgtccacgatactcaccaaatcggtgcaccaatggctggtgttatcatagaagttaaagtacataaagggtctttggtgaaaaagggcgaatcgattgctgttttgagtgccatgaaaatggaaatggttgtctcttcaccagcagatggtcaagttaaagacgttttcattaaggatggtgaaagtgttgacgcatcagatttgttggttgtcctagaagaagaaaccctacccccatcccaaaaaaagtaatttttactcgttaattatattttatgacatctgaaaatactagctgtactatatatggcgtatattttatctagttatgttcccatgtatatttaaa

SEQ ID NO: 4695 - protein, 1180 aa, Saccharomyces cerevisiae
MSSSKKLAGLRDNFSLLGEKNKILVANRGEIPIRIFRSAHELSMRTIAIYSHEDRLSMHRLKADEAYVIGEEGQYTPVGAYLAMDEIIEIAKKHKVDFIHPGYGFLSENSEFADKVVKAGITWIGPPAEVIDSVGDKVSARHLAARANVPTVPGTPGPIETVQEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKVCGYRNAGTAEFLVDNQNRHYFIEINPRIQVEHTITEEITGIDIVSAQIQIAAGATLTQLGLLQDKITTRGFSIQCRITTEDPSKNFQPDTGRLEVYRSAGGNGVRLDGGNAYAGATISPHYDSMLVKCSCSGSTYEIVRRKMIRALIEFRIRGVKTNIPFLLTLLTNPVFIEGTYWTTFIDDTPQLFQMVSSQNRAQKLLHYLADLAVNGSSIKGQIGLPKLKSNPSVPHLHDAQGNVINVTKSAPPSGWRQVLLEKGPSEFAKQVRQFNGTLLMDTTWRDAHQSLLATRVRTHDLATIAPTTAHALAGAFALECWGGATFDVAMRFLHEDPWERLRKLRSLVPNIPFQMLLRGANGVAYSSLPDNAIDHFVKQAKDNGVDIFRVFDALNDLEQLKVGVNAVKKAGGVVEATVCYSGDMLQPGKKYNLDYYLEVVEKIVQMGTHILGIKDMAGTMKPAAAKLLIGSLRTRYPDLPIHVHSHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDIRRLANSLDFPDSVMDFFEGLIGQPYGGFPEPLRSDVLRNKRRKLTCRPGLELEPFDLEKIREDLQNRFGDIDECDVASYNMYPRVYEDFQKIRETYGDLSVLPTKNFLAPAEPDEEIEVTIEQGKTLIIKLQAVGDLNKKTGQREVYFELNGELRKIRVADKSQNIQSVAKPKADVHDTHQIGAPMAGVIIEVKVHKGSLVKKGESIAVLSAMKMEMVVSSPADGQVKDVFIKDGESVDASDLLVVLEEETLPPSQKK

SEQ ID NO: 4696 - DNA, 6558 bp, Ustilago maydis (corn smut)
  CDS (1)..(6558)
atgccgcctccggatcacaaggcagtcagccagtttatcggcggcaacccgcttgaaaccgctcccgccagccctgttgccgactttattcgcaaacagggtggtcacagtgtcatcaccaaggtcctcatttgcaacaacggtatcgccgccgtcaaggagattcgctccatccgaaaatgggcctacgagacctttggcgatgagcgtgccattgaatttaccgtcatggccacccctgaggacctcaaagtcaatgccgactacatccgcatggccgaccaatacgtcgaggtacccggtggctctaacaacaacaactacgctaacgtcgacctcatcgtcgatgtcgctgagcgagccggcgttcacgccgtatgggctggctggggtcacgcctccgagaacccacgcctacctgaatcgctcgccgcctccaagcacaagatcatctttatcggtccccccggctccgccatgcgctcgcttggtgacaagatctcgtccaccatcgtcgcacagcacgccgacgtgccatgcatgccctggtccggtaccggcatcaaggagaccatgatgagcgatcagggtttcctgaccgtctcggacgacgtctaccaacaggcctgcatccacaccgctgaagaaggtcttgagaaggccgaaaagatcggctaccccgtcatgatcaaggcctccgaaggtggaggaggaaagggtatccgaaagtgtaccaacggcgaagaattcaagcagctctacaacgccgttctcggtgaagtgcccggctcgcccgttttcgttatgaaactcgccggccaggcgcgtcatctcgaggtgcagctgctggccgatcagtacggcaacgccatcagcatctttggtcgtgactgctctgtccagcgtcgtcaccaaaagatcatcgaggaggctcctgtcactatcgctcctgaggatgcccgcgagtccatggagaaggctgccgtgcgtctcgccaaactggtcggctacgtctctgccggtaccgtcgaatggctctactctcccgagtcgggcgagtttgccttcctcgagctcaacccccgtcttcaggtcgagcaccctactaccgagatggtctcgggtgtcaacattcccgctgcccagcttcaggtcgccatgggtatccctctctactcgatccgcgacatccgaaccctttacggcatggaccctcgcggtaatgaggtcatcgactttgacttctctagccccgagtcgttcaagacccagcgcaagcctcagccccagggccacgtagtcgcctgccgtatcactgccgaaaaccccgacaccggcttcaagcctggcatgggtgccctcactgagctcaacttccgctccagcacctccacctggggttacttctccgtcgcagccagcggtgctctccacgagtacgccgattcgcagttcggacacatctttgcctatggtgccgaccgatccgaggcgcgaaaacagatggtcatctcgctcaaggagctctccattcgcggtgacttccgtaccaccgtcgaatacctcatcaagttgctcgagaccgacgccttcgagtccaacaagatcaccactggatggctcgatggtctcattcaggaccgtctcactgccgaacgacctcctgcggacctcgctgtcatttgcggtgctgccgtcaaggctcatctccttgcgcgtgagtgcgaggacgagtacaagcgcatcttgaatagaggtcaggtccctcctcgcgacaccatcaagaccgtcttctcgatcgacttcatctacgagaacgtcaagtacaactttactgccacgcgcagctccgtctccggctgggtcctctacctcaacggtggacgtacgctggtgcagctccgaccccttaccgacggaggtctgctcattggtctttcgggcaagtcgcaccccgtctactggcgtgaggaggtcggcatgacccgtctcatgatcgactccaagacctgcctcatcgagcaggagaatgaccccacccagatccgctcgccctcgcccggtaagctcgttcgcttcttggtggattcgggcgaccacgtcaaggccaaccaggccattgcagagatcgaggtcatgaagatgtacttgcctctcgttgccgccgaggacggcgtcgtctcgtttgtcaagaccgccggtgttgctctcagccctggagacattatcggtattctctcgcttgatgaccctagccgtgtccagcacgctaaaccctttgctggccagctgcccgactttggaatgcccgtcatcgttggcaacaagcctcaccagcgttacacggcccttgtcgaggtactcaacgatatcctcgatggttacgaccagagcttccgcatgcaggcggtcatcaaggagctcatcgagacgctccgcaaccccgagctgccctacggtcaggcctcccagattctgtccagcttgggcggccgtatccctgccaggctcgaggatgtggtgcgcaacacaattgagatgggccactcgaagaacattgagttccccgctgctcgtctgcgcaagctcaccgagaacttcctccgtgacagcgtcgaccctgctatccgcggacaggtgcaaatcaccattgctcctctctaccagctcttcgagacctacgctggcggcctcaaggctcatgagggcaacgtgcttgcttcgttcctccaaaagtactacgaagttgagtcccagtttaccggtgaggctgacgtcgttctcgagcttcgtctccaggccgacggcgacctcgacaaggttgtggccctgcagacttcgcgcaatggcatcaaccgcaaaaacgctctgctgctcaccttgcttgacaagcacatcaagggcacctcgcccgtctcgcgtactagcggtgctaccatgatcgaggctctgcgcaagcttgcctcgcttcagggcaagtcgactgcccccatcgccctcaaggctcgtgaggtctcgctcgacgccgacatgcccagtcttgccgaccgatcagctcagatgcaggccattcttcgtggctccgtcacctcgtccaagtatggtggtgatgatgagtaccatgctccctcgcttgaggttctccgcgagctcagcgactcacagtacagcgtgtacgatgtgctgcacagcttcttcggtcaccgcgagcaccatgtcgcctttgccgcgctctgcacctacgtcgtccgcgcctaccgagcttacgagattgtcaacttcgactatgccgttgaggactttgacgtcgaagaacgcgctgtgctcacctggcagttccagctgcctcgaagcgcttcttcgctcaaggagcgtgagcgtcaggtgtctatcagcgacctcagcatgatggataacaacaggagggctcgccccatccgcgagctgcgcactggtgccatgaccagctgcgccgatgtggccgacattcctgaacttctccctaaggttctcaagttcttcaagtcttctgccggtgccagtggagcgcccatcaatgtgctaaacgttgctgttgtcgaccagactgactttgtcgacgccgaagtgcgaagccagcttgccctgtacaccaatgcctgcagcaaggagttttccgctgctcgtgtccgccgtgtcacctacctcctttgccagcccggcttgtatcccttcttcgccaccttccgtcccaacgagcagggcatctggtccgaagagaaggcgattcgcaacatcgaacccgcgcttgcctaccagcttgagctcgacagggtcagcaagaactttgagctcacccccgttccggtctcgtcgtccacgatccatctctactttgctcgtggtatccagaactcggccgatacccgattctttgttcgctcactcgtccgtcccggccgcgtgcagggcgacatggctgcatacctcatctccgaatcggaccgcattgtcaacgatattctcaacgtcatcgaggtagctcttggccagcccgagtaccgcaccgccgatgcttcgcacatcttcatgtctttcatctaccagctggatgtcagcctcgtggatgtgcagaaggctattgccggcttccttgagcgacacggcacccgcttcttccgtctccgcatcacaggtgccgagatccgcatgattctaaacggtcccaacggcgagccccgcccgatccgagcctttgtcaccaacgagaccggtctggtcgtccgatacgagacatacgaggagactgtcgccgatgacggctctgtgattctgcgcggcatcgagccccagggcaaggatgccacgctcaatgcccagagcgcacacttcccttacacaaccaaggtggcactgcagtcgcgacgatctcgtgcccacgctttgcagaccaccttcgtctacgactttatcgatgtgcttggtcaggccgtgcgtgcgtcgtggagaaaggttgctgccagcaagattcccggtgatgtcatcaagtcggccgtcgagttggtctttgacgagcaggagaacctgcgtgaggtcaagcgtgctcctggtatgaacaacatcggcatggttgcttggctcgtcgaggtgctcacccccgagtaccccgctggccgtaagctcgttgtcatcgggaacgacgtcaccatccaggctggctcgttcggccccgttgaggaccgcttcttcgctgctgcctccaagctcgcccgtgagcttggtgtgccgcgcctctacatctcggccaattcgggtgcccgtatcggcttggcaactgaggcgctcgacctgttcaaggtcaagttcgtcggcgacgaccctgccaagggtttcgagtacatctacctcgacgacgagtcgctccaagccgtccaggccaaggcgcccaacagtgtcatgaccaagcccgtccaggccgctgatggcagcgtccataacatcatcaccgatatcatcggcaagcctcaggggggtctcggtgtcgagtgtctgtcgggcagtggtctcattgccggtgagaccagccgtgcaaaggaccagatcttcactgccaccatcatcacgggacgaagtgtcggtatcggtgcctatcttgctcgtctgggcgagcgtgtaatccaggtcgagggctcgcccttgatcctcactggttatcaggcactcaacaagctgctgggtcgtgaggtctatacctcgaacctacagctcggtggtcctcagatcatgtacaagaacggtgtttctcacctcactgctcaggacgacctcgacgctgtcaggtcgtttgtcaactggatatcatacgttcctgctcagcgtggtggacctctgccgatcatgcccaccaccgatagctgggaccgagcggtcacataccagcctcctcgtggtccttacgacccacgatggctcatcaacggtaccaaggccgaagacggcaccaagctcaccggtcttttcgatgaaggctcatttgtcgagacgcttggcggctgggccacttcggtagtcactggtcgtgctcgcctgggcggcatccctgtcggtgtgatcgctgtcgagacgcgcacgctcgagcgtgttgttccggccgaccctgcgaaccccaactcgaccgagcagcgcatcatggaagccggccaggtgtggtaccccaactcagcgtacaagactgcccaagccatctgggactttgacaaagagggtctgcctttggtcatccttgccaactggcgtggattttcgggtggccagcaggacatgtacgacgagatcctcaagcagggctccaagatcgtcgacggtctgtcgtcgtacaagcagcccgtgtttgttcacattccacctatgggtgagcttcgcggtggttcgtgggtcgtggtcgactctgcgatcaacgacaacggtatgatcgagatgtcggccgatgtcaacagcgcacgaggtggtgtgctggaagcctcaggtctggtcgagatcaagtaccgtgccgacaagcaacgtgctaccatggagcgactcgacagcgtctatgccaagttgagcaaggaagctgccgaagcgaccgacttcaccgcgcagaccaccgctcgtaaggcgttggcagagcgagagaagcagctcgcacctatctttacggcgatcgctaccgagtatgcagatgcacacgaccgtgcaggacgcatgcttgcgactggagtgctgcgatcggcgctgccatgggagaacgcgcgtcgatacttctactggcgtctcaggagaaggttgaccgaggtcgctgctgaacgcacggttggcgaggccaacccgacgctgaagcatgttgagaggctggctgtattgcgacagtttgttggtgctgctgcgagcgatgacgacaaggcggtggctgagcacttggaggcttcggccgaccagctgttggccgcatccaaacagttgaaggcacagtacatcttggctcagatctcgacattggaccctgaactgcgcgctcaactagccgcttcgctcaagtaa

SEQ ID NO: 4697 - protein, 2185 aa, Ustilago maydis (corn smut)
MPPPDHKAVSQFIGGNPLETAPASPVADFIRKQGGHSVITKVLICNNGIAAVKEIRSIRKWAYETFGDERAIEFTVMATPEDLKVNADYIRMADQYVEVPGGSNNNNYANVDLIVDVAERAGVHAVWAGWGHASENPRLPESLAASKHKIIFIGPPGSAMRSLGDKISSTIVAQHADVPCMPWSGTGIKETMMSDQGFLTVSDDVYQQACIHTAEEGLEKAEKIGYPVMIKASEGGGGKGIRKCTNGEEFKQLYNAVLGEVPGSPVFVMKLAGQARHLEVQLLADQYGNAISIFGRDCSVQRRHQKIIEEAPVTIAPEDARESMEKAAVRLAKLVGYVSAGTVEWLYSPESGEFAFLELNPRLQVEHPTTEMVSGVNIPAAQLQVAMGIPLYSIRDIRTLYGMDPRGNEVIDFDFSSPESFKTQRKPQPQGHVVACRITAENPDTGFKPGMGALTELNFRSSTSTWGYFSVAASGALHEYADSQFGHIFAYGADRSEARKQMVISLKELSIRGDFRTTVEYLIKLLETDAFESNKITTGWLDGLIQDRLTAERPPADLAVICGAAVKAHLLARECEDEYKRILNRGQVPPRDTIKTVFSIDFIYENVKYNFTATRSSVSGWVLYLNGGRTLVQLRPLTDGGLLIGLSGKSHPVYWREEVGMTRLMIDSKTCLIEQENDPTQIRSPSPGKLVRFLVDSGDHVKANQAIAEIEVMKMYLPLVAAEDGVVSFVKTAGVALSPGDIIGILSLDDPSRVQHAKPFAGQLPDFGMPVIVGNKPHQRYTALVEVLNDILDGYDQSFRMQAVIKELIETLRNPELPYGQASQILSSLGGRIPARLEDVVRNTIEMGHSKNIEFPAARLRKLTENFLRDSVDPAIRGQVQITIAPLYQLFETYAGGLKAHEGNVLASFLQKYYEVESQFTGEADVVLELRLQADGDLDKVVALQTSRNGINRKNALLLTLLDKHIKGTSPVSRTSGATMIEALRKLASLQGKSTAPIALKAREVSLDADMPSLADRSAQMQAILRGSVTSSKYGGDDEYHAPSLEVLRELSDSQYSVYDVLHSFFGHREHHVAFAALCTYVVRAYRAYEIVNFDYAVEDFDVEERAVLTWQFQLPRSASSLKERERQVSISDLSMMDNNRRARPIRELRTGAMTSCADVADIPELLPKVLKFFKSSAGASGAPINVLNVAVVDQTDFVDAEVRSQLALYTNACSKEFSAARVRRVTYLLCQPGLYPFFATFRPNEQGIWSEEKAIRNIEPALAYQLELDRVSKNFELTPVPVSSSTIHLYFARGIQNSADTRFFVRSLVRPGRVQGDMAAYLISESDRIVNDILNVIEVALGQPEYRTADASHIFMSFIYQLDVSLVDVQKAIAGFLERHGTRFFRLRITGAEIRMILNGPNGEPRPIRAFVTNETGLVVRYETYEETVADDGSVILRGIEPQGKDATLNAQSAHFPYTTKVALQSRRSRAHALQTTFVYDFIDVLGQAVRASWRKVAASKIPGDVIKSAVELVFDEQENLREVKRAPGMNNIGMVAWLVEVLTPEYPAGRKLVVIGNDVTIQAGSFGPVEDRFFAAASKLARELGVPRLYISANSGARIGLATEALDLFKVKFVGDDPAKGFEYIYLDDESLQAVQAKAPNSVMTKPVQAADGSVHNIITDIIGKPQGGLGVECLSGSGLIAGETSRAKDQIFTATIITGRSVGIGAYLARLGERVIQVEGSPLILTGYQALNKLLGREVYTSNLQLGGPQIMYKNGVSHLTAQDDLDAVRSFVNWISYVPAQRGGPLPIMPTTDSWDRAVTYQPPRGPYDPRWLINGTKAEDGTKLTGLFDEGSFVETLGGWATSVVTGRARLGGIPVGVIAVETRTLERVVPADPANPNSTEQRIMEAGQVWYPNSAYKTAQAIWDFDKEGLPLVILANWRGFSGGQQDMYDEILKQGSKIVDGLSSYKQPVFVHIPPMGELRGGSWVVVDSAINDNGMIEMSADVNSARGGVLEASGLVEIKYRADKQRATMERLDSVYAKLSKEAAEATDFTAQTTARKALAEREKQLAPIFTAIATEYADAHDRAGRMLATGVLRSALPWENARRYFYWRLRRRLTEVAAERTVGEANPTLKHVERLAVLRQFVGAAASDDDKAVAEHLEASADQLLAASKQLKAQYILAQISTLDPELRAQLAASLK

SEQ ID NO: 4698 - DNA, 8521 bp, Saccharomyces cerevisiae
  CDS (1539)..(8240)
gattgtgtgtgatctgttaaacaagtatacctatattatcttggttattttttttttttctatctgcttttgttaacgctataacgtgtagtatgtacaggcaaagagagtagaagaggaaaatggtcttttttttttttttttctgcaatggagggcgaatgcaataacctattatttctattaattaaacgcaacaaatgtttcccttttgctctacgtaaaggttcctttctctcttttttttgtcggtgtcttttttttttcagtattttctctttttttcaatgaatcgtcgatttccttttcttccttttgcgattaaattatttttacccagctttagcaagccagttcgtacgcagcgactagcaaacagccgggtaactcacattttgtttgcacacttaaaatacccatacagaaccattatatatgttgggttgaattgggacctaatgtgctgctcaggtgccgcgtatatcatgacacttatacttggtggggaatcgcccgtcaggcctgaacgcaacgaacccgcgcatgcatcgacgtcacagtgagctcaggccgcatcacggccgttacgccctccagagtcaccacgactgcgactagtatcatccgtcaagaagaacaagaacaagaacaagaacaagaacaacaaactccgggcacatctctcggcttcagtcgctttcgctcattgcctgtaggttggcccgatatgcgttgacgttatccaaaggggaatgcttcatcttgttgaacaacgcccaacaatttccactgcccaccgaatcgttgcgcccgttaaaatcttcacatggcccggccgcgcgcgcgttgtgccaacaagtcgcagtcgaaattcaaccgctcattgccactctctctactgcttggtgaactaggctatacgctcaatcagcgccaagatatataagaagaacagcactcccagtcgtattctggcacagtatagcctagcacaatcactgtcacaattgttatcggttctacaattgttctgctctcttcaattttcctttccttattctactctttttatccctttcgtacagtttacctgaagataaaaaacaacaaagccaattccctaatttgcaatcgccatttgcatctatatatatatatttgttgtgccatttttttatcctctgtgagtgatcggtgcatgtgtttataaaagtttattcattctactatacgaacttttccctctgcccttccctcccgcttcatccttatttttggacaataaactagagaacaatttgaacttgaattggaattcagattcagagcaagagacaagaaacttccctttttcttctccacatattattatttattcgtgtattttcttttaacgatacgatacgatacgacacgatacgatacgacacgctactatactatacaaatataatagtataataaccgattcgtcttctagcttaatttttttccgttcccgaaacagcgcagaaaattagaaaaaatcaagtttctaccatgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataaaccttgtaaagtaaaaaaaaaaaatagtattgatgtaatttaatttagttgctaatataaattagaaaatacatacatatatatattatgcgcgttttctttcataatccgttctttttacttagaatatattatatatctgtgggaaggggtacaaccttttgctttttagtgtcactgcctatgtgatcggtctgtttcctcttttgcttggcgatggcgttggcgtttttcaaagctttttcttgagctctgcagttttccaagtactctgaaggatc

SEQ ID NO: 4699 - protein, 2233 aa, Saccharomyces cerevisiae
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 4700 - DNA, 1794 bp, Saccharopolyspora erythraea
  CDS (1)..(1794)
atggcccagcaggacgtccaggacacccgtgaacgcaccgcgccgctgcgcaaggtgttggtggcgaatcggggtgagatcgcggtgcgggtgatccgggcttgccgggatgtgggggtgggcagtgtggcggtgtatgcggagccggatgtggatgcggtgttcgtgcggttggccgatgaggcgttcgggttgggtgggtcgacggcggcggagtcgtatctggacatcggcaaggtgatcgatgcggcgcagcgctcaggggcggatgcggtgcatccggggtatgggttcttgtcggagaacgcggatttcgcgcaggcggtgctggatgcgggtctggtgtgggtgggtccgtcgccggaggcgatccgggtgttgggggacaaggtgaccgcgcggcggatcgcgttggaggtgggggcgccgttggtgccggggaccgaggagccggcgtcgggtgctgatgaggtggtggcgttcgctgaggagcacgggttgccggtggcgatcaaggcggcgttcggtggtgggggccgggggttgaaggtggcgcgcagcctggaggagattccggggttgttcgagtcggcggtgcgggaggccgaggcggcgttcggtcggggtgagtgtttcgtggagcggtatctggaccggccgcggcatgtggaggctcaggtgctggcggatcgccatggtggtgtggtggtggtggggacgcgggattgttcgttgcagcggcggcatcagaagttggtggaggaggctccggcgccgtttttgagcgaggagcagcgggagcggatccataccgcggcgcgggagatctgtgcgcgggcgggttatgccggtgccgggacggtggagttcttggtgggtgcggacgggacgatctcgtttttggaggtcaacacgcggttgcaggtggagcatccggtgtcggaggagaccacggggctggatctggtggtcgagcagttgcggatcgcggcgggtgagcggttgtggttgcgggaggatccggtgccggtggggcatgcgatcgagttccggatcaacggggaggatccggggcgggatttcctgccggcgccgggtacggtgcggcgattcgtggtgccgtcgggtccgggggtgcgggtggatgcgggggtggagtccgggagtgtgatcggggggcagttcgactcgttgttggccaaggtgatcgtgtgggggcgggatcgggcgcaggcgttggcgcggtcgcggcgggtgctggccgagatgcgggtggaggggctggccacggtgttgccgtttcaccgggcggtggtggccgatccggcgttcaccgccgaggacgggttcggggtgcacacgcggtggatcgagaccgagttcgacaacacgctgccgccgttcgacggtgcgagcgaggccgaggcgggggtggggcggcggacggtggtggtcgaggtcggtggtcgtcggttggaggtgtcgctgccggctgatctcacgcccgcggcggcgccggccgggggtgcggggcggccgcggcggcggtcggccggcggtggtggtgcgggctcgtcgggggatgcggtgaccgcgccgatgcagggcacgctggtcaagctggtggtggccgagggcgaccgggtcagcgcgggggacgagatcgcggtgctggaggcgatgaagatggagaacccggtgctggcgcacaaggacggcaccgtcaccggactgaccgcccagcccggcgccaccctcacccgaggcagcaccctctgcgaactcaaggactga

SEQ ID NO: 4701 - protein, 597 aa, Saccharopolyspora erythraea
MAQQDVQDTRERTAPLRKVLVANRGEIAVRVIRACRDVGVGSVAVYAEPDVDAVFVRLADEAFGLGGSTAAESYLDIGKVIDAAQRSGADAVHPGYGFLSENADFAQAVLDAGLVWVGPSPEAIRVLGDKVTARRIALEVGAPLVPGTEEPASGADEVVAFAEEHGLPVAIKAAFGGGGRGLKVARSLEEIPGLFESAVREAEAAFGRGECFVERYLDRPRHVEAQVLADRHGGVVVVGTRDCSLQRRHQKLVEEAPAPFLSEEQRERIHTAAREICARAGYAGAGTVEFLVGADGTISFLEVNTRLQVEHPVSEETTGLDLVVEQLRIAAGERLWLREDPVPVGHAIEFRINGEDPGRDFLPAPGTVRRFVVPSGPGVRVDAGVESGSVIGGQFDSLLAKVIVWGRDRAQALARSRRVLAEMRVEGLATVLPFHRAVVADPAFTAEDGFGVHTRWIETEFDNTLPPFDGASEAEAGVGRRTVVVEVGGRRLEVSLPADLTPAAAPAGGAGRPRRRSAGGGGAGSSGDAVTAPMQGTLVKLVVAEGDRVSAGDEIAVLEAMKMENPVLAHKDGTVTGLTAQPGATLTRGSTLCELKD

SEQ ID NO: 4702 - DNA, 1347 bp, Synechocystis sp
  CDS (1)..(1347)
atgcaattcgccaaaattttaattgccaatcggggagagatcgccctacgcatcattcacagttgcgaagaattgggcattcccaccgtggcagtccactccaccatcgatcgccatgccctccacgtgcaactagccaacgagagtgtgtgcattgggccaccccccagcaataaaagctatctcaacattcccaatatcattgccgccgccctcacccgcaacgccactgccattcaccctggttacggatttttagcggaaaatgcccgctttgctgaaatttgtgccgaccatcaaattactttcatcggccccagccctgaagccatcaccgccatgggggataaatccaccgccaagaaaaccatgcaaaagtccggtgtgccctgtgtgcctggcagtccgggcttgattgagtcggaagcaacggccctaaaaattgcagcggaaattggttacccggtaattattaaagccacagctgggggcggcggtagggggatgcgcctcgtccaggaagaaaaggattttctcaaactgttccatgcggcccagggggaagcaggggcggcctttggcaatccaggggtttacctggaaaaattcattgaaaaaccccgccatattgagttccaaattttggccgatagccacggtaacgtagtgcacctgggggaaagggattgttccatccaacggcgacatcaaaagttactcgaagaagcccctagtccctttttgactccccacttgcggaaaaaaatgggggaggcggcggtgaaagcggccaaatccattaactacgtcggagccggcacagtggaatttttggtggatggtaacggtaatttctactttatggaaatgaacacccgcattcaggtggagcatccggttacagaaatgattaccggctatgacttgatttcggaacaaatccgcattgccatgggagaaaaactccgcttccgccagtccgacgtggaaattcgtggccatgccattgaatgccgcattaatgctgaagatcccaaacaaaattttcgcccccaccccggcaaaatcagtgcttatctcccccccggtggccccggagtccgcattgattcccacgtttacaccgactatgaaatccctccctactacgattccctgatcggcaaattaattgtttgggctggcgatcgcccttcggccatcaagagaatgcagagagccttgcgggaatgcgccatcactggagtacccaccacattggaatttcaccagcgcatactacaaaccccagcttttctggccggggatgtgtacaccaatttcatcgaagagcatttaacaccctag

SEQ ID NO: 4703 - protein, 448 aa, Synechocystis sp
MQFAKILIANRGEIALRIIHSCEELGIPTVAVHSTIDRHALHVQLANESVCIGPPPSNKSYLNIPNIIAAALTRNATAIHPGYGFLAENARFAEICADHQITFIGPSPEAITAMGDKSTAKKTMQKSGVPCVPGSPGLIESEATALKIAAEIGYPVIIKATAGGGGRGMRLVQEEKDFLKLFHAAQGEAGAAFGNPGVYLEKFIEKPRHIEFQILADSHGNVVHLGERDCSIQRRHQKLLEEAPSPFLTPHLRKKMGEAAVKAAKSINYVGAGTVEFLVDGNGNFYFMEMNTRIQVEHPVTEMITGYDLISEQIRIAMGEKLRFRQSDVEIRGHAIECRINAEDPKQNFRPHPGKISAYLPPGGPGVRIDSHVYTDYEIPPYYDSLIGKLIVWAGDRPSAIKRMQRALRECAITGVPTTLEFHQRILQTPAFLAGDVYTNFIEEHLTP

SEQ ID NO: 4704 - DNA, 1970 bp, Arabidopsis thaliana (mouse-ear cress)
  CDS (140)..(1753)
gaggattcaatatctcacagtttcactctcaacatttcattctctctctctctcaacaattagatctgtttcgataatcacgaggtttccctcacttcctttccattgctaaaccaggatttgcctcctgcatttggaaatggacgcttctatgattaccaattccaaatccattacttctccaccctctttagccttagggaagtcaggaggaggaggagttatcagaagttcactatgtaacttaatgatgccaagcaaagttaacttccctagacaaagaactcaaactctaaaggttagccagaagaaactcaagagagctactagtggtggtcttggtgttacatgcagtggtggtgataagattctcgtagcgaatcgaggtgaaattgcagttcgtgttatcagaactgctcatgaaatggggattccttgtgtcgctgtgtattctactatagataaagatgctcttcatgttaaattagctgatgaagctgtttgtattggtgaagctcctagtaaccagtcgtatttggtgattccgaatgttctgtctgcggctattagccgtggatgtacaatgcttcatcctggatatggttttctttcggagaatgctctctttgttgaaatgtgtagagaccatgggatcaattttattggacctaatcctgatagcatccgtgttatgggagacaaagcgactgcaagagagacaatgaaaaatgcaggggtacccactgtaccagggagtgatgggctattgcagagtacagaagaagctgtcagggtcgccaatgagattggtttccctgtaatgatcaaggcaacagctggtggtggtggacgtggaatgcgtcttgctaaggaaccgggagagtttgtaaaactgttgcagcaagctaagagcgaggctgctgctgcttttgggaatgatggatgttatctggagaagttcgtacaaaaccctagacatattgagttccaggtgctggcagataaatttggaaatgttgttcactttggtgagcgtgactgcagcatccagaggcgtaaccaaaagcttctggaagaagcaccttctccagcattgaccgctgaattgcgaaaagccatgggtgatgcagcagtcgcagcagcagcatccattgggtacattggtgttggtactgtggagtttcttttagatgagagaggttccttctacttcatggaaatgaacactaggatccaggtggagcatcctgtaacagagatgatttactctgttgatttgatagaggagcagattcgtgttgcaatgggagagaaacttcgttacaaacaggaagatattgtgctcagagggcactcaattgaatgtcgtatcaatgcagaagatccatttaaaggattcagacctggacctggcagaataacatcatacctgccatctggaggtcctttcgttagaatggacagccatgtctattccgactatgttgtgcctccaagctatgattctcttcttgggaagcttattgtgtgggctccaacgagggaaaaagcaattgaacggatgaagcgtgcgcttaatgacactatcattacaggggttccaacgactatcaattaccacaaacttatccttgatgttgaggatttcaaaaatggaaaagttgatacagctttcatcgtcaagcatgaagaggagctagctgagcctcaagaaattgtggcagtgaaagatctgacaaacgcaacggtttagaatgatacatcagctctgaaagaccacccaattattgcaatcttcgtctccttttgtgtgttcattggtacaaacttcggtaacgataagactgttttactagagtctgtggttttatcaatgttcttcttgtatcataaacaagaggaaacacttttgtttgtagtctctatgtcaagatttttcaataattttcatatatagtagagattatatg

SEQ ID NO: 4705 - protein, 537 aa, Arabidopsis thaliana (mouse-ear cress)
MDASMITNSKSITSPPSLALGKSGGGGVIRSSLCNLMMPSKVNFPRQRTQTLKVSQKKLKRATSGGLGVTCSGGDKILVANRGEIAVRVIRTAHEMGIPCVAVYSTIDKDALHVKLADEAVCIGEAPSNQSYLVIPNVLSAAISRGCTMLHPGYGFLSENALFVEMCRDHGINFIGPNPDSIRVMGDKATARETMKNAGVPTVPGSDGLLQSTEEAVRVANEIGFPVMIKATAGGGGRGMRLAKEPGEFVKLLQQAKSEAAAAFGNDGCYLEKFVQNPRHIEFQVLADKFGNVVHFGERDCSIQRRNQKLLEEAPSPALTAELRKAMGDAAVAAAASIGYIGVGTVEFLLDERGSFYFMEMNTRIQVEHPVTEMIYSVDLIEEQIRVAMGEKLRYKQEDIVLRGHSIECRINAEDPFKGFRPGPGRITSYLPSGGPFVRMDSHVYSDYVVPPSYDSLLGKLIVWAPTREKAIERMKRALNDTIITGVPTTINYHKLILDVEDFKNGKVDTAFIVKHEEELAEPQEIVAVKDLTNATV

SEQ ID NO: 4706 - DNA, 1921 bp, Nicotiana tabacum (common tobacco)
  CDS (85)..(1695)
ctagctccgccctctctctttctctctgtcaaagtaaatagttcttggcaggaatacaggaattagattacattgatcaggaaaatggactcggcagccctgactagcgtttgtggcaaatctgctcttcgcttcactccgggtttatttctggggagaacgaatggtattaggagctcgcagtgtagctttatggcaggaaaccggataaactttccgcggcagagagctcaagcatatagagttagtactaaatctagcacacgtggtggtgctcttgctgcaacatgtcgcgccgagaagattctggtggcaaatcgaggagaaattgctgttcgtgtgattcgaactgcccatgagatgggaattccttgtgttgctgtttattcgaccatagacaaagatgccttacatgtgaagctagctgatgaatctgtttgcattggtgaagcaccaagcaatcaatcgtatttagtgatcccaaatgtcttatctgctgctatcagtcgtggatgtacaatgttgcatcctggatatggtttccttgctgagaatgcagtttttgttgagatgtgcagagaacatggaatcaactttattgggccaaatccagacagtattagagtcatgggtgacaaatccactgccagagatacaatgaagaatgctggtgttccaactgtgccaggaagtgatggactattacagagcactgaagaaggtgtaaggcttgctgaggagattggttaccctgtgatgattaaggcaacagctggtggtggtggacgtggaatgcgtcttgctaaagaacctgatgagtttgtaaaattattacagcaagctaaaagtgaagcagctgctgcatttggaaatgatggcgtttatctggagaagtacgtccaaaatcctaggcacattgaatttcaggttttggcggacaagtatggtaatgttgtacactttggagagcgtgattgcagtattcagagaaggaaccagaagttgctggaggaagcaccttcccctgcattaacaccagagctaaggaacgccatgggtgacgcagctgttgcggcagcagcatccataggttacattggtgttggtaccgtggagttcctattggatgagagagggtccttttacttcatggaaatgaacactcgtattcaggtagagcatccagtgacagaaatgatatcctctgttgatctgatagaggaacagatccgtgtggctatgggagaaaagctccgatacaaacaggaggatattgtgcttagaggacattcaattgaatgccgtataaatgcagaagatgctttcaaaaatttcagacccggaccagggagaatcactgcctatttaccagctggaggtccatttgtgcgtatggataaccacgtttatcctgactatgtggttccacctagcgacgattccctgctaggaaagctcatcgtatgggctccaacacgcgagggggctattgaacgcatgaaaagagcacttaatgacaccataattactggagttcctaccacaatagaatatcataagctcatcctcgatattgaggactttaagaatggaaagtttgatccttcttttattcccaagcatggaggagaattagctcccccccacaaaatggttccagcagctaccaaggagatggtcaatgctagtgcttaattcttcctctttttttttttttttttttctttgatatttttcctttacccttgtcggcgaatagtgaaagcagattgctcccattggatcttgaggtgactgcagttctggatataacattcatctctttgatcttagcttgaatgtatttttagatacactagactgaatgaaattctttttttggtatatgatgctcaatcgaatctgtgttaaatggcaaaag

SEQ ID NO: 4707 - protein, 536 aa, Nicotiana tabacum (common tobacco)
MDSAALTSVCGKSALRFTPGLFLGRTNGIRSSQCSFMAGNRINFPRQRAQAYRVSTKSSTRGGALAATCRAEKILVANRGEIAVRVIRTAHEMGIPCVAVYSTIDKDALHVKLADESVCIGEAPSNQSYLVIPNVLSAAISRGCTMLHPGYGFLAENAVFVEMCREHGINFIGPNPDSIRVMGDKSTARDTMKNAGVPTVPGSDGLLQSTEEGVRLAEEIGYPVMIKATAGGGGRGMRLAKEPDEFVKLLQQAKSEAAAAFGNDGVYLEKYVQNPRHIEFQVLADKYGNVVHFGERDCSIQRRNQKLLEEAPSPALTPELRNAMGDAAVAAAASIGYIGVGTVEFLLDERGSFYFMEMNTRIQVEHPVTEMISSVDLIEEQIRVAMGEKLRYKQEDIVLRGHSIECRINAEDAFKNFRPGPGRITAYLPAGGPFVRMDNHVYPDYVVPPSDDSLLGKLIVWAPTREGAIERMKRALNDTIITGVPTTIEYHKLILDIEDFKNGKFDPSFIPKHGGELAPPHKMVPAATKEMVNASA

SEQ ID NO: 4708 - DNA, 1998 bp, Leishmania major
  CDS (1)..(1998)
atgcctgctccgattttcgacaaggttctcgtcgccaaccgcggcgagatcgcctgtcgtgtgatggcgacctgccagcgcctgggaatcaagacggtggctgtctactccaccgccgatgagcaggccaaacacgtgaaggtggcggacgagggcgtctgcattggccccccggcctccgtggagagctacctgtgtattgacaagattgtggatgcctgcaagaagacgggtgctcaggccgttcatccaggctacggcttcctgtccgagaacggcgagtttcaagcagccttgcacaagaataacattatcttcgttggcccagacgcgcactctatcgaggcgatgggcgacaagatcgagtcgaagcgacttgcacacagtgctggcgtgacgtgcattcctggcttcatcggcgaggtgaagacgcacgaggacgtgctgaagtttgcgagagaggtcggctacccggtcatgatcaaggcttccggcggtggtggtggcaagggcatgcgagtagcgtacaatgacagtcagtgcgtggagtactacgacatgtgcagggaggaggccaaggccgccttcaacagcgacaagatgctcgtcgagaagttcatcgaaaacccgcgtcacatcgagatccaggtgatcgcggatcgcaggggcaacaccctgtacctgccggagcgcgagtgctccattcagcgccgcaaccagaaggtgatcgaggaggcgccgtcggtcctgttggatgcaaagacccgcaaggccatgggcgaggaggctgtcgcgatggcgcgagccgtacagtacgtcagcgccggcacggtcgagaacgtcgtcaacccgcagaagcagttctacttcctcgagatgaacacccgcctccaggtggagcaccccatcacggaggagatcaccggcatcgatctcgtggagcagatgctccgtgccgcggcagacctgccgctcagcatcacgcaggacgacatcaagattaacggccatgccacggagtgtcgcgtgtacgccgaggacccgatgaagaactacttcccatccatcggccgcctcaccatgtaccaggagccgaccggccccggcgtgcgctgcgactctggcatcatcgaagggtcgcagatctcggtttattacgacccgctcatctgcaagctgtccacctggggaaaggaccgcgcggcgtgcatcgagcgtatggagaaggcgctggacgagtacgtcattcgcggcctgcgccacaatatttgcctcctgcgcgacgttgtcacggagccgcgttaccagagtggtaacctcaccaccaactacctgccggagcagtacccgaacggcttcaagaaggcagagctgaccgcggaggagacgcagctgatgtatgaggcggcagcctgcatgcacctgaagcgcgagcgcactcactacacccagggcatcgctccgtcggagcgtcagttctacgtttctgtcggcgctaggcaggagggcgagatgccggtgtacgtccagcagctcgacgattcccacttcgaggtcgccgcgtcgaagagcggcccgttcaagaagctggagatggcgtggaaagtcagctacccgatcatccgcgtgaacgatggagagaaggagacggtgctgcagttctggggcaccaacgaagtgacgtacggcatccagatgaagggcaccaccttcgacgtgaatgtaatgagcgacttgcagtccgtgctgggccacttcgtgccggctgtagagatcaccgtcaacacgaagcagattctgtcgccgatgccaggtgtcattgtcgccatcaaggttcagcctgggcagacggtggtcgccggtgaagagcttctgacgctggaggccatgaagatgcgcaacaagatccacgctcaagcagacggcaaggtgaaggagatcaaggtcacgctcggcgccactgtggaggatagcgaggtgctggtcgagcttgagtaa

SEQ ID NO: 4709 - protein, 665 aa, Leishmania major
MPAPIFDKVLVANRGEIACRVMATCQRLGIKTVAVYSTADEQAKHVKVADEGVCIGPPASVESYLCIDKIVDACKKTGAQAVHPGYGFLSENGEFQAALHKNNIIFVGPDAHSIEAMGDKIESKRLAHSAGVTCIPGFIGEVKTHEDVLKFAREVGYPVMIKASGGGGGKGMRVAYNDSQCVEYYDMCREEAKAAFNSDKMLVEKFIENPRHIEIQVIADRRGNTLYLPERECSIQRRNQKVIEEAPSVLLDAKTRKAMGEEAVAMARAVQYVSAGTVENVVNPQKQFYFLEMNTRLQVEHPITEEITGIDLVEQMLRAAADLPLSITQDDIKINGHATECRVYAEDPMKNYFPSIGRLTMYQEPTGPGVRCDSGIIEGSQISVYYDPLICKLSTWGKDRAACIERMEKALDEYVIRGLRHNICLLRDVVTEPRYQSGNLTTNYLPEQYPNGFKKAELTAEETQLMYEAAACMHLKRERTHYTQGIAPSERQFYVSVGARQEGEMPVYVQQLDDSHFEVAASKSGPFKKLEMAWKVSYPIIRVNDGEKETVLQFWGTNEVTYGIQMKGTTFDVNVMSDLQSVLGHFVPAVEITVNTKQILSPMPGVIVAIKVQPGQTVVAGEELLTLEAMKMRNKIHAQADGKVKEIKVTLGATVEDSEVLVELE

SEQ ID NO: 4710 - DNA, 6993 bp, Triticum aestivum (common wheat)
  CDS (39)..(6974)
gaacactgcatctgcgctgtttgtccaaagggaggacgatgggatccacacatttgcccattgtcggccttaatgcctcgacaacaccatcgctatccactattcgcccggtaaattcagccggtgctgcattccaaccatctgccccttctagaacctccaagaagaaaagtcgtcgtgttcagtcattaagggatggaggcgatggaggcgtgtcagaccctaaccagtctattcgccaaggtcttgccggcatcattgacctcccaaaggagggcacatcagctccggaagtggatatttcacatgggtccgaagaacccaggggctcctaccaaatgaatgggatactgaatgaagcacataatgggaggcatgcttcgctgtctaaggttgtcgaattttgtatggcattgggcggcaaaacaccaattcacagtgtattagttgcgaacaatggaatggcagcagctaagttcatgcggagtgtccgaacatgggctaatgaaacatttgggtcagagaaggcaattcagttgatagctatggctactccagaagacatgaggataaatgcagagcacattagaattgctgatcaatttgttgaagtacccggtggaacaaacaataacaactatgcaaatgtccaactcatagtggagatagcagtgagaaccggtgtttctgctgtttggcctggttggggccatgcatctgagaatcctgaacttccagatgcactaaatgcaaacggaattgtttttcttgggccaccatcatcatcaatgaacgcactaggtgacaaggttggttcagctctcattgctcaagcagcaggggttccgactcttccttggagtggatcacaggtggaaattccattagaagtttgtttggactcgatacccgcggagatgtataggaaagcttgtgttagtactacggaggaagcacttgcgagttgtcagatgattgggtatcccgccatgattaaagcatcatggggtggtggtggtaaagggatccgaaaggttaataatgacgatgatgtcagagcactgtttaagcaagtgcaaggtgaagttcctggctccccaatatttatcatgagacttgcatctcagagtcgacatcttgaagttcagttgctttgtgatcaatatggcaatgtagctgcgcttcacagtcgtgactgcagtgtgcaacggcgacaccaaaagattattgaggaaggaccagttactgttgctcctcgcgagacagtgaaagagctagagcaagcagcaaggaggcttgctaaggctgtgggttatgttggtgctgctactgttgaatatctctacagcatggagactggtgaatactattttctggaacttaatccacggttgcaggttgagcatccagtcaccgagtggatagctgaagtaaacttgcctgcagctcaagttgcagttggaatgggtatacccctttggcaggttccagagatcagacgtttctatggaatggacaatggaggaggctatgacatttggaggaaaacagcagctcttgctactccatttaacttcgatgaagtggattctcaatggccaaagggtcattgtgtagcagttaggataaccagtgaggatccagatgacggattcaagcctaccggtggaaaagtaaaggagatcagttttaaaagcaagccaaatgtttgggcctatttctctgttaagtccggtggaggcattcatgaatttgctgattctcagtttggacatgtttttgcatatggagtgtctagagcagcagcaataaccaacatgtctcttgcgctaaaagagattcaaattcgtggagaaattcattcaaatgttgattacacagttgatctcttgaatgcctcagacttcaaagaaaacaggattcatactggctggctggataacagaatagcaatgcgagtccaagctgagagacctccgtggtatatttcagtggttggaggagctctatataaaacaataacgagcaacacagacactgtttctgaatatgttagctatctcgtcaagggtcagattccaccgaagcatatatcccttgtccattcaactgtttctttgaatatagaggaaagcaaatatacaattgaaactataaggagcggacagggtagctacagattgcgaatgaatggatcagttattgaagcaaatgtccaaacattatgtgatggtggacttttaatgcagttggatggaaacagccatgtaatttatgctgaagaagaggccggtggtacacggcttctaattgatggaaagacatgcttgttacagaatgatcacgatccttcaaggttattagctgagacaccctgcaaacttcttcgtttcttggttgccgatggtgctcatgttgaagctgatgtaccatatgcggaagttgaggttatgaagatgtgcatgcccctcttgtcacctgctgctggtgtcattaatgttttgttgtctgagggccagcctatgcaggctggtgatcttatagcaagacttgatcttgatgacccttctgctgtgaagagagctgagccatttaacggatctttcccagaaatgagccttcctattgctgcttctggccaagttcacaaaagatgtgccacaagcttgaatgctgctcggatggtccttgcaggatatgatcacccgatcaacaaagttgtacaagatctggtatcctgtctagatgctcctgagcttcctttcctacaatgggaagagcttatgtctgttttagcaactagacttccaaggcttcttaagagcgagttggagggtaaatacagtgaatataagttaaatgttggccatgggaagagcaaggatttcccttccaagatgctaagagagataatcgaggaaaatcttgcacatggttctgagaaggaaattgctacaaatgagaggcttgttgagcctcttatgagcctactgaagtcatatgagggtggcagagaaagccatgcacactttattgtgaagtcccttttcgaggactatctctcggttgaggaactattcagtgatggcattcagtctgatgtgattgaacgcctgcgccaacaacatagtaaagatctccagaaggttgtagacattgtgttgtctcaccagggtgtgagaaacaaaactaagctgatactaacactcatggagaaactggtctatccaaaccctgctgtctacaaggatcagttgactcgcttttcctccctcaatcacaaaagatattataagttggcccttaaagctagcgagcttcttgaacaaaccaagcttagtgagctccgcacaagcattgcaaggagcctttcagaacttgagatgtttactgaagaaaggacggccattagtgagatcatgggagatttagtgactgccccactgccagttgaagatgcactggtttctttgtttgattgtagtgatcaaactcttcagcagagggtgatcgagacgtacatatctcgattataccagcctcatcttgtcaaggatagtatccagctgaaatatcaggaatctggtgttattgctttatgggaattcgctgaagcgcattcagagaagagattgggtgctatggttattgtgaagtcgttagaatctgtatcagcagcaattggagctgcactaaagggtacatcacgctatgcaagctctgagggtaacataatgcatattgctttattgggtgctgataatcaaatgcatggaactgaagacagtggtgataacgatcaagctcaagtcaggatagacaaactttctgcgacactggaacaaaatactgtcacagctgatctccgtgctgctggtgtgaaggttattagttgcattgttcaaagggatggagcactcatgcctatgcgccataccttcctcttgtcggatgaaaagctttgttatgaggaagagccggttctccggcatgtggagcctcctctttctgctcttcttgagttgggtaagttgaaagtgaaaggatacaatgaggtgaagtatacaccgtcacgtgatcgtcagtggaacatatacacacttagaaatacagagaaccccaaaatgttgcacagggtgtttttccgaactcttgtcaggcaacccggtgcttccaacaaattcacatcaggcaacatcagtgatgttgaagtgggaggagctgaggaatctctttcatttacatcgagcagcatattaagatcgctgatgactgctatagaagagttggagcttcacgcgattaggacaggtcactctcatatgtttttgtgcatattgaaagagcaaaagcttcttgatcttgttcccgtttcagggaacaaagttgtggatattggccaagatgaagctactgcatgcttgcttctgaaagaaatggctctacagatacatgaacttgtgggtgcaaggatgcatcatctttctgtatgccaatgggaggtgaaacttaagttggacagcgatgggcctgccagtggtacctggagagttgtaacaaccaatgttactagtcacacctgcactgtggatatctaccgtgaggtcgaagatacagaatcacagaaactagtgtaccactctgctccatcgtcatctggtcctttgcatggcgttgcactgaatactccatatcagcctttgagtgttattgatctgaaacgttgctccgctagaaataacagaactacatactgctatgattttccgttggcatttgaaactgcagtgcagaagtcatggtctaacatttctagtgacactaaccgatgttatgttaaagcgacggagctggtgtttgctcacaagaacgggtcatggggcactcctgtaattcctatggagcgtcctgctgggctcaatgacattggtatggtagcttggatcttggacatgtccactcctgaatatcccaatggcaggcagattgttgtcatcgcaaatgatattacttttagagctggatcgtttggtccaagggaagatgcattttttgaaactgttaccaacctagcttgtgagaggaagcttcctctcatctacttggcagcaaactctggtgctcggatcggcatagcagatgaagtaaaatcttgcttccgtgttggatggtctgatgatggcagccctgaacgtgggtttcaatatatttatctgactgaagaagaccatgctcgtattagcgcttctgttatagcgcacaagatgcagcttgataatggtgaaattaggtgggttattgattctgttgtagggaaggaggatgggctaggtgtggagaacatacatggaagtgctgctattgccagtgcctattctagggcctatgaggagacatttacgcttacatttgtgactggaaggactgttggaataggagcatatcttgctcgacttggcatacggtgcatacagcgtactgaccagcccattatcctaactgggttctctgccttgaacaagcttcttggccgggaagtttacagctcccacatgcagttgggtggccccaaaattatggcgacaaacggtgttgtccatctgacagtttcagatgaccttgaaggtgtatctaatatattgaggtggctcagctatgttcctgccaacattggtggacctcttcctattacaaaatctttggacccacctgacagacccgttgcttacatccctgagaatacatgcgatcctcgtgctgccatcagtggcattgatgatagccaagggaaatggttggggggcatgttcgacaaagacagttttgtggagacatttgaaggatgggcgaagtcagttgttactggcagagcgaaactcggagggattccggtgggtgttatagctgtggagacacagactatgatgcagctcatccctgctgatccaggccagcttgattcccatgagcgatctgttcctcgtgctgggcaagtctggtttccagattcagctactaagacagcgcaggcaatgctggacttcaaccgtgaaggattacctctgttcatccttgctaactggagaggcttctctggtggacaaagagatctttttgaaggaatccttcaggctgggtcaacaattgttgagaaccttaggacatacaatcagcctgcctttgtatatatccccaaggctgcagagctacgtggaggggcttgggtcgtgattgatagcaagataaatccagatcgcattgagttctatgctgagaggactgcaaagggcaatgttctcgaacctcaagggttgatcgagatcaagttcaggtcagaggaactccaagagtgcatgggtaggcttgatccagaattgataaatctgaaggcaaagctccagggagtaaagcatgaaaatggaagtctacctgagtcagaatcccttcagaagagcatagaagcccggaagaaacagttgttgcctttgtatactcaaattgcggtacggttcgctgaattgcatgacacttcccttagaatggctgctaagggtgtgattaagaaggttgtagactgggaagattctaggtcgttcttctacaagagattacggaggaggatatccgaggatgttcttgcgaaggaaattagaggtgtaagtggcaagcagttttctcaccaatcggcaatcgagctgatccagaaatggtacttggcctctaagggagctgaaacaggaagcactgaatgggatgatgacgatgcttttgttgcctggagggaaaaccctgaaaactaccaggagtatatcaaagaactcagggctcaaagggtatctcagttgctctcagatgttgcagactccagtccagatctagaagccttgccacagggtctttctatgctattagagaagatggatccctcaaggagagcacagtttgttgaggaagtcaagaaagtccttaaatgatcagatgataccgtcgacg

SEQ ID NO: 4711 - protein, 2311 aa, Triticum aestivum (common wheat)
MGSTHLPIVGLNASTTPSLSTIRPVNSAGAAFQPSAPSRTSKKKSRRVQSLRDGGDGGVSDPNQSIRQGLAGIIDLPKEGTSAPEVDISHGSEEPRGSYQMNGILNEAHNGRHASLSKVVEFCMALGGKTPIHSVLVANNGMAAAKFMRSVRTWANETFGSEKAIQLIAMATPEDMRINAEHIRIADQFVEVPGGTNNNNYANVQLIVEIAVRTGVSAVWPGWGHASENPELPDALNANGIVFLGPPSSSMNALGDKVGSALIAQAAGVPTLPWSGSQVEIPLEVCLDSIPAEMYRKACVSTTEEALASCQMIGYPAMIKASWGGGGKGIRKVNNDDDVRALFKQVQGEVPGSPIFIMRLASQSRHLEVQLLCDQYGNVAALHSRDCSVQRRHQKIIEEGPVTVAPRETVKELEQAARRLAKAVGYVGAATVEYLYSMETGEYYFLELNPRLQVEHPVTEWIAEVNLPAAQVAVGMGIPLWQVPEIRRFYGMDNGGGYDIWRKTAALATPFNFDEVDSQWPKGHCVAVRITSEDPDDGFKPTGGKVKEISFKSKPNVWAYFSVKSGGGIHEFADSQFGHVFAYGVSRAAAITNMSLALKEIQIRGEIHSNVDYTVDLLNASDFKENRIHTGWLDNRIAMRVQAERPPWYISVVGGALYKTITSNTDTVSEYVSYLVKGQIPPKHISLVHSTVSLNIEESKYTIETIRSGQGSYRLRMNGSVIEANVQTLCDGGLLMQLDGNSHVIYAEEEAGGTRLLIDGKTCLLQNDHDPSRLLAETPCKLLRFLVADGAHVEADVPYAEVEVMKMCMPLLSPAAGVINVLLSEGQPMQAGDLIARLDLDDPSAVKRAEPFNGSFPEMSLPIAASGQVHKRCATSLNAARMVLAGYDHPINKVVQDLVSCLDAPELPFLQWEELMSVLATRLPRLLKSELEGKYSEYKLNVGHGKSKDFPSKMLREIIEENLAHGSEKEIATNERLVEPLMSLLKSYEGGRESHAHFIVKSLFEDYLSVEELFSDGIQSDVIERLRQQHSKDLQKVVDIVLSHQGVRNKTKLILTLMEKLVYPNPAVYKDQLTRFSSLNHKRYYKLALKASELLEQTKLSELRTSIARSLSELEMFTEERTAISEIMGDLVTAPLPVEDALVSLFDCSDQTLQQRVIETYISRLYQPHLVKDSIQLKYQESGVIALWEFAEAHSEKRLGAMVIVKSLESVSAAIGAALKGTSRYASSEGNIMHIALLGADNQMHGTEDSGDNDQAQVRIDKLSATLEQNTVTADLRAAGVKVISCIVQRDGALMPMRHTFLLSDEKLCYEEEPVLRHVEPPLSALLELGKLKVKGYNEVKYTPSRDRQWNIYTLRNTENPKMLHRVFFRTLVRQPGASNKFTSGNISDVEVGGAEESLSFTSSSILRSLMTAIEELELHAIRTGHSHMFLCILKEQKLLDLVPVSGNKVVDIGQDEATACLLLKEMALQIHELVGARMHHLSVCQWEVKLKLDSDGPASGTWRVVTTNVTSHTCTVDIYREVEDTESQKLVYHSAPSSSGPLHGVALNTPYQPLSVIDLKRCSARNNRTTYCYDFPLAFETAVQKSWSNISSDTNRCYVKATELVFAHKNGSWGTPVIPMERPAGLNDIGMVAWILDMSTPEYPNGRQIVVIANDITFRAGSFGPREDAFFETVTNLACERKLPLIYLAANSGARIGIADEVKSCFRVGWSDDGSPERGFQYIYLTEEDHARISASVIAHKMQLDNGEIRWVIDSVVGKEDGLGVENIHGSAAIASAYSRAYEETFTLTFVTGRTVGIGAYLARLGIRCIQRTDQPIILTGFSALNKLLGREVYSSHMQLGGPKIMATNGVVHLTVSDDLEGVSNILRWLSYVPANIGGPLPITKSLDPPDRPVAYIPENTCDPRAAISGIDDSQGKWLGGMFDKDSFVETFEGWAKSVVTGRAKLGGIPVGVIAVETQTMMQLIPADPGQLDSHERSVPRAGQVWFPDSATKTAQAMLDFNREGLPLFILANWRGFSGGQRDLFEGILQAGSTIVENLRTYNQPAFVYIPKAAELRGGAWVVIDSKINPDRIEFYAERTAKGNVLEPQGLIEIKFRSEELQECMGRLDPELINLKAKLQGVKHENGSLPESESLQKSIEARKKQLLPLYTQIAVRFAELHDTSLRMAAKGVIKKVVDWEDSRSFFYKRLRRRISEDVLAKEIRGVSGKQFSHQSAIELIQKWYLASKGAETGSTEWDDDDAFVAWRENPENYQEYIKELRAQRVSQLLSDVADSSPDLEALPQGLSMLLEKMDPSRRAQFVEEVKKVLK

SEQ ID NO: 4712 - DNA, 6786 bp, Glycine max (soybean)
  CDS (1)..(6786)
atggctgacattgggcgtaggaatggatattcaaacagtgtactaccaaataggccacctgctgcaatatctgaagtagatgaattctgcaatgcccttggtggaaacaggccaattcatagtatattaattgcaaataatggaatggcagcagtcaagtttatacgtagtgttaggagctgggcctatgagacatttggctcagagaaagccatcttgttggttgccatggctactccagaggacatgagaatcaatgcagaacatatcagaatagctgatcaatttgtggaagtacctggtgggaccaataacaataactatgccaacgtgcagcttattcttgagatggctgagataactcatgttgatgcggtgtggcctggttggggtcatgcatcagaaaatcctgagcttccagatgcattaaaagcaaaaggaattgtatttcttggacctcctgctatatctatggctgcattgggggataaaattggttcatcattgattgctcaagcagcggaagtgcctacccttccatggagtggttctcatgtgaaaattccgcctgaaagttccttgattactattcctgatgaaatttatcgggaagcatgtgtttatacaacagaggaagcagtggcaagttgtcaagttgtaggataccctgcaatgatcaaggcatcttggggtggtggtggtaaaggaataagaaaggttcataatgatgatgaggtaagggcattgttcaagcaagttcaaggtgaagttccgggttcacccatatttataatgaaggttgcatcccagagccgacatctagaagtccagttactttgtgatcagtacggaaatgtcgcagctttgcatagccgtgattgcagtgttcaaaggaggcaccaaaagattattgaggaggggcccattactgtagcaaccatagaaacagtgaaaaaactggaacaggccgctagaaggttggctatatctgtaaattatgttggggcggctactgttgagtatctttatagtatggaaactggcgagtactactttttagagttgaaccctcggctacaggttgaacatcctgttactgagtggatagcagagataaatctgccagcagcacaagttgccattgggatgggtgttcctctctggcaaattcctgagataaggcgtttctatggggtggaacatggtggagggtatgatgcttggagaaaaacatccgttttagctaccccttttgattttgacaaagcacaatctacaaggccaaaaggtcattgtgtggctgtgcgagtaactagtgaggaccctgatgatggttttaagcctacaagtggcaaagtgcaggagcttaactttaaaagcaagccaaatgtgtgggcgtacttctctgtcaagtctggaggaggaattcatgaattctcagattcacagtttggtcatgtttttgcttttggagaatctagggctttagcaattgcaaatatggttctggggctgaaggagattcagattcggggagaaatccgtaccaatgttgataacaccattgatcttctgaatgcttcagactacagagaaaacaaaattcacacaggttggctggacagtagaattgcaatgcgggttagagcagaaaggcctgcctggtatctttcggtcgttggaggggcactctataaagcttctgatagcagtgcagctttggttacagattatgttggttatcttgaaaagggacaaatccctcccaagcacatatctcttgtccattctcaagtgtccttgaacattgaaggaagcaaatatacgattgacatgatacgaggtgggtctggaagttatagattgagaatgaatcaatcagagatagaagcagaaatacatactttacgtgatggaggtttgctaatgcagttggatggaaacagtcatgtaatatatgcagagggagaagcagctggaactcgccttctaatagatggaaggacttgcttgcttcagaatgatcatgatccatcaaagttggttgcggagacaccatgcaagcttctgagatatttggttgcagatgacagtcatgttgatgctgacacaccatatgctgaagttgaggtcatgaaaatgtgcatgcctcttctttcgcctgcttctgggattattcatttcacaatgtctgaaggtcaagcaatgcaggctggtgaacttatagcaaggcttgatctggatgatccttcagctgtaagaaaggcagaacccttcactgggagcttcccagttctgggacctcctactgcaatttctgtaaaagttcatcagaaatgcgctgccagcttaaatgccgcgcggatgattctctctgggtatgagcacaatattgatgaagtggttgtgcaaagtttgcttaattgccttgatagtcctgaattgcctttccttcaatggcaagagtgcttggcagttcttgcaacccgccttcccaaagagctaaaaaatgagttggaatcaaaatatcaggagtttgaggggatttcaagctcccaaattgttgatttccctgccaaattattgaagggaattattgaagctcatctttcctcctgtcccgacaaagaaaaaggagctcaagaaagactagttgaacctctattgagtcttgttaagtcttatgagggtggaagagagagccatgcccatataattgtccaatccctatttgatgagtatctttctgttgaagaattatttagcgataatattcaggctgatgtgattgaacgtctgcgtctacaatacaagaaagatctattgaagattgttgatatagtgctctctcatcagggaatcaagagtaaaaataagctgatcttgcaactgatggataaattggtttaccctaaccctgttgcctatagggatcagttaatccgtttctctttactccaccatacaaattattctgagttggctctaaaggcaagtcaactgctggaacaaactaaattaagtgaacttcgatccaacattgctagaagtctttccgaattagagatgttcacagaggatggtgaaaatattgatacacccaagaggaagagtgccattaatgaccgaatggaggaccttgtgagtgctccttttgcagttgaagatgctctcgtgggtttatttgatcacagtgatcacacccttcagaggagggttgtggaaagttatatacgtaggctctatcagccatatcttgtcaaagggagtgccaggatgcaatggcacagatctggtcttattgctacatgggagttctatgatgagtacattgaaaggaagaatggggttgaagaccaaagtttgagtaaaacagtggaggagaaacatagtgagaaaaagtggggagtgatggttataattaaatctcttcaatttttgcctgcaattatcactgctgcattgagggaggcaaccaacaaccctcacgaagcacttacaagtggttctgtggaaccagttaactatggtaatatgatgcatattggattagtgggcatcaacaaccagatgagtttactgcaagacagtggtgatgaggatcaagctcaagaaagaatcaataagttagctaaaatactcaaagagcaggaagtaggctccaccatacgagctgcaggtgtcggtgtaatcagctgtatcatacaaagggatgaagggcgtgccccaatgaggcactcctttcactggtcagaagaaaagctttactatgcggaggaacctctgttgcgtcatctggaacctccgctatccatttatcttgaattggacaaacttaaagcctatgagaatatacggtatactccatctcgagatcgtcaatggcacctctacacagttgtggatcacaagccacaaccaattcaaagaatgtttcttcgaacacttgtaagacagccgacaacaaatgaaggattttcttcatatcaaaggctggatgcagaaacatctcgtacccaattggccatgtcctttacttcaaggagcatttttaggtctttgatggctgcaatggaggagttggaacttaatgcacacaatgtcaatatcaaatctggacatgctcatatgtacctatatatcatacgcgaacaacaaatagatgatcttgtgccctatcccaagagaattaacatagaagctgggaaagaagaaataacagttgaggcagtcttggaagaactggcacgggaaatccattcatctgttggtgtaagaatgcatagattaggggttgttgtgtgggaaatcaagctctggatggcagcctgtggacaggcaaatggtgcttggagggtcattgtaaacaatgtggctggtcatacatgcactgtacatctataccgagaaaaggaggataccatcactcataaagtggtatacagttcagtatcggttaagggtccactgcatggtgtggcagtgaatgaaaattatcaacctttaggagttattgaccgaaagcgtctttcagcaagaaagaacagcaccacatactgctatgattttcctcttgcatttgaaactgccttggaacagtcatgggcaatccaacagccaggatttcaaagagccaaagataaaaatcttttaaaggtaacagagcttaaatttgcagataaagaaggtagctggggtactcctcttgttcctgtggagaattaccctgggctcaatgatgttggcatggtagcctggtttatggaaatgtgtacccctgagttcccatctggaaggacaatattggttgttgcaaatgatgtgaccttcaaggctggttcttttggcccaagagaggatgcattcttccgtgcagtaactgatcttgcatgtacaaaaaaactacctttgatttatttagctgcaaattctggtgcccgtttaggtgtagctgaagaagtcaaatcctgtttcagagttggttggtctgaggaatctaatcctgagaatggctttcagtatgtatatttaacacctgaggataatgctcggattggatcatcggtgatagcacatgagttaaagcttgagagtggagaaaccagatgggttatagataccattgttggcaaggaggatggccttggcgttgaaaacttgagtggaagtggggctattgctggtgcttattcaagggcatacaaggaaacttttacactgacatatgtgactggtagaactgttggaattggagcttatcttgctaggcttgggatgagatgcatacaaaggcttgatcagcccataattcttactggtttttcagcattaaacaaacttcttggtcgggaggtttacagctctcacatgcaacttggtggacctaaaatcatggcaactaatggagtcgttcatcttacagtttccgatgatcttgaaggtgtttcttctattttgaagtggcttagctacattccttctcatgttggcggtgcacttcccattgtaaagccacttgatcctccagaaagaccagtggagtatttcccagaaaactcgtgtgatcctcgtgctgccatttctggaaccttggatggtaatggaagatggctgggaggaatttttgacaaagacagctttgtggagacactagagggatgggcaagaacagttgttacaggaagggcaaagcttggaggaatccctgtgggagtagttgctgtagaaacacagacggtaatgcaaataatacctgctgatcctggccagcttgattctcacgagagggttgttcctcaagccgggcaagtgtggttccctgattccgcaaccaagacagcccaagcaatattggatttcaacagagaagagctcccgcttttcattcttgcaaactggagaggcttttcaggagggcaaagggaccttttcgaaggaattcttcaggctggttccactattgtggagaaccttagaacatacaagcagcccatatttgtatatatcccaatgatgggcgaactccgtggtggggcatgggtggttgttgtcagtagaatcaattcagaccacatcgaaatgtatgccgatcgaacagacaaaggtaatgtcctagagccagaaggaatgattgagatcaaatttagaacaagagaattgttggagagtatgggtagacttgatcagcaattgataactctgaaggccccacttcaggaagccaagagtagcaggaacattgtggcctttgtatccctacagcagcagattaaatcacgcgagagacaacttttgcctgtgtatacccagatagctaccaagtttgctgaactgcatgatacttccttaagaatggctgccaagggtgtcattagagaagttctggactggcgtaactcccgctctgtcttttaccagagactgcacaggagaattggtgagcaatcactgatcaacagtgtgagagatgctgctggtgaccaattgtcacatgcatctgcaatgaacttgctcaaagaatggtatttgaattccgatattgccaaaggtagagaagatgcttggttggatgatgaagccttcttcaggtggaaggatattccttcaaattacgagaataaactaaaggaattgcgtgtgcagaaagtgttacttcaattgacaaatattggtgactcagctctagatttgcaagctctacctcaaggtcttgctgcccttttaagcaagttggagccattaggtcgcgtgaagttgacggatgaacttcgcaaggtacttggttag

SEQ ID NO: 4713 - protein, 2261 aa, Glycine max (soybean)
MADIGRRNGYSNSVLPNRPPAAISEVDEFCNALGGNRPIHSILIANNGMAAVKFIRSVRSWAYETFGSEKAILLVAMATPEDMRINAEHIRIADQFVEVPGGTNNNNYANVQLILEMAEITHVDAVWPGWGHASENPELPDALKAKGIVFLGPPAISMAALGDKIGSSLIAQAAEVPTLPWSGSHVKIPPESSLITIPDEIYREACVYTTEEAVASCQVVGYPAMIKASWGGGGKGIRKVHNDDEVRALFKQVQGEVPGSPIFIMKVASQSRHLEVQLLCDQYGNVAALHSRDCSVQRRHQKIIEEGPITVATIETVKKLEQAARRLAISVNYVGAATVEYLYSMETGEYYFLELNPRLQVEHPVTEWIAEINLPAAQVAIGMGVPLWQIPEIRRFYGVEHGGGYDAWRKTSVLATPFDFDKAQSTRPKGHCVAVRVTSEDPDDGFKPTSGKVQELNFKSKPNVWAYFSVKSGGGIHEFSDSQFGHVFAFGESRALAIANMVLGLKEIQIRGEIRTNVDNTIDLLNASDYRENKIHTGWLDSRIAMRVRAERPAWYLSVVGGALYKASDSSAALVTDYVGYLEKGQIPPKHISLVHSQVSLNIEGSKYTIDMIRGGSGSYRLRMNQSEIEAEIHTLRDGGLLMQLDGNSHVIYAEGEAAGTRLLIDGRTCLLQNDHDPSKLVAETPCKLLRYLVADDSHVDADTPYAEVEVMKMCMPLLSPASGIIHFTMSEGQAMQAGELIARLDLDDPSAVRKAEPFTGSFPVLGPPTAISVKVHQKCAASLNAARMILSGYEHNIDEVVVQSLLNCLDSPELPFLQWQECLAVLATRLPKELKNELESKYQEFEGISSSQIVDFPAKLLKGIIEAHLSSCPDKEKGAQERLVEPLLSLVKSYEGGRESHAHIIVQSLFDEYLSVEELFSDNIQADVIERLRLQYKKDLLKIVDIVLSHQGIKSKNKLILQLMDKLVYPNPVAYRDQLIRFSLLHHTNYSELALKASQLLEQTKLSELRSNIARSLSELEMFTEDGENIDTPKRKSAINDRMEDLVSAPFAVEDALVGLFDHSDHTLQRRVVESYIRRLYQPYLVKGSARMQWHRSGLIATWEFYDEYIERKNGVEDQSLSKTVEEKHSEKKWGVMVIIKSLQFLPAIITAALREATNNPHEALTSGSVEPVNYGNMMHIGLVGINNQMSLLQDSGDEDQAQERINKLAKILKEQEVGSTIRAAGVGVISCIIQRDEGRAPMRHSFHWSEEKLYYAEEPLLRHLEPPLSIYLELDKLKAYENIRYTPSRDRQWHLYTVVDHKPQPIQRMFLRTLVRQPTTNEGFSSYQRLDAETSRTQLAMSFTSRSIFRSLMAAMEELELNAHNVNIKSGHAHMYLYIIREQQIDDLVPYPKRINIEAGKEEITVEAVLEELAREIHSSVGVRMHRLGVVVWEIKLWMAACGQANGAWRVIVNNVAGHTCTVHLYREKEDTITHKVVYSSVSVKGPLHGVAVNENYQPLGVIDRKRLSARKNSTTYCYDFPLAFETALEQSWAIQQPGFQRAKDKNLLKVTELKFADKEGSWGTPLVPVENYPGLNDVGMVAWFMEMCTPEFPSGRTILVVANDVTFKAGSFGPREDAFFRAVTDLACTKKLPLIYLAANSGARLGVAEEVKSCFRVGWSEESNPENGFQYVYLTPEDNARIGSSVIAHELKLESGETRWVIDTIVGKEDGLGVENLSGSGAIAGAYSRAYKETFTLTYVTGRTVGIGAYLARLGMRCIQRLDQPIILTGFSALNKLLGREVYSSHMQLGGPKIMATNGVVHLTVSDDLEGVSSILKWLSYIPSHVGGALPIVKPLDPPERPVEYFPENSCDPRAAISGTLDGNGRWLGGIFDKDSFVETLEGWARTVVTGRAKLGGIPVGVVAVETQTVMQIIPADPGQLDSHERVVPQAGQVWFPDSATKTAQAILDFNREELPLFILANWRGFSGGQRDLFEGILQAGSTIVENLRTYKQPIFVYIPMMGELRGGAWVVVVSRINSDHIEMYADRTDKGNVLEPEGMIEIKFRTRELLESMGRLDQQLITLKAPLQEAKSSRNIVAFVSLQQQIKSRERQLLPVYTQIATKFAELHDTSLRMAAKGVIREVLDWRNSRSVFYQRLHRRIGEQSLINSVRDAAGDQLSHASAMNLLKEWYLNSDIAKGREDAWLDDEAFFRWKDIPSNYENKLKELRVQKVLLQLTNIGDSALDLQALPQGLAALLSKLEPLGRVKLTDELRKVLG

SEQ ID NO: 4714 - DNA, 2030 bp, Glycine max (soybean)
  CDS (90)..(1709)
atccgcatcaaaagaccttctctttctcttgccatcatttcattccccatacgctccatccatcaccctttctttcattctgttgggaaatggaagtcacactttcagcgtgcaagtccattagctcgccttctgttcccgtcgcagctttatttgcggggaaagcaggaactaagagttcgcaatgcagttttttagctggagcaaacaaagtgaggtttcctaggcaagtcggtcaagttagccacgttcgcaaacagcgccaaacgcgtcactgtggtgctctccacgcgacttgcagcggtgacaagatcctgatcgcgaatagaggcgagattgcggttcgcgttattcgaaccgctcatgaattggggattccgtgtgtggctgtgtactccaccattgataaggacgcccttcatgtcaaactggctgatgaagctgtatgcatcggcgaagcgccgagtagccagtcgtacttgctgatcccgaatgttctgtcggctgctattagccgcagatgcacgatgttgcatcctggctatggttttcttgcggagaatgctgtgtttgttgaaatgtgcagggaacatggaatcaactttattgggcccaaccctgacagtattcgggttatgggtgacaaagcaactgccagagagacaatgaagaaagcaggtgttcccaccgttccaggaagtgatggccttttacagagcacagaagaagctattaggctggcaaatgagattggtttccctgtgatgatcaaggcaacagctggtggtggaggacgtggcatgcgtcttgctaaagaacctgatgagtttgtgaagttgttacagcaagctaagagtgaggcagctgctgcatttggcaatgacggggtttatttggagaagtacattcaaaacccaaggcacattgagttccaggttcttgcagataaatatggtaatgttgttcactttggagaacgtgattgcagcattcagaggcgtaatcagaaactgcttgaagaagcaccatctcctgccctgacccctgagttgcgaaaggcaatgggagatgcagcagttgctgctgctgcatctattggttacataggtgttggaacgattgagtttcttttggatgaaagaggttccttttactttatggagatgaacacacgtatccaggttgagcatcctgtgacagaaatgatttcctcaacagatttgatagaagagcaaattcgtgtagctatgggagaaaaacttcgatacaaacaggaggatattgtcctcagaggacattctattgaatgccgtatcaatgcagaagatgcttttaagggatttagaccagggccaggtagaattacagcatacttgccatctggaggtccatttgttagaatggatagccatgtttatcctgattatgtggttcctccaagctatgactcccttcttggaaagctgattgtatgggctccaacaagagaaaaagcaattgaacgcatgaaaagggcacttgatgacactattatcacaggagttcctactacaattgattatcataaacttatccttgacatagaggatttcagaaatggaaaggttgatactgcttttattccaaaacacgaggaagagttggcaatgcctccgcagaagatggtactcgctaacagggtgaacgaactagctggttcaactgcctgatgaatatgattgtgtgatgtcagaattgctttttgtaatcgccgtgttgtcagtgcctcgaagtgaatgttttaatgaaattttgataattagtctcgtacattccttttcttcacataattatattgtaaaatcaattaattcaagtttgatttcatcccgaatattattgcaaggaattaagaataggtccttgcatttttttcggaagtcatagttgtcacaatggttggtttagaggatcttgtattaagagctcgatgctagatacagtaataaaaacttaaccttatcctaatagactgggtttgttatatgtaa

SEQ ID NO: 4715 - protein, 539 aa, Glycine max (soybean)
MEVTLSACKSISSPSVPVAALFAGKAGTKSSQCSFLAGANKVRFPRQVGQVSHVRKQRQTRHCGALHATCSGDKILIANRGEIAVRVIRTAHELGIPCVAVYSTIDKDALHVKLADEAVCIGEAPSSQSYLLIPNVLSAAISRRCTMLHPGYGFLAENAVFVEMCREHGINFIGPNPDSIRVMGDKATARETMKKAGVPTVPGSDGLLQSTEEAIRLANEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTIEFLLDERGSFYFMEMNTRIQVEHPVTEMISSTDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFRNGKVDTAFIPKHEEELAMPPQKMVLANRVNELAGSTA

SEQ ID NO: 4716 - DNA, 6915 bp, Brassica napus (rape)
  CDS (1)..(6915)
atggagatgagagctttggtttcgtgttctgctgccggaaatggagcttctgatcggtttagactctccaatgtttcaccatggatcacatcagctcgtggtgcaagtggcagtgactccccagccacagtgaagctgggaagcagctctatgatcagagccttcaaaggagtttcgatttacaaaaacaagaccagaagaaatgttttgtctcaaaggaacaaacagtttcgtcctatggcctacttaggaaggaaggacttgagcagccctgatccgacctccttctgcgataatgatatatctgaacctcaagggactggatccattaatgggaatgatcatagtgctgtaagagtgtctcaagtcgatgagttctgtaaggctcacggtggaaaaaggccaatccatcgcattttggttgctaccaacggaatggcagctgtcaagtttatacgaagtgttagagcatggtcttaccaaacatttggctcggaaaaatccatatcattggtggccatggcgactcctgaagacatgcggatcaatgcggaacatatcagaatcgctgatcagtttatgcaagtcccgggtggaacgaacaataacaattatgctaatgttcatcttattgtagagatggctgaagcaacaggtgtggatgcagtttggcctggttggggtcatgcatctgaaaaccctgagttacctgatgcattaaaggccaaaggagtcatatttcttggtcctacagcagcctcaatgttagcattaggggataagattggttcgtccttgattgcacaagctgctgatgtacctactctgccatggagtggttcccatgttaaaatacctcctggtagcagcttggtaacgatccccgaggagatgtacaggcaagcttgtgtctacactaccgaagaagcggttgctagttgtcaagttgtgggctatccggcaatgatcaaagcatcgtggggtggtggcggtaaaggcattaggaaggttcatgatgatgatgaggttagggctctattcaagcaagttcaaggtgaggtcccaggctcgccgatattcataatgaaggttgcttcacagagtcggcatttagaggtgcagctgctatgtgaccaatatggaaatgtttcagctttgcatagccgtgattgtagcgtccagagaagacaccaaaagatcatcgaggagggtcccatcactgtggctccccgagataccgtgaagaagctggagcaggcagctagaaggttggccaagagtgttaactatgttggagctgctactgttgagtttctctacagcatggacactggggactacttcttcttagagcttaaccctaggttacaggtagagcaccctgtaaccgagcggatcgctgacataaatctaccagctgcccaagttgctgtcggtatgggaatccctctctggcaaatccctgagataagacggttctatggtatagaacaatatgattcgtggaggacaacatctttgctagcctccccttttaattttgataaagctgaatctgtaaggccaaaaggtcattgtgtcgctgtccgggtgacaagcgaggatcctgatgacgggtttaaacccaccagcggtcaagtgcaggagcttagttttaagagcaacccaaatgtgtggggttacttctctgtcaagtctggtggaggcatccacgagttctcagattctcagtttggacatgtttttgcatttggggaatccagagccatggcaatagcaaatatggttcttgcgctgaaagaaattcaaattcgtggagaagttaggactaacgttgactacacgattgaccttctacatgcttttgattaccgggaaaacaaaattcacactggttggttggacagtagaattgctatgcgggtccgagcagagaggcctccatggtacctctctgttgtcagcggggctctctataaagcatcagcgactggtgctgccgtggtctcggattacattgcttatcttgacaaggggcaaattcccccaaagcatatatctcttgtgcattctcaagtgtctctgaatattgaaggaagtaaatatacgattgatgtggtccggagtggatcaggaagctacaagctaagaatgaacaactcagaagtggcagcagaaatacacactctacgtgatggaggtttgttgatgcagttggatggtaaaagccatgttatatatgcacaggaagaaacctcaggcacccgtcttctgattgacggcaaaacttgtttacttcagaatgaacacgacccttcaaaattaatggctgagacaccgtgcaagctacttaggtatctggtttcagatgatagcagcattgatgctgatacaccctatgcagaggttgaggtcatgaagatgtgcatgccgcttctttcacctgcgtcaggagttatccattttaaaatgtgtgaaggacaagtcatgctgcctggtgaacttatagccaatcttgatcttgctgatccttcgactgtaagaaaggccgaacccttccatggagggttcccaagattagggcttccaacggaaatttctgctaaagttcatcagagatgtgctgcaactttagatgctgctcgcatgattcttgccggctatgagcatcaagtagatgaggttgtgcaagactttgtttcttgccttgatagccctgaactcccattccttcagtggcaagagtgctttgcagttctggcgacacggttaccaaaagatctcagaatcatgctagaatcaaagtatatggaatatgagtgtatctccaggaactccttgaccgcagattttcctgccaaacttttaaaaggcattctagaggctcatgtagcatcttgtgatgagactgagagaggtgcccttgcaaggctcattgaaccattgatgagccttgcaaagtgttacgaaggtggtagagaaagtcatgcctgtgttattgttcgttccctctttgaggaatatctatcagtagaagaattattcaacaataacatgctggctgatgttatagaacgtatgcgtcacgaatacaagaaagatcggtccaagattgtggatatagtgctgtcacaccagggcctaaaaagcaaaaacaagctcgttctcggactcatggagcattttgttaatgctaatcctgctatgtacagggataaacttatcagattcttgaaacttaaccatactaactactctgaggtggtgctcaaggcgagtcaattactcaaacagagaaaattaagtgaacttcgttctagcatcctgtcggagttagaaatgtttgcagaggatggggaaaatatggatactcccaagaggaagtgtgccatggaagatcttgtgagcgcacctttagctgttgaagatgctctcgtgggactatttgaccacagcgaccgcacacttcaaagactggttgttgaaacttatattcgtagattgtaccagccctacgtcgttaaagagagcgtgaggatgcagtggcaccaatatggttttattgcttcctgggagttcctagacgatcatatggaaagaaaaaacagtgagggctcagatgaccaagagacatctgaaaaagtttttgttgagaagcgtagaaagaaaaaaaaggggtttatggttataatcaaatcgctggagtttctgccgaatataataactgcagcagcactgacagaaacaaaccacatcgactatggtgaatctgccggatctcctctatctggcaatataatgcacattgctgttttagacagtgagaatgaggaggaccaagctcaagaaagagtggagaaaattctcaaagaggaagaagttagttcgagcctgtgttccgcaggtgtgggtgtggtgagctgtataatcgagcgagatgaaggacgaacacctattagacattcgttccattggtcgatggagaaacagtactatgcagaagagccgatgctgcgccatcttgaacctcctctctccatataccttgagttggataagctgagaggatatgaaaatatacaatatacccctacaagagatcgtcaatggcatctgtatactgtcacagataacaagccggtgccagtcaggaggatgttcctgagatctcttgttcgacaagggcaggataaccaacttagccaaacgcttgttagatctttgatggatgcgatggaggaacttgagctgaatgcccataaggaggatggtgcgaaaccagaccacgcacatatgttcctttgcctacttcgtgagcagcacattaatgatcttgtgccttaccccaggagagttgaagtgaatgcggaggttgaagaaactggaatagagatgatcttagaagaaacagtacgagagatacacaagtcagctggagtgagaatgcataggttgggtgtgtgcgagtgggaagtgcggctgcggttggcaagtggcgtttggagggctgtggttacaaacgtgacaggccgtacctgcactgtccatatataccgagaagttgaagctactgggagtaacagtttaatttatcaatcaataaccaagaagggacctttgcatggaaccccgatcaatgatcaatataagccactgggacatcttgtcaggcaacgattagccgcaaggaggagtaacactacttactgctatgatttcccgttggcatttgagacagccttggaagagttgtgggaatcacaacacccgggagttaagaaaccgtttaagaacactctgaccaatgttgaagagcttgtattctctactccagaaggttctcttattccggttaaaagaccaccgggtctcaacgactgcggaatggtggcatggaccctagagatgtcgactcctgagtttccaaagggacggaaaattatcatagtcgccaatgacgttaccttcaaagctgggtcttttggtcctagagaggacgcgtttttcctcgctgtgactgaactcgcttgcgcggagaagcttcccttgatttacttagcagcaaactctggcgcccggctaggggtggctgaagaagtcaaagcctgctttaaagttggatggtcggatgaagtttcccctgagaatggttttcagtatatatacctaagccctgaggatcacgaaaggattggatcatctgtcattgcgcacgaaataaagctgcccagcggggaaacgaggtgggtcattgatacaatcgttggtaaagaagatggtattggcgtagagaatctaacgggaagcggggcaatagcgggtgcttactcgagggggtacagggaaacttttactttaacctttgtcagtggaagaacggttggcattggcgcttaccttgcccgtctgggtatgcggtgcatacagaggttagaccagcctataattttgactggcttttcgacgctgaacaagttacttgggcgtgaggtctacacctctcacatgcaactcggcggccccaaaatcatgggtgcaaatggtgttgttcatctcacagtctcagatgatctggaaggcgtgtcggcgatcctaaactggctgagctacgttcctgctcacgcgggtggtcctcttcctcttcctcttctttcccctttagatccaccggagagaactgtggagtacgtcccagagaactcttgcgacccccgagctgctatagctggggtcaatgacaacgccggtaaatggcttggcggtatctttgataaaaacagctttatggagactctcgaaggctgggcgaggacggttgtgaccggtagagcgaaactagggggagtacctgttggagttgtagcagttgagacgcagaccgtgacgcagattattccagcggatcctggacaggtggactcgcacgaaagagtggttccgcaggcagggcaagtctggttccctggctcagcagccaagacggctcaagcgctcatggatttcaaccgggaagggcttccgttgtttatcctagcgaactggcgagggttttccggcgggcagagagatcttttcgaaggaatactccaggctggttcagctatcgtcgaaaatttgagaacgtatggccagccagtgtttgtgtacatccccaagatgggagagctgcgaggcggagcgtgggtggttgttgatagccagattaattcggattacgttgaaatgtatgctgacgaaacttcacgtgggaatgtgctcgagccggaagggatgatagagatcaaatttagaaagagagagatgttggagtgcatggggaggttggaccagaagctgatcagtctcaaagcaaaactgcgagacgccaaacaaagcgagatggaacttatcaagcaacagattaaagctcgtaagaagcagcttttaccgctttacatccaaatcgccaccaaatttgcggatcttcacgacacgtccatgaggatggcagcgaaaggagtgatcaaaagcgttgtggaatggagcggttcgcgatcattcttctataaaaagctcattaggagaattgcggagagctctctggtgaaaaatgtgatagaagcttcgggagacaacttatcgtataaatctgcaatgggtttgattaaggattggttctgcaagtctgatgttgcaaaggggaaagaagaggcatggacagacgaccaagtgttctttacatggaaggagaatgttggtaactacgaatccgagctcagcgagttgagagcacagaaactgctgaagcaacttgcggagattgggaattcatctgatctgcaggctctgccccagggacttgctaatattctacacaaggtggagcctttgaaaagagaacagctagtggatgctctaagaaaggtgttgagttga

SEQ ID NO: 4717 - protein, 2304 aa, Brassica napus (rape)
MEMRALVSCSAAGNGASDRFRLSNVSPWITSARGASGSDSPATVKLGSSSMIRAFKGVSIYKNKTRRNVLSQRNKQFRPMAYLGRKDLSSPDPTSFCDNDISEPQGTGSINGNDHSAVRVSQVDEFCKAHGGKRPIHRILVATNGMAAVKFIRSVRAWSYQTFGSEKSISLVAMATPEDMRINAEHIRIADQFMQVPGGTNNNNYANVHLIVEMAEATGVDAVWPGWGHASENPELPDALKAKGVIFLGPTAASMLALGDKIGSSLIAQAADVPTLPWSGSHVKIPPGSSLVTIPEEMYRQACVYTTEEAVASCQVVGYPAMIKASWGGGGKGIRKVHDDDEVRALFKQVQGEVPGSPIFIMKVASQSRHLEVQLLCDQYGNVSALHSRDCSVQRRHQKIIEEGPITVAPRDTVKKLEQAARRLAKSVNYVGAATVEFLYSMDTGDYFFLELNPRLQVEHPVTERIADINLPAAQVAVGMGIPLWQIPEIRRFYGIEQYDSWRTTSLLASPFNFDKAESVRPKGHCVAVRVTSEDPDDGFKPTSGQVQELSFKSNPNVWGYFSVKSGGGIHEFSDSQFGHVFAFGESRAMAIANMVLALKEIQIRGEVRTNVDYTIDLLHAFDYRENKIHTGWLDSRIAMRVRAERPPWYLSVVSGALYKASATGAAVVSDYIAYLDKGQIPPKHISLVHSQVSLNIEGSKYTIDVVRSGSGSYKLRMNNSEVAAEIHTLRDGGLLMQLDGKSHVIYAQEETSGTRLLIDGKTCLLQNEHDPSKLMAETPCKLLRYLVSDDSSIDADTPYAEVEVMKMCMPLLSPASGVIHFKMCEGQVMLPGELIANLDLADPSTVRKAEPFHGGFPRLGLPTEISAKVHQRCAATLDAARMILAGYEHQVDEVVQDFVSCLDSPELPFLQWQECFAVLATRLPKDLRIMLESKYMEYECISRNSLTADFPAKLLKGILEAHVASCDETERGALARLIEPLMSLAKCYEGGRESHACVIVRSLFEEYLSVEELFNNNMLADVIERMRHEYKKDRSKIVDIVLSHQGLKSKNKLVLGLMEHFVNANPAMYRDKLIRFLKLNHTNYSEVVLKASQLLKQRKLSELRSSILSELEMFAEDGENMDTPKRKCAMEDLVSAPLAVEDALVGLFDHSDRTLQRLVVETYIRRLYQPYVVKESVRMQWHQYGFIASWEFLDDHMERKNSEGSDDQETSEKVFVEKRRKKKKGFMVIIKSLEFLPNIITAAALTETNHIDYGESAGSPLSGNIMHIAVLDSENEEDQAQERVEKILKEEEVSSSLCSAGVGVVSCIIERDEGRTPIRHSFHWSMEKQYYAEEPMLRHLEPPLSIYLELDKLRGYENIQYTPTRDRQWHLYTVTDNKPVPVRRMFLRSLVRQGQDNQLSQTLVRSLMDAMEELELNAHKEDGAKPDHAHMFLCLLREQHINDLVPYPRRVEVNAEVEETGIEMILEETVREIHKSAGVRMHRLGVCEWEVRLRLASGVWRAVVTNVTGRTCTVHIYREVEATGSNSLIYQSITKKGPLHGTPINDQYKPLGHLVRQRLAARRSNTTYCYDFPLAFETALEELWESQHPGVKKPFKNTLTNVEELVFSTPEGSLIPVKRPPGLNDCGMVAWTLEMSTPEFPKGRKIIIVANDVTFKAGSFGPREDAFFLAVTELACAEKLPLIYLAANSGARLGVAEEVKACFKVGWSDEVSPENGFQYIYLSPEDHERIGSSVIAHEIKLPSGETRWVIDTIVGKEDGIGVENLTGSGAIAGAYSRGYRETFTLTFVSGRTVGIGAYLARLGMRCIQRLDQPIILTGFSTLNKLLGREVYTSHMQLGGPKIMGANGVVHLTVSDDLEGVSAILNWLSYVPAHAGGPLPLPLLSPLDPPERTVEYVPENSCDPRAAIAGVNDNAGKWLGGIFDKNSFMETLEGWARTVVTGRAKLGGVPVGVVAVETQTVTQIIPADPGQVDSHERVVPQAGQVWFPGSAAKTAQALMDFNREGLPLFILANWRGFSGGQRDLFEGILQAGSAIVENLRTYGQPVFVYIPKMGELRGGAWVVVDSQINSDYVEMYADETSRGNVLEPEGMIEIKFRKREMLECMGRLDQKLISLKAKLRDAKQSEMELIKQQIKARKKQLLPLYIQIATKFADLHDTSMRMAAKGVIKSVVEWSGSRSFFYKKLIRRIAESSLVKNVIEASGDNLSYKSAMGLIKDWFCKSDVAKGKEEAWTDDQVFFTWKENVGNYESELSELRAQKLLKQLAEIGNSSDLQALPQGLANILHKVEPLKREQLVDALRKVLS

SEQ ID NO: 4718 - DNA, 7175 bp, Medicago sativa (alfalfa)
  CDS (70)..(6843)
agcaaagaataaaaatactgacttcatttttttttatgtatattggaaataactagaaggagaacaataatggctagcgtgggccgtggaaatggatatttaaacagtgtgctaccgagtaggcaccctgctactacaaccgaagtagatgaatactgcaatgcccttggaggaaacaagccgattcatagcatattgattgcaaacaatggaatggcagcagtcaagtttatacgtagtgttaggagttgggcttacgagacatttggcacggaaaaagctatcttgttggttgccatggcaactccagaggatatgagaatcaatgcagaacatatcagaatagccgatcaatttgtggaagtacctggtgggaccaataacaataactacgccaatgtgcagcttattctagagattgctgagataactcacgttgatgcggtgtggcctggttggggtcatgcatcagaaaatcctgagcttccagatgcattaaaagcaaagggaattgtattccttggacctcctgctatatctatggcagcattgggagacaaaattggttcctcgttgattgctcaggcagcagaagttccaacccttccatggagtggttctcatgtgaaaattcctccagaaagtgacttgattactattcctgatgaaatttaccgtgcagcatgtgtttatacaacagaagaagcaattgcaagttgtcaagtagtaggttaccctgcaatgattaaggcatcttggggtggtggcggcaaaggcataagaaaggttcataatgatgatgaggttagggcattgttcaagcaagttcaaggtgaagtaccaggctcacctatatttataatgaaagttgcttcccagagccgacatcttgaagtccaattgatttgcgatcagcacggaaattttgcagcattgcacagccgtgattgtagtgttcaaagaaggcatcaaaagattattgaagagggtcccattactgtagcacctccagaaacggtgaaagaacttgaacaggcggctagaagattagctaaatctgtaaattatgtgggggcagctaccgttgagtatctttatagcatggaaactggcgagtactactttttagagttgaacccccgactacaggttgagcatcctgttactgaatggatagctgagataaatctgccagcagcacaagttgcagttgggatgggcatcccactctggcaaattcctgagattaggcgtttctatgggatggaacatggtgggggaaatgatggttggaagaaaacatcagtgttagctaccccttttgattttgacgaagcacaatctacaaagccgaaaggtcattgtgtggctgtacgagtcaccagtgaggaccccgatgatggttttacgcctacaggaggaaaagtgcaggagctcagctttaaaagcaagccaaatgtgtgggcttatttctctgttaagtccggaggaggaattcatgaattctcagattctcaatttggacatgtttttgcgtttggagaatctagagctttagcaattgcaaatatggtactggggttgaaggaaattcaaattcgaggagaaattcgtaccaacgttgattacacaattgatcttctgaatgcttcagactacagagacaacaaaattcacacaggatggctagacagtagaattgcaatgcgggttagagcagagaggcctccctggtatctgtctgttgttggtggggcactctataaagcttctgccagcagtgcagctttagtttcggactatgttggctatcttgaaaaggggcaaatccctcccaagcacatttctcttgtccattctcaagtttctttgagcattgaaggaagcaaatacacgattgacatggtacgaggaggacctggaagttacaaattgaaattgaatcaatcggagatagaagcggagatacacactttacgtgatggaggtttgctaatgcagttggatggaaacagtcatgtaatatatgcagaggaagaagcagctggaactcggcttttaatagatggaaggacttgcttgcttcagaatgatgacgatccatcaaagttaattggagagacaccgtgcaagcttctgagatatttggttgcggatgatagtcagattgatgcagacacaccatatgctgaagttgaggtcatgaagatgtgcatgcctcttctttcccctgcttctggaattattcatttcagaatggctgaaggtcaagccatgcaggctggtgaacttatagcaaagcttgatctagatgatggttctgcagtaaggaaggcagaacccttcactgggagcttccctatcctgggccctcctactgcaatttcaggtaaagttcatcagaaatgtgcagcaagcttaaacgctgcacggatgattcttgctggctatgagcacaacattgatgaagttgtggtcaaaagtttgctcaattgccttgacagccctgaactgcctttccttcaatggcaagagtgctttgcagttttggcaacccgtcttcccaaagatcttagaaacgagttggaagctaaatataaggagttcgaaattatttcaagctcccaaactattgatttccctgccaaattattgaaggcaatccttgaagctcatctttcctcctgtcctgaaaacgaaaaaggagccttagaaagactagttgaaccgctgacaagtcttgtaaagtcttatgagggtggaagagagagccatgctcataaaattgttcaatctctatttgaagagtatctttcagttgaagaactattcagtgataatatacaggctgatgtaattgaacgactccgtcttcaatacaagaaagatttgttgaagattgtagatattgtgctctctcatcagggtgtcaagagcaaaaacaagctgatactgcgactaatggataaactggtttaccctaatcctgctgcctatagggatcaattaatccgattctcccaactcaaccatatagtttattctgagttggctcttaaggcaagtcaactgttggagcaaactaaactcagtgaacttcgatccagcattgctagaagtctttctgaactagaaatgtttaccgaggatggtgaaaatattgatactccgaagaggaagagtgccattaatgacagaatggaggaccttgtgagcgctcctttggctgttgaagatgcccttgttggtttatttgatcacagcgatcacacccttcaaaggagagttgttgaaacttatatccgtaggctctatcagccatatcttgtcaaagatagcatcaggatgcagtggcacagatctggccttattgctacatgggaattcttagaagaatacgttgaacggaagaatggggttgaagacaaaacactggtggagaaacatagtgagaagaaatggggagtgatggttgtaattaaatctcttcagtttttgccagcaattatcagtgctgcattaagagaagcaaccaataactttcacgatcctcttaaaagtggttctggtgactcaagtaaccatggtaatatgatgcatattggattagtggggatcaacaaccaaatgagtttacttcaagacagtggtgatgaggatcaggctcaagaaagaattgataagttggccaaaatactcagagagcaggaaatagggtccataatacatgctgcaggtgttggagatattagctgtatcatacagagggatgaagggcgtgctccaatgaggcattcctttcactggtcatctgaaaagctatattatgtagaggaaccattgttgctccatcttgaacctcccctatccatttatcttgaactggacaagcttaagtgctatgaaaatattcgctatacaccatcccgagatcgtcaatggcacctctacacagttgtggataccaagccacaaccaattcaaagaatgtttcttcgaacacttatcagacagccaaccacaaatgaaggatactcttcttatcaaagactggatgcagaaacgtcccgtacccaattggctatgtcttatacttcaaggagcatttttaggtccctaatgggcgcaatggaggagttggaacttaactcacacaataccaccatcaaatctgaacatgctcatatgtacctctatatcatacgcgagcagcaaatagatgatcttgtgccttattccaagaaaattaacatagaagctggccaagaagaaacaacagttgaggcaatcttggaagaactggcacaggaaatccattcctctgttggtgtaagaatgcacagattaggcgttttcgtgtgggaaatcaagctctggattacagcatgtggacaggcaaatggtgcttggagggtcattgtaaacaatgtgactggtcatacatgcactgtacatatatatcgagagatggaggatgccaccactcataaagtggtctacagttcagtcactgtaaagggtccgttgcatggtgtaccggtgaatgaaaactatcaacctttgggaggtattgaccgaaaacgtcttgcagcgagaaagaacagcaccacatactgctatgatttcccccttgcatttcaaacatccttggaacagtcctggtcaatacagcagacaggaattcaaagagctaatgataaggatctcctaaaagtaacagagcttaaattttccgaaaaagctggtagttggggtacttctcttgttcctgcagagcgtcttcctggactcaatgatgttggcatggtagcctggttgatggaaatgtgtacgcctaaattcccatctggaaggacaatattggttgtttcaaacgatgtgaccttcaaggccgggtcttttggcccaagagaggatgcattctttagagcagtaactgatcttgcctgtgcaaagaaaatacctttaatttacttggcagcaaattctggtgcccgtttaggtgttgccgaggaagtcaaagcttgtttcaaagttggttggtctgaggaatctaaacctgaacatggttttcagtatgtatatttaacacctgaggattatgctcgaatcggatcatcagtgatggcacatgaattaaagcttgaaagtggagaaaccagatgggttatagataccattgttggcaaagaagatggactgggagttgaaaacttgagtggtagtggggccattgccggtgcctattcaagggcatacaaggaaacctttacattgacatatgttaccggtaggactgttggaattggtgcttatcttgctaggcttgggatgaggtgcatacagaggcttgatcaacctataattcttaccgggttttcagcattaaacaaacttcttggtagggaggtgtacagctctcacatgcaacttggtggaccgaaaatcatggcaacaaatggagtcgttcatctcacagtttcggacgaccttgaaggcgtttcttctattttgaagtggcttagctacgttccttctcatgtaggtggtgcacttcccattgtaaagccccttgatcccccagagagggaagtggagtatttaccggaaaattcatgcgatcctcgtgctgccatttccggaactctggatgttaatggaaagtggctgggaggcatttttgacaaggacagctttgtggagacactagaaggatgggctagaacagttgttacaggaagggcaaagcttggaggaatccctgtgggaattgttgcggtggaaacacaaacagttatgcaaataatacctgctgatccaggtcaacttgattctcacgagagggttgttcctcaagccgggcaggtgtggtttcctgattctgcgaccaagacggcccaagcgatattggatttcaacagagaagaactcccacttttcattatcgcaaactggagaggcttttcaggtggacaaagggacctttttgaaggaattcttcaggctggttcgactattgtggagaaccttaggacatacaaacagcccatatttgtatacattccaatgatgggtgaactccgaggcggggcttgggttgttgtcgacagccgaatcaactcagaccacattgaaatgtatgctgagcgaacggccaaaggtaacgtccttgagccggaaggaatgattgaaatcaaatttagaacaagagaattgttggagtgtatgagaagacttgatcaacaattgattaatttgaaggaaaaactttctgaagccaagagtaacaaggactatggtgcatatgattctctgcagcagcagattagattccgtgagaaacagcttttgcctttgtatactcagatagctacaaaatttgctgaactccatgatacttcattaagaatgaaagcaaagggtgtaatcagagaagttcttgattggcgtaagtcgcgttctgtcttctatcagagactgcacaggagaatcggtgagcactcactgatcaacatcgtgagagatgctgctggtgaccaattgtcatatgtttctgccatgaacttgctcaaagaatggtatctgaattctgatatcgccaaaggtagagaagatgcttggttggacgatgaagccttcttcagatggagggatgatccagcaaactacgaggataaactaaaggaattgcgcgtccagagactgttgcttcagttgacaaatattggcgactcggctctagatttacaagctctacctcaaggtcttgccgcccttttaagcaagttggaagcatcaagtcgcgataagttgatcagtgaacttcgcaaagtactcggttagtagacagtgaatgctcctgtgatctgcccatgcactcatgttgtagtgttcacgtcgttgatacatgaccatatagaaatgtatccattttacgatgttatcatcaaagtagcagcatccctcggaaaatggactttcacttgagggatcaactgtaaatgacttcggtcttggatagatatttaatttatgcagttagaggatcataaccagcatcaccatgtttggtctatttatttgctggttgattgattctttgcgtgtatctgaataaacatgtaataatttgtaacattgattattttttatgaaaaacaaagttttgggcactc

SEQ ID NO: 4719 - protein, 2257 aa, Medicago sativa (alfalfa)
MASVGRGNGYLNSVLPSRHPATTTEVDEYCNALGGNKPIHSILIANNGMAAVKFIRSVRSWAYETFGTEKAILLVAMATPEDMRINAEHIRIADQFVEVPGGTNNNNYANVQLILEIAEITHVDAVWPGWGHASENPELPDALKAKGIVFLGPPAISMAALGDKIGSSLIAQAAEVPTLPWSGSHVKIPPESDLITIPDEIYRAACVYTTEEAIASCQVVGYPAMIKASWGGGGKGIRKVHNDDEVRALFKQVQGEVPGSPIFIMKVASQSRHLEVQLICDQHGNFAALHSRDCSVQRRHQKIIEEGPITVAPPETVKELEQAARRLAKSVNYVGAATVEYLYSMETGEYYFLELNPRLQVEHPVTEWIAEINLPAAQVAVGMGIPLWQIPEIRRFYGMEHGGGNDGWKKTSVLATPFDFDEAQSTKPKGHCVAVRVTSEDPDDGFTPTGGKVQELSFKSKPNVWAYFSVKSGGGIHEFSDSQFGHVFAFGESRALAIANMVLGLKEIQIRGEIRTNVDYTIDLLNASDYRDNKIHTGWLDSRIAMRVRAERPPWYLSVVGGALYKASASSAALVSDYVGYLEKGQIPPKHISLVHSQVSLSIEGSKYTIDMVRGGPGSYKLKLNQSEIEAEIHTLRDGGLLMQLDGNSHVIYAEEEAAGTRLLIDGRTCLLQNDDDPSKLIGETPCKLLRYLVADDSQIDADTPYAEVEVMKMCMPLLSPASGIIHFRMAEGQAMQAGELIAKLDLDDGSAVRKAEPFTGSFPILGPPTAISGKVHQKCAASLNAARMILAGYEHNIDEVVVKSLLNCLDSPELPFLQWQECFAVLATRLPKDLRNELEAKYKEFEIISSSQTIDFPAKLLKAILEAHLSSCPENEKGALERLVEPLTSLVKSYEGGRESHAHKIVQSLFEEYLSVEELFSDNIQADVIERLRLQYKKDLLKIVDIVLSHQGVKSKNKLILRLMDKLVYPNPAAYRDQLIRFSQLNHIVYSELALKASQLLEQTKLSELRSSIARSLSELEMFTEDGENIDTPKRKSAINDRMEDLVSAPLAVEDALVGLFDHSDHTLQRRVVETYIRRLYQPYLVKDSIRMQWHRSGLIATWEFLEEYVERKNGVEDKTLVEKHSEKKWGVMVVIKSLQFLPAIISAALREATNNFHDPLKSGSGDSSNHGNMMHIGLVGINNQMSLLQDSGDEDQAQERIDKLAKILREQEIGSIIHAAGVGDISCIIQRDEGRAPMRHSFHWSSEKLYYVEEPLLLHLEPPLSIYLELDKLKCYENIRYTPSRDRQWHLYTVVDTKPQPIQRMFLRTLIRQPTTNEGYSSYQRLDAETSRTQLAMSYTSRSIFRSLMGAMEELELNSHNTTIKSEHAHMYLYIIREQQIDDLVPYSKKINIEAGQEETTVEAILEELAQEIHSSVGVRMHRLGVFVWEIKLWITACGQANGAWRVIVNNVTGHTCTVHIYREMEDATTHKVVYSSVTVKGPLHGVPVNENYQPLGGIDRKRLAARKNSTTYCYDFPLAFQTSLEQSWSIQQTGIQRANDKDLLKVTELKFSEKAGSWGTSLVPAERLPGLNDVGMVAWLMEMCTPKFPSGRTILVVSNDVTFKAGSFGPREDAFFRAVTDLACAKKIPLIYLAANSGARLGVAEEVKACFKVGWSEESKPEHGFQYVYLTPEDYARIGSSVMAHELKLESGETRWVIDTIVGKEDGLGVENLSGSGAIAGAYSRAYKETFTLTYVTGRTVGIGAYLARLGMRCIQRLDQPIILTGFSALNKLLGREVYSSHMQLGGPKIMATNGVVHLTVSDDLEGVSSILKWLSYVPSHVGGALPIVKPLDPPEREVEYLPENSCDPRAAISGTLDVNGKWLGGIFDKDSFVETLEGWARTVVTGRAKLGGIPVGIVAVETQTVMQIIPADPGQLDSHERVVPQAGQVWFPDSATKTAQAILDFNREELPLFIIANWRGFSGGQRDLFEGILQAGSTIVENLRTYKQPIFVYIPMMGELRGGAWVVVDSRINSDHIEMYAERTAKGNVLEPEGMIEIKFRTRELLECMRRLDQQLINLKEKLSEAKSNKDYGAYDSLQQQIRFREKQLLPLYTQIATKFAELHDTSLRMKAKGVIREVLDWRKSRSVFYQRLHRRIGEHSLINIVRDAAGDQLSYVSAMNLLKEWYLNSDIAKGREDAWLDDEAFFRWRDDPANYEDKLKELRVQRLLLQLTNIGDSALDLQALPQGLAALLSKLEASSRDKLISELRKVLG

SEQ ID NO: 4720 - DNA, 2175 bp, Caenorhabditis elegans
  CDS (1)..(2175)
atgctccgtgctgcatccagtatccgcgctgtggccaatcgtggattggcaactgctgctgttgccagaccaggagtaccacttgatgaacgtgagggaaaggagatttacactactgtaggaatcgattacaatgagccaaagttcgacaagattttgattgccaatagaggagagattgcgtgtcgcgtgatcaaaactgccagagctatgggaatcaagacagtggccgttcactcagatgtcgacagcaactcgcttcacgtaaagatggccgatgaggctgtatgtgttggagaagctccaactgccaaatcctacctacgtgctgaccgcatcttgcaagctgtcgaggacaccggtgctcaagcggttcatccaggatatggattcctttccgagaacaccaagtttgccgccgagcttgagaaggctggagccaagttcatcggaccaaactctaaggctattcttgatatgggagacaagattcattcaaagaaaatcgctaccgcagcccgtgtcagcatgattccaggatatgacggagaaattgctgatgaggatatgtgcgtgaaagtctcccgcgacattggatacccagtcatgatcaaggcttctgccggtggtggtggaaaaggaatgcgagttgcctggaacgacaagcaagctcgtgaaggataccgtttgtccaagcaagaagcagcttcttctttcggagatgatcgaatgctcgttgagaagttcattgacaacccacggcacattgagatgcaggtgctctgcgacaagcatggaaacgctttgtggctcaacgagcgtgaatgctccattcagagaagaaaccagaaggttatcgaagaggctccaagcagctttgtgccaccagagatgagacgcaaaatgggagaacaggccgttcagctcgccaaggctgtcggttatgactctgctggaaccgtcgaattcctcgttgattctcagagaaacttctacttcttggagatgaacactcgtcttcaggtcgagcatccaattaccgagtgcatcactggaatcgatattgtccaacagatgcttcgcgtttcctacggtcacccacttccaatcacccaagagcaagtgccactcaacggatgggctttcgagtctcgtgtctacgccgaggatccatacaagggattcggtcttccatcagtcggacgtctctccagatatgttgagccaaaacacgtcgacggagttcgttgcgactctggaatccgtgagggatcggaaatctctatctactacgatccacttatctgcaagctcgttacgcacggagacaaccgtgaacaggctctgaaccgcatgcaagaggctctcgacaactacgtcattcgtggagtcactcacaacattccacttcttcgtgatattgtccaagagaagagattccgtactggagacattaccaccaaatatcttccagaagtgtacccagaaggcttccagggaaccagcctctcaccaaaagagcaagacgttgtcattgcctttgcctcggctctcaacgctcgtaaacttgctcgtgccaatcaattcttgaaccagaacaaacaacgtagcactcatgtggcttccttctcgaagacctacaagttcgtgtcttctctgccagtgaaggagggtgagaggccaaccgagcacgctgttgaagtcgaatttgtcgaaggaagcgccaacaaggcccaagttcgtattggtggaaagactgtgactatcagtggagatctcaacttgtctcatccagtcaactcaattgaagtcgatggagagcacatcaccacccaaattgttggcaagcgcgccggagagatcaccgttctttacaagggaactccattcaaggtcaaggtgcttccagagcaggccgtcaagtacttgcagtacatgaaggagaaggccaaggttgacttgtccacagttgtgctctcaccaatgccaggagcaatcaagaacgtcaacgttaagccaggagatatggtttccgagggacaagagttagttgtcatggaggctatgaagatgcagaacagtcttcatgctggaaagaccggacgcgtcaaggccgtcaatgtgaaggttggagccacagtcgacgagggagaggtgctcgttgagctcgagtag

SEQ ID NO: 4721 - protein, 724 aa, Caenorhabditis elegans
MLRAASSIRAVANRGLATAAVARPGVPLDEREGKEIYTTVGIDYNEPKFDKILIANRGEIACRVIKTARAMGIKTVAVHSDVDSNSLHVKMADEAVCVGEAPTAKSYLRADRILQAVEDTGAQAVHPGYGFLSENTKFAAELEKAGAKFIGPNSKAILDMGDKIHSKKIATAARVSMIPGYDGEIADEDMCVKVSRDIGYPVMIKASAGGGGKGMRVAWNDKQAREGYRLSKQEAASSFGDDRMLVEKFIDNPRHIEMQVLCDKHGNALWLNERECSIQRRNQKVIEEAPSSFVPPEMRRKMGEQAVQLAKAVGYDSAGTVEFLVDSQRNFYFLEMNTRLQVEHPITECITGIDIVQQMLRVSYGHPLPITQEQVPLNGWAFESRVYAEDPYKGFGLPSVGRLSRYVEPKHVDGVRCDSGIREGSEISIYYDPLICKLVTHGDNREQALNRMQEALDNYVIRGVTHNIPLLRDIVQEKRFRTGDITTKYLPEVYPEGFQGTSLSPKEQDVVIAFASALNARKLARANQFLNQNKQRSTHVASFSKTYKFVSSLPVKEGERPTEHAVEVEFVEGSANKAQVRIGGKTVTISGDLNLSHPVNSIEVDGEHITTQIVGKRAGEITVLYKGTPFKVKVLPEQAVKYLQYMKEKAKVDLSTVVLSPMPGAIKNVNVKPGDMVSEGQELVVMEAMKMQNSLHAGKTGRVKAVNVKVGATVDEGEVLVELE

SEQ ID NO: 4722 - DNA, 3864 bp, Caenorhabditis elegans
  CDS (36)..(3563)
ggtttaattacccaagtttgagataaacgacaacgatgcggttctcccgcatcccaccgatcttcgctaatgtcgtccgacagacacattatcgtaactatgccaatggagttatcaaaccaagagaattcaacaaggttatggtggccaatcgtggagaaattgcaatccgtgtgttccgtgccctcacagaattgaacaaaacttctgttgcgatttacgccgagcaggacaaaaactcgatgcatcgtctgaaagctgacgaagcctatcttgtaggaaaaggtcttccaccggttgctgcttatctgactattgaccagattatagaaactgccctgaagcacaacattgatgctattcatcccggatatggatttctgtcagagcgatctgactttgcagctgcttgtcaaaatgcaggaatagtgttcattggtcctagccccgacgttatggctcgaatgggagacaaagttgctgctcgtcaagctgccattgaagctggtgttcaagtcgttccaggaactcctggaccaattacaactgctgatgaagctgtcgaatttgcaaagcagtacggtacaccaattattttgaaggccgcttatggaggaggtggtcgtggaattcgtcgtgttgataaattggaagaagttgaagaggcattccgtagatcctactcggaagctcaagctgcgtttggagacggaagtcttttcgttgaaaagtttgttgagagaccaagacatattgaagttcagctgcttggagaccatcatggaaatattgttcatttgtatgagcgtgattgttcagtgcaacgtcgtcatcaaaaggttgttgaaattgctccagcgccagctctcccagaaggtgttcgtgagaaaattttggcagacgctcttcgacttgcaagacatgttggataccaaaatgctggtacagtcgaattcctggttgatcagaagggcaactactatttcatcgaagtgaatgcacgtcttcaagtcgagcatacagtaactgaagagatcactggtgtggatcttgtccaagctcaaattcgtatcgccgaaggaaaatctctggatgatctgaagctttcacaggaaactattcaaactactggctcagctattcaatgtcgtgtcacaactgaagatccagctaaaggattccagccagattccggaagaattgaagttttccgatccggagagggaatgggaattcgtcttgattcagcatctgccttcgcaggatcagtcatttcacctcactacgattctttgatggtcaaagtaattgcatcggctagaaatcatccgaacgctgccgcaaaaatgattcgtgccctcaaaaagttccgtatccgaggcgtaaagacaaacatcccatttctgctcaacgttcttcgccagcccagcttccttgatgcatccgtcgatacgtatttcattgatgagcatccagagttgttccaattcaaaccaagccaaaaccgtgctcaaaagttgttgaactatttgggagaagttaaggtgaacggtccaactactcctcttgctactgacctgaaaccagcagttgtttctcctccgatcccatacatcccagctggagccaaaccgccgactggacttcgtgatgtacttgttcaaagaggaccaactgagtttgcaaaggaagttcgcagtagaccaggatgtatgatcactgatactacattcagagatgcacatcaatctcttcttgcaacacgagtacgtacctatgatatggctgctatttcaccttttgttgcccaatcattcaatggtctcttctcacttgaaaactggggaggagctactttcgatgtttccatgcgcttcctccacgagtgtccatgggaacgtcttcaaactcttcgcaaactgattccaaatattccattccaatgtcttctgcgaggtgccaatgctatgggatattcaaattatcctgataacgttatttacaagttctgcgagttggcggtgaaaaatggaatggatgtgttccgtgtatttgattcactgaactatcttccaaatcttctcgtcggaatggaagccgttggaaaggccggtggagttgttgaagctgctatcgcatacactggagatgttaccgataagtctcgtgacaaatacgacctcaaatactatttgaacttggctgatcaacttgtcaaagctcaagcgcatattctttctatcaaggatatggctggagttctgaaaccggaagctgccaagttgttgattggcgctctccgagacaagttcccagatattccaattcacgttcatacccacgatacatctggagctggagttgctgctatgcttgagtgtgccaaagctggagctgatgtggtcgatgctgcagttgatagcatgagtggaatgacttctcagccttcaatgggagctattgtagctagtcttcaaggaactaaacatgatactggtctttctcttgatgacatttcaaaatattctgcatactgggagtcaactcgtcaactctatgctccattcgaatgtgccaccaccatgaaaagtggaaatgccgatgtttacaagcacgaaattccaggaggacagtacacgaacttgcaattccaagcattctctctcggacttgggccacagttcgatgaagtcaagcgtatgtatcgtgaagctaatcttgttcttggcgacataattaaagttacgccatcatccaagattgtcggtgacttggctcagtttatggtgcaaaacaacttgactcgcgaaactcttgtcgaccgtgccgatgatctatccttcccaaaaagtgtcgttgatttcatgcaaggaaatgtcggacaacctccatatggattccctgagccattgagaactaaagtccttcgtggaaagccaaaagtcgatggaaggccaggagaaaatgctaagccagttgatctagatgctgtgaaggtcgaacttgaagagaaacatggacgtactttgtctgaagaagatgtgatgtcatattcgatgttcccaacggttttcgatgagtttgagactttccgtcaacaatatggaccagttgataagctgccaacgagactcttcttgactggattggagattgcggaagaagttgatgttgaaatcgagagtggaaaaactcttgcaattcaattgctcgctgaaggaaaactaaacaagcgtggagaacgcgaagtcttctttgatctcaatggacaaatgagaagtatcttcgtggttgacaaggaagcttccaaggaaattgtaactcgcccaagagctctcccaggtgtccgtggacatattggagcaccaatgccaggagatgttttggagctgaaaatcaaggaaggcgacaaggttaccaagaagcaacccctatttgtgctttccgccatgaaaatggagatggtcatcgactctccaattgctggaaccgtcaaggctatccatgcaccacaaggaaccaaatgtagtgccggagacttggtagttgaagttgaaccatgaactgacatcaataaactcgcattttgtctctttttttgttaattccattcaccatcacaaattccgccacatcgaaattatatttggcgttgtgctatatagaatgattagccaccaccttctctttgccattcgaaccatctcaatgtgtatattctgtgtattgcctccccaaaattttctaaacgtcttcattgccagtaatttttcgttttccctccacttttgcatttatattgttttcttagaaaaagtatttattgcatcgggtgctcattgtctttgtgtagaatataaactc

SEQ ID NO: 4723 - protein, 1175 aa, Caenorhabditis elegans
MRFSRIPPIFANVVRQTHYRNYANGVIKPREFNKVMVANRGEIAIRVFRALTELNKTSVAIYAEQDKNSMHRLKADEAYLVGKGLPPVAAYLTIDQIIETALKHNIDAIHPGYGFLSERSDFAAACQNAGIVFIGPSPDVMARMGDKVAARQAAIEAGVQVVPGTPGPITTADEAVEFAKQYGTPIILKAAYGGGGRGIRRVDKLEEVEEAFRRSYSEAQAAFGDGSLFVEKFVERPRHIEVQLLGDHHGNIVHLYERDCSVQRRHQKVVEIAPAPALPEGVREKILADALRLARHVGYQNAGTVEFLVDQKGNYYFIEVNARLQVEHTVTEEITGVDLVQAQIRIAEGKSLDDLKLSQETIQTTGSAIQCRVTTEDPAKGFQPDSGRIEVFRSGEGMGIRLDSASAFAGSVISPHYDSLMVKVIASARNHPNAAAKMIRALKKFRIRGVKTNIPFLLNVLRQPSFLDASVDTYFIDEHPELFQFKPSQNRAQKLLNYLGEVKVNGPTTPLATDLKPAVVSPPIPYIPAGAKPPTGLRDVLVQRGPTEFAKEVRSRPGCMITDTTFRDAHQSLLATRVRTYDMAAISPFVAQSFNGLFSLENWGGATFDVSMRFLHECPWERLQTLRKLIPNIPFQCLLRGANAMGYSNYPDNVIYKFCELAVKNGMDVFRVFDSLNYLPNLLVGMEAVGKAGGVVEAAIAYTGDVTDKSRDKYDLKYYLNLADQLVKAQAHILSIKDMAGVLKPEAAKLLIGALRDKFPDIPIHVHTHDTSGAGVAAMLECAKAGADVVDAAVDSMSGMTSQPSMGAIVASLQGTKHDTGLSLDDISKYSAYWESTRQLYAPFECATTMKSGNADVYKHEIPGGQYTNLQFQAFSLGLGPQFDEVKRMYREANLVLGDIIKVTPSSKIVGDLAQFMVQNNLTRETLVDRADDLSFPKSVVDFMQGNVGQPPYGFPEPLRTKVLRGKPKVDGRPGENAKPVDLDAVKVELEEKHGRTLSEEDVMSYSMFPTVFDEFETFRQQYGPVDKLPTRLFLTGLEIAEEVDVEIESGKTLAIQLLAEGKLNKRGEREVFFDLNGQMRSIFVVDKEASKEIVTRPRALPGVRGHIGAPMPGDVLELKIKEGDKVTKKQPLFVLSAMKMEMVIDSPIAGTVKAIHAPQGTKCSAGDLVVEVEP

SEQ ID NO: 4724 - DNA, 4974 bp, Caenorhabditis elegans
  CDS (1)..(4974)
atgtcagacttgggcgacgaaaacagctcggatccggattctaataaaatcgacgagtttgtcaagatgcttgaaggtggacggagcatcaaaagaattcttgttgcaaacaacgggttagccgcaatgaaatgtctcatctctattcggcaatggcttcaaaatcaatttggtacttctggggtggtaagttttgtctgtatcgccactgaagatgagatgaggtctgcgagtcattatctcaagttagctgacgaaatcgtcatggccccagctggttctaattcaaaaaattttgctaattgtgacgtcatcataaggttggctgtggaagcgcaggtcgacgcagtttatgttgggtggggtcatgcttctgaaaatccggagctctgtagacgtctcgagctgaataatattatttttattggcccatcggaaaaatctataatagcatcaggcgataaaatcgttagcaccatcattgctcaatcaatcggaatgccaactgttacatggactggaagtggtgtgaaagttgaagaatgcgtggattttgagcattatcatgagctccgctctaaagctaccattcgaaatgtaaaagagggtctcgaggcgatcgaaaaatacggtattggtgtgccaatgatgataaaagcatccgaaggtggaggtggaaaaggtattaggaagtgtgagaatatggacgatttcaagaggcttttcaaggaagtagagttagaatttccgaactccccgatcttcttgatgaagtgtatggatggtgctcgtcacgtggagattcaaattctcggtgataaacatggagacgttattgctctatcgtctagagattgcacaattcaacgaaggtgtcagaaagttatagaagaagctccagcgagcattgtcccaggagaagttatgcagaaaatgaaaaaggacgccatagcatttgccaactttgtcggatactactctgcaggaactgtcgaacttctgttcattcctaccacaaacgagtacttcttccttgagctcaatccacgtctccaagtcgaacatccttgcacagaatcaatctgcgacgtgaatgtcccagcgctgcagtatcaaattgcaatgggcagaaagctgaaagatattccgtgtattaaacgattcagagaacgggaagcaactggaaacgctggaggagttcattgtatggcggcgagagtaacttgtgaggatcctaatgatagatttctgccttctactggaaccgtaagatctttgaaattcaactctacttcgaaagcttgggcatatttttcgttatctgatggaagcactgttcatgagtttgcggactcgcaaatcggccacgttttcgcgagaggaagagatcgaaatgaggctattgccaatcttaaacacggacttcaaaatctgaagattgatgctacgtttccaactcaatcggattacctcatcgatttgctatcacttgagaaattcaagtcgaaccagtacgacacacaatggttggataagcgaattgctagtaaagaaggccagaaactaacactctcaatagaccatctcattgcaattagtgcagctgccattggtcgttcaaaaattcgccgagcatttgaaaaatatgaacatcagttgaaaactgggaagatcgtactacctatcgagttgtcaaggtgtacggagctagatttgcttatgaataatttgaagtatacgctgaaagtgtttgaggagacctctatgaaatatcacgtccgaatgggagaacaagaaaccactgttaaaatgcttcagtatggaagtcaaactttagccattcatcagggaaaatcaactgatttttgtctcgaaaaaagcgatgatttctatttcatcaaaatcggcggaaataaattgaaattcccaataactgatacaaatgatgctacttgcctcagatctccatacactggaaaattcttagagtataaggtgcaacctggtgaatttgtggaagttggacaaacttatgcacaaattgagtcgatgaagatggttttcgatgtagtaacgaaaattgtacctggaagactcattccaattgcaaaagaaggtgatcttattaatcctggatccattctcgggagacttgaaattgataagcaagttcaagatcaactgccaactagtgagaagttcagtggaaagatgaaggggtggaagatggaggagaagagttatttcgaaagagcgaaattaattttggaaggacgtggacctttggattatccggttgactcactgatctcaggactattctactcgaaagaatgtggtgatgacgctacactatccaatgagcaaacccatgagctcctagagcgatttttggaaacggaacaatacttcgatgctcgagacagttttgatgaatccgttcagaatatgattaaatccaatgtcgacgtcttggattttgaaaatgtcgtagaccaaatttattcgaattcacatttgagaaccaaagaaaaattaatttttggcgttttaagtcacatttccaaatctcaagttgaacctgatttcttcataccaatactctggaaactatttgagttgaatcatctcaaagaagtcaacattctgactgcaaggattctctaccgatccatcgaacatcaagattttacagtgaagagttgtaaaatcgttacacataaatccgggttttctgattgtgttgcatctatgaagtttgagaatgacacggacgtttcaatttccaattgcatcgatcaagcgcttattgagtttgtcaactattcctcagagtactccaaacttaaatttgttgcgaatcgaatcaaaatcgcgaacaattctgataattatatagtttctgatattgagaacttaattttgaagcgccaaaaacagttggaagatgccgaagtcaaggaggtttttatacaaagagctggaggatccttgagatttgttaatgaatttggagtttttcggactgaagttttgcataattctgatgaatcaagtgaattctcaccaccagacaaacgtgatttcaaacgaagtttggccagacaaaaccgcacaacatacatttacgacttcccgagaatgtttgcctgggtggcatctggctcttctaaagaacctttggatacatggagttccacagttcaagtccaagaactcgtaatcgacgacgaaagcagtgaacttcggtttatctccgacctaaaagaacttgaggcgcgtgctactgaaggtgccaattcatgctcggttgttgcctggcttttgaacattcatatcgatcaaaagaacatggaattcgttttgattgggaatgacgtaactcatcaagtcgggtcgtttgctcaaccagagcacagactatttgagatggctagtaagcttgccagagagaaacagatccctcgaatcaatatttcctgtaattcgggggctcgaattggacttgccagagatgttctagatgtactgaaagtaaagttgaaatcaaatggacatgattttgattatctctacgttgatgcaacggaaaaggagcgaattggaagtcaaatagtctacaagcagcatgagaacgagctaaggataaaagctgtaaaaggaaagaagaacgagtatattggcgtcgaaaatctcatggggtccggggcaattggaggtgaaacttctcgtgcttatcgtgagattccaacttattgctatgtaactggaagatctgttggcattggagcatacactgcaagacttgcaagacggattattcagcatgaaaaagctcacttaattctcacaggatccgctgctttgaatacacttttgggaaagaaagtgtatgcatccaacaatcgtttgggaggaatagaaataatgagaagcaatggaatagcccacgctactgtctcatcggaccttgcaggagttgcgaagctggttcactggatgcaatatttacctgccactcagtctgagtttccatttttccgatgcttcaacgaccaatcgccaagcactgagttagaagcagtaggagtcactaaagatgagatgcagttggatgtcaaaaacttgtttgaagggttcaacggaaaacaaggattatttgatactgattcgttcgacgagattcgctcttcatgggccgcttcaatggtgaccggacgtgccaaattgaatggattgccagttggagttattgcgtcacaatggaaatcttatgagaaactactactggctgatgaaagtgtggaaaacagtgaagaaatgataacaagtaaagctggtcaagtatggtacccggaatcagcgttcaaaacatcccaagcaatatctgacttcaatcgggaatctcttccacttataatgattgcaagtcttcgtggattctctggaggacgaaaagacatgtcagatcaagttcttacttttggagctcacattatcgatgaactgtcacaatatcaacaacctagtgccttcaaaaaagggtgtgtcgaattcgccgacatgcacgatcgttggcagcgaatggatcatgttggagcaattcgtcaagttgtgacgcttcaaaaaactcgagatgtcttctggaaaattctacgtcgagaaatgattctgatagagatggcaagaagattccaaaaggctccaatctatccaaaaccttcactatcggaggctcttgattgggttcaaaagaagattgatggcgtcgataacttagagcaattctacaatcaatttttttctgaagcggtttctgcggaaattgaggaatcaaagcaaaagttcgatcaattcattgccacctggcaagattttttttttatttttctattgaaatatttttctatttttctattttattttatttttctattgaacgattttttgtctagaataccttttttcatttaa

SEQ ID NO: 4725 - protein, 1657 aa, Caenorhabditis elegans
MSDLGDENSSDPDSNKIDEFVKMLEGGRSIKRILVANNGLAAMKCLISIRQWLQNQFGTSGVVSFVCIATEDEMRSASHYLKLADEIVMAPAGSNSKNFANCDVIIRLAVEAQVDAVYVGWGHASENPELCRRLELNNIIFIGPSEKSIIASGDKIVSTIIAQSIGMPTVTWTGSGVKVEECVDFEHYHELRSKATIRNVKEGLEAIEKYGIGVPMMIKASEGGGGKGIRKCENMDDFKRLFKEVELEFPNSPIFLMKCMDGARHVEIQILGDKHGDVIALSSRDCTIQRRCQKVIEEAPASIVPGEVMQKMKKDAIAFANFVGYYSAGTVELLFIPTTNEYFFLELNPRLQVEHPCTESICDVNVPALQYQIAMGRKLKDIPCIKRFREREATGNAGGVHCMAARVTCEDPNDRFLPSTGTVRSLKFNSTSKAWAYFSLSDGSTVHEFADSQIGHVFARGRDRNEAIANLKHGLQNLKIDATFPTQSDYLIDLLSLEKFKSNQYDTQWLDKRIASKEGQKLTLSIDHLIAISAAAIGRSKIRRAFEKYEHQLKTGKIVLPIELSRCTELDLLMNNLKYTLKVFEETSMKYHVRMGEQETTVKMLQYGSQTLAIHQGKSTDFCLEKSDDFYFIKIGGNKLKFPITDTNDATCLRSPYTGKFLEYKVQPGEFVEVGQTYAQIESMKMVFDVVTKIVPGRLIPIAKEGDLINPGSILGRLEIDKQVQDQLPTSEKFSGKMKGWKMEEKSYFERAKLILEGRGPLDYPVDSLISGLFYSKECGDDATLSNEQTHELLERFLETEQYFDARDSFDESVQNMIKSNVDVLDFENVVDQIYSNSHLRTKEKLIFGVLSHISKSQVEPDFFIPILWKLFELNHLKEVNILTARILYRSIEHQDFTVKSCKIVTHKSGFSDCVASMKFENDTDVSISNCIDQALIEFVNYSSEYSKLKFVANRIKIANNSDNYIVSDIENLILKRQKQLEDAEVKEVFIQRAGGSLRFVNEFGVFRTEVLHNSDESSEFSPPDKRDFKRSLARQNRTTYIYDFPRMFAWVASGSSKEPLDTWSSTVQVQELVIDDESSELRFISDLKELEARATEGANSCSVVAWLLNIHIDQKNMEFVLIGNDVTHQVGSFAQPEHRLFEMASKLAREKQIPRINISCNSGARIGLARDVLDVLKVKLKSNGHDFDYLYVDATEKERIGSQIVYKQHENELRIKAVKGKKNEYIGVENLMGSGAIGGETSRAYREIPTYCYVTGRSVGIGAYTARLARRIIQHEKAHLILTGSAALNTLLGKKVYASNNRLGGIEIMRSNGIAHATVSSDLAGVAKLVHWMQYLPATQSEFPFFRCFNDQSPSTELEAVGVTKDEMQLDVKNLFEGFNGKQGLFDTDSFDEIRSSWAASMVTGRAKLNGLPVGVIASQWKSYEKLLLADESVENSEEMITSKAGQVWYPESAFKTSQAISDFNRESLPLIMIASLRGFSGGRKDMSDQVLTFGAHIIDELSQYQQPSAFKKGCVEFADMHDRWQRMDHVGAIRQVVTLQKTRDVFWKILRREMILIEMARRFQKAPIYPKPSLSEALDWVQKKIDGVDNLEQFYNQFFSEAVSAEIEESKQKFDQFIATWQDFFFIFLLKYFSIFLFYFIFLLNDFLSRIPFFI

SEQ ID NO: 4726 - DNA, 6867 bp, Emericella nidulans, Aspergillus nidulans
  CDS (1)..(6867)
atgggcgtcccagacggtacaacaaacggccacggaggctctcgagccgccaaacacaacctcccctcacatttcattggtggcaaccacttagacgctgctgccccaagcagcgtcaaggactttgtcgctaaccatgaaggtcactccgtcatcacctcggtccttatcgcgaataacggtattgcggccgtcaaggagattcgatctgtccgaaaatgggcctacgagacattcggcaacgagcgtgccattcaattcacagtgatggcaaccccagaagatctggcggcgaacgccgactatatccgtatggctgatcaatatgttgaggtccctggtggtacgaataacaacaactacgccaacgtcgagctgattgtggatgtggctgaacggatggacgttcacgccgtctgggccggttggggtcacgcctctgagaacccccggttaccagaatctctagccgcttctcccaaaaagatcatctttattggacctcccgcctctgcgatgcgatctcttggtgacaagatttcctctactatcgtcgctcagcacgctcaggtaccgtgcattccgtggtctggaaccggtgtagatgaggtgaaggttgatgagaacggcatcgttacggtggaggaagaggtttacaacaagggatgcacattctctccggaagagggtctagagaaagccaagcagattggattccccgtcatgattaaagcctccgagggtggcggtggtaagggtatccgtaaggttgagaaggaagaggactttatcaacctgtacaatgctgcggcgaatgagattcctgggtcacctatcttcatcatgaagcttgccggtaacgcccgccacttggaagtgcagttgttggctgaccagtacggtaacaatatttcgcttttcggtcgtgactgttccgtgcagcgacggcaccagaagattattgaggaggcgccagtaaccattgcgaaccctacaactttccaggccatggaacgtgccgccgtgagcttgggtaagcttgtcggttacgtctccgccggtacggttgagtacctgtactctcacgctgatgacaaattttacttcctggagctcaacccgcgtctgcaggtcgagcatcccaccactgaaatggtcactggtgtcaacttgcccgctgcccagctccagattgccatgggtatccctctgcaccgtatccgtgacattcgtctgctttatggcgttgaccccaatacatcggcggagatagacttcgacttttccagcgaagagagcttcaagactcagcgccgtcctcagcccaagggacacaccaccgcttgccgtatcacttccgaagatcctggtgagggtttcaagccctctagcggaaccatgcacgagttgaacttccgaagttcatctaacgtttggggttacttctctgtcggaacagcgggtggtatccacagtttctccgacagccagttcggtcacatcttcgcgtacggagagaaccgctccgcctcgcgaaagcacatggtcattgccctgaaagaattgagcattcgtggtgatttccggacgacaattgagtacctgatcaagctcttggagacgccagcttttgaggaaaacaagatcaccactggttggttggatcagctgatttccaacaagctgactgcagagcgtcccgatacaacgatcgctgtgctctgcggtgctgtcactaaagcccatcaggctagcgaggcgcgccttgaagagtaccgtaacggcattcagaagggtcaggttccctctaaggatgtcctgaaaaccgtcttccccgtggacttcatctacgagggtaagcggtacaagttcactgccacccgtgccggtcttgacagctatcacctcttcatcaacggttctaagtgctcgattggtgtgcgtgccttggctgacggtggactactcgtcctcctcaacggtcggagccataacgtatactggaaggaggaggccgctgctacccgtattagtgtggacggcaagacttgcttgctcgagcaggagaatgatcctactcaacttcgtactccctctcccggaaagttggtcaagttcaccgtcgagaacggagagcatgtccgcgccggtcagccttttgctgaagttgaagtcatgaagatgtacatgcctctgatcgcccaggaggacggtattgtccagctcatcaagcagcccggtgccacccttgaggctggtgacattcttggtatccttgcccttgacgatccatcccgtgtcaagcatgctcagccgttcaccgagcagcttcccccaattggaccccctcaggtcgttggtaataagcctgctcaacgatttttcctcttgcacagcattttggagaacatcttgaagggtttcgacaaccaggttattatgaactctactctcaaggagctcatcgaggtccttcgcgaccccgagttgccttacagcgaatggaacgcccagtcttccgccctccactcccgcatgccccagaaattggatgctcagcttcaaaacattgttgaccgcgctcggtcacgcaaggccgagtttccggccaggcagctgcagaagactatggtccgattcattgaagagaatgtcaaccctgctgacgccgagatcctgaagactacacttcttcctttggttcaggttattaataactacatcgaaggcttgaaggcgcacgaatacaaggtgttcgttggacttctcgagcagtactacgctgtggagaagctgttctctggcagcaaagctcgatatgaggatggtatcctcgccctccgtgaggagcacaaggatgatgttgccactattgtgcagatcgccctgtctcacagccgcatcggcgccaagaacgacctcatcctcgcgatcctgtcgatctaccgtcccaaccagcctggaatggccaatgtgggccagtacttcaagtcgattctgaagaaactgactgaaattgagtcgcgtgctgcggccaaggtcaccctgaaggctcgtgaagtcctcattcagtgcgctctgccttcgctggaggagcgtctttctcagatggagctcattctgcgctcctctgttgcggagtctcagtacggcgagaccggctgggcccaccgtgagcccgatctcggtgccctcaaggaggttgtcgattccaaatacaccgtgttcgacgttctgccacgcttctttgttcacaaggatgcgtgggtcactttggcggctctcgaagtctatgtgcgccgcgcctaccgtgcttactcaattcagggtatccagtatcaccacgagggcgagccagcattcctgtcttgggacttcacaatgggcaagctgggtcagcctgagttcggttccatgactgctgtcacccacccctccacgccaagcacgcctaccactgaatcaaaccccttcaagcgcgtctcctcaatcagtgacatgtccaacttgctaaatgacagccccaacgggactcccagaaagggtgtcatccttcctgtacagtacctcgaagatgccgaagagtacctcaccaaggctttggaagtgttcccaagggctggcactaggaagcctagcgaccatggcctaattgcctctcttgaggggaagcgccgtccggctccccgtgctgacagtgagtctactgagctgaccggagtcttaaacatcgccatccgtgacatcgaggagcttgatgatgcccagatcgttgcccagatcagtaagctcgtttctagcttcaaggacgagttccttgcgcgccgcattcgtcgtgtgacgttcatctgcggcaaggatggtgtctaccccagctactacaccttcagaggtcccaactacgaagaggatgagagtatccgccacagcgagcctgccctggccttccagctcgaactcaaccgtctttccaagttcaagatcaagcccgtattcacagagaacaggaacatccatgtctacgaggcgattggcaaggggcctgagaacgataaggctttggacaaacggtacttcgttcgcgctgtcgtccgtcccggccgactccgtgacgatatccccactgcggagtaccttacctcggaagctgaccgtttgatgaacgacattcttgatgcccttgaggtcattggcaacaacaactccgatctcaaccacatcttcatcaacttctcccccgtcttcaacttacagcccaaagatgtggaagaggcattagcaggcttcttggatcgcttcggccttcgcctttggcgccttcgtgtcactggtgccgagatccgcattctatgcaccgatcccgccactggcatgccataccctctgcgtgtgatcattagcaacactgttggctatatcatccaggttgagctttacattgagaaaaagtccgagaagggcgagtggcttcttcacagcattggtggcactaacaagcttggatccaaccacttgcgtccggtttccaccccttaccctaccaaggagtggctgcagcctaagcgctacaaggctcacgtcatgggtactcaatatgtgtacgacttccctgagctcttccgtgaagctttccagaactcgtggaccaaggccatagagaagagcccgagcttgatcgagcgtcgtcctcctcttggcgagtgcatggaatacagcgagcttgtcttagacgatactgacaacctggttgagatttctcgcggccctggcaccaacacccacggtatggttggatggatagttactgctcgcacccccgagtatcccgagggcagacgcttcatcattgttgcgaatgacattaccttccagatcggttcgttcggtccattggaagacaagttcttccacaaatgtaccgaattggctcgtaagctcggaatccctcgtgtctacctttctgccaactctggtgctcgcattggtatggcggatgagctcatcccatacttctccgttgcttggaacgaccctgctaagcctgaggctggcttcaagtacctttacctcacacctgaggtgaagaagaagttcgacgcaagcaagcagaaggaggttatcactgaactgattcacgatgagggtgaggagcgccacaagatcaccaccattatcggtgccaaggatggtcttggagtcgagtgtcttaagggttctggtctcattgctggtgccacttcccgcgcttacgaagacatttttaccattactctcgtcacctgccgttcagtcggtattggtgcctaccttgtccgtcttggacaaagagctattcaggttgagggccagcctatcattcttactggtgctcctgccatcaacaagctgctaggaagagaggtctatacttccaacctgcagcttggtggtactcagatcatgtacaggaacggtgtttctcacatgaccgctgctaacgacttcgatggtgtcgagaaaattgtcgactggcttgccttcgtccccgaaaagaagggctctctgccacccatccgaccactcgccgacccttgggatcgtgacgtttcttaccaccctcctgcaaagcaagcctacgatgtccgttggctcatcaatggtaaggaagacgaggaaggcttcctccctggtctttttgacgccggctccttcgaggaggctcttggtggctgggctcgcactgtcgttgttggtcgtgctagacttggtggcatccccatgggtgttatcgctgtcgagacacgctctgtggagaacgttactccggctgatcctgctaaccccgactctatggaaatgatcacccaggaagcgggcggtgtctggtaccctaactcgtccttcaagactgcccaggccctccgggacttcaacaacggcgagcagcttcccgttatgatattggctaactggagaggtttctctggtggacaacgtgacatgtacaacgaggttctgaagtacggttcctacatcgtggatgctctcgtcaaatacgagcagcctattttcgtgtacattcctccgttcggtgaactccgtggtggttcttgggtcgttgtcgaccctaccatcaaccccgaccagatggaaatgtacgccgatgaggaggcccgtggtggtgtcctggagcccgagggtatcgttaacatcaaattccgccgcgacaagcagttggagaccatggctcgtttggaccctacttacggagaacttcgccgcgctcttcaggacaagaacctcagcaaggagaaactttccgacatcaaggacaaaatggcggcacgcgaggagcaactccttcctgtttacatgcagattgcattgcagtttgccgatctgcacgatcgtgctggccgcatgcaagccaagaacaccatccgccaagccctctcctggaagaacgctcgtcgcttcttctactggcgtgttcgccgccgtattagcgaggagtacattatcaagcgcatgctcaccgcatgccctgctcctgttcagggtgaaggcagcggagctgtcgcccagggtgtgtcgcctgcccctagcgactcccctcgcaccacccatctccgcactttgcactcatggactcccttccttgagaacgaggttgagaatgacgaccgtcgcgtcgccgtctggtatgaggagaacaaggagcttatccaggagaagattgaagctctcaagtctcaagccatcgcttcccagatctccgacgtcctcttcagcaaccgcgaaagcggcctcaagggcattcagcaggctctcagcttcctccctgttgaagagaaagagtccattctcaaatacctcggatccaactag

SEQ ID NO: 4727 - protein, 2288 aa, Emericella nidulans, Aspergillus nidulans
MGVPDGTTNGHGGSRAAKHNLPSHFIGGNHLDAAAPSSVKDFVANHEGHSVITSVLIANNGIAAVKEIRSVRKWAYETFGNERAIQFTVMATPEDLAANADYIRMADQYVEVPGGTNNNNYANVELIVDVAERMDVHAVWAGWGHASENPRLPESLAASPKKIIFIGPPASAMRSLGDKISSTIVAQHAQVPCIPWSGTGVDEVKVDENGIVTVEEEVYNKGCTFSPEEGLEKAKQIGFPVMIKASEGGGGKGIRKVEKEEDFINLYNAAANEIPGSPIFIMKLAGNARHLEVQLLADQYGNNISLFGRDCSVQRRHQKIIEEAPVTIANPTTFQAMERAAVSLGKLVGYVSAGTVEYLYSHADDKFYFLELNPRLQVEHPTTEMVTGVNLPAAQLQIAMGIPLHRIRDIRLLYGVDPNTSAEIDFDFSSEESFKTQRRPQPKGHTTACRITSEDPGEGFKPSSGTMHELNFRSSSNVWGYFSVGTAGGIHSFSDSQFGHIFAYGENRSASRKHMVIALKELSIRGDFRTTIEYLIKLLETPAFEENKITTGWLDQLISNKLTAERPDTTIAVLCGAVTKAHQASEARLEEYRNGIQKGQVPSKDVLKTVFPVDFIYEGKRYKFTATRAGLDSYHLFINGSKCSIGVRALADGGLLVLLNGRSHNVYWKEEAAATRISVDGKTCLLEQENDPTQLRTPSPGKLVKFTVENGEHVRAGQPFAEVEVMKMYMPLIAQEDGIVQLIKQPGATLEAGDILGILALDDPSRVKHAQPFTEQLPPIGPPQVVGNKPAQRFFLLHSILENILKGFDNQVIMNSTLKELIEVLRDPELPYSEWNAQSSALHSRMPQKLDAQLQNIVDRARSRKAEFPARQLQKTMVRFIEENVNPADAEILKTTLLPLVQVINNYIEGLKAHEYKVFVGLLEQYYAVEKLFSGSKARYEDGILALREEHKDDVATIVQIALSHSRIGAKNDLILAILSIYRPNQPGMANVGQYFKSILKKLTEIESRAAAKVTLKAREVLIQCALPSLEERLSQMELILRSSVAESQYGETGWAHREPDLGALKEVVDSKYTVFDVLPRFFVHKDAWVTLAALEVYVRRAYRAYSIQGIQYHHEGEPAFLSWDFTMGKLGQPEFGSMTAVTHPSTPSTPTTESNPFKRVSSISDMSNLLNDSPNGTPRKGVILPVQYLEDAEEYLTKALEVFPRAGTRKPSDHGLIASLEGKRRPAPRADSESTELTGVLNIAIRDIEELDDAQIVAQISKLVSSFKDEFLARRIRRVTFICGKDGVYPSYYTFRGPNYEEDESIRHSEPALAFQLELNRLSKFKIKPVFTENRNIHVYEAIGKGPENDKALDKRYFVRAVVRPGRLRDDIPTAEYLTSEADRLMNDILDALEVIGNNNSDLNHIFINFSPVFNLQPKDVEEALAGFLDRFGLRLWRLRVTGAEIRILCTDPATGMPYPLRVIISNTVGYIIQVELYIEKKSEKGEWLLHSIGGTNKLGSNHLRPVSTPYPTKEWLQPKRYKAHVMGTQYVYDFPELFREAFQNSWTKAIEKSPSLIERRPPLGECMEYSELVLDDTDNLVEISRGPGTNTHGMVGWIVTARTPEYPEGRRFIIVANDITFQIGSFGPLEDKFFHKCTELARKLGIPRVYLSANSGARIGMADELIPYFSVAWNDPAKPEAGFKYLYLTPEVKKKFDASKQKEVITELIHDEGEERHKITTIIGAKDGLGVECLKGSGLIAGATSRAYEDIFTITLVTCRSVGIGAYLVRLGQRAIQVEGQPIILTGAPAINKLLGREVYTSNLQLGGTQIMYRNGVSHMTAANDFDGVEKIVDWLAFVPEKKGSLPPIRPLADPWDRDVSYHPPAKQAYDVRWLINGKEDEEGFLPGLFDAGSFEEALGGWARTVVVGRARLGGIPMGVIAVETRSVENVTPADPANPDSMEMITQEAGGVWYPNSSFKTAQALRDFNNGEQLPVMILANWRGFSGGQRDMYNEVLKYGSYIVDALVKYEQPIFVYIPPFGELRGGSWVVVDPTINPDQMEMYADEEARGGVLEPEGIVNIKFRRDKQLETMARLDPTYGELRRALQDKNLSKEKLSDIKDKMAAREEQLLPVYMQIALQFADLHDRAGRMQAKNTIRQALSWKNARRFFYWRVRRRISEEYIIKRMLTACPAPVQGEGSGAVAQGVSPAPSDSPRTTHLRTLHSWTPFLENEVENDDRRVAVWYEENKELIQEKIEALKSQAIASQISDVLFSNRESGLKGIQQALSFLPVEEKESILKYLGSN

SEQ ID NO: 4728 - DNA, 6165 bp, Caenorhabditis elegans
  CDS (1)..(6165)
atggttgtaaacgggcaaaaaccagatatcagaacgatcgtcgtcagtggaaattcgctgaccaacgatgccgccgatcagtacgagagcatggagcagttcattcactctcacgtggccgatattgagaagagaaggcccatcaagaggctcctcgtcgccacaaatggaatcgccgctatgcgatgcctgatgactgccaaaaaatttctccatcacacattccgcaacgataatctcatccattttgtctgtatgaccacggaagacgagattcagtcaatgtcagaatccctccgaatgccgaacatcacacttgccgagtcgccatccggtaccaacaagaacaatttcgccaatgtcgacgagatcctgaagcacgcgatcaagtacgaggtcgatgccgtctgggccggatggggacacgcttcggagaatcctgatctaccgcgccggctcaatgatcacaatattgcgttcatcggacccccagctagtgctatgttcagtttgggagacaagatcgcgagtacgatcattgcgcagaccgtcggagtgcctactgtcgcctggtcgggatccgggatcactatggagagcatcgagcgatcccgtggagatttcgtcgtggtgccagaggatctgctcgagcaggcgtgtgtcgccaactacaaggagggtctcgaagcgctcaaaactcacaatatcggattccccttgatgatcaaagcgtcggagggtggaggtggaaaaggaatccgaaaatgcaccaaagtcgaggacttcaagagcatgttcgaggaagttgcccaagaggttcaaggatccccgatcttcctgatgaagtgcgtcgatggagcgcgccatatcgaggttcagctcctcgctgatcgttacgaaaatgtgatttccgtgtacaccagagactgctcgattcagcgacggtgtcagaagatcattgaagaggcaccggcgatcattgccagcagccacatcagaaagtcgatgcaagaggacgcagtgcgtcttgccaagtacgtcggatacgagtctgccggaactgtcgagtacctgtacctaccagccagtgagggtcaggaggagcactattatttcctggagctgaatccaaggcttcaagtcgagcatcccaccactgagatggtgtcgaacatcagcatccctgctattcaacttcaaatcgctatgggtctccctttgcataagatcaaggatatccggaagctctacgatcttccgattgatggagactctgagctgcccgacgaggtgttggtggatacgaagcttcatgcgatcgccgccaggatcacatgcgagaacccggacgacagcttccgtccatccaccggaaaggtctatgagatcaacttcccgtcgtcgcaggatgcgtgggcgtacttctcagttggaagaggatccagtgttcatcaatttgctgattctcaattcggacacatcttcacgcgtggaaccagccgaacggaggcgatgaatacgatgtgctcgacgttgaagcatatgacgatccgatcgagcttcccgactcaggtcaactatttggtggatctgatgcacgacgctgacttcatcaacaacgccttcaacacacaatggctggataagaggatcgccatgaagatcaaacagaagtgcagtctatcgatgagtgtgatcatcgcagtcagtgccgccgtcatcggaagctcccgagtcacaggagtcttcgagagcttcgaggaatccatcgatcgtggacaagttcgcccgccgaacgatctgactgagacgttcatcttcgaccttgtcaaagatctcaacatctactcgttgaaggtagtcagaagtgccgagaacaccttcgtcatcatcctgaacggatccaaggtgaccgtcggagtgaaggagcttcagaatggagagttcatggtgactcactgtgagattgtctaccgatgcgctttcgaggagaccaaggaagcctacaaggtcactgtgaacaatgagatcattacattcgagaaggacaatgacgtcagtgtgctcaagtctccgtacactggaaagttgctccaatggaagaaggaggacggtgattggctgaacgtcggcgatgtctacgccactgccgagtcgatgaagatggtgttccaggtggaggtcgccaaggcgcctggaagactccagcgtgtcgtcaacgaaggggacccgatccatccgggaagtgtccttgcgaagcttgtcgatcagacggaatccgaagcggatcgggctcagccgttccatgggacgttccttgaatggtcatggcacagctcgaaggccaatgagcagtcgaagttcaatgattgcttggcgcaatgccaaaacctgctggccggttcgacaccgatggacagcgcatgcattatcaccgaactcttccatcatctcaacgaaagccacaccgcccacgcatccgaagtgctcaatcaactgctccgcgactatatcaacgtggagaagtattttgagggaaaagtgtacgatgactcggttggagagatcaaggaggatcacctcagtcggaaggacgttgttcggaccatctactcgcatacacagatcaaatcgaagaatattgtgatgaaggcgctgctgggtgcactgaagcaaggatccggatcgaagtttatcccgtcgttgttggataatcttcgacagattggaaatctccatcataccgaagagatttcgaatcttgcccgtgaaattctgctcttctaccacagcatgtgctacaagaacaactactcggagatcacggccagcggcctcagacctacaggccaggaggtcaaggcttggcttgatggcccgctatcgagaaggccggattccagtggatggaaggtcatccacgagtacttcttcgatgagacaatcggatcgcaatgccttgatcgttatgtggctatgcacatctccgcggaggaaggatccattggaaacacctacccgctgcctcagatgaaatgcaccattgatcactttacactgaccgccacgccgaagagcttcaacaaagtcgtgctgaaagggaacaagctgatcgttgtccgactctctctggactccaagaccttcaatcaacaatgcttctccagtgagaagttcttggattgtctcaagactaacttccgaaagtactgcaagaagactgatgtgatcaatgtttcgatctttgttaagatcaccgacgatctggaagctcatcaggatccttccaccctgaccgagcaagaagagcaaagagtgtgctatgcgcagaacgccgtcgtcgacatgaagacgatcctcgagaaggagttccgtgtaaatcgagtcaataccgtgctctgcctcaacgatcgacccctaccgcaactgacgatctttgagcaggtccgacttgagaaggatcggctgccagcgaattcctatccagtgttgtcgaagctctcgacggttcgtgtctctcagcatgatgatccgacaagcaactttgccaagctcttcgtccgccagcagctgatcattccggggaacaatgccgaggaggttcagaagaaaatctcgcaggcggtgtacctggcgctggacaatgcatgtacggctgctcaggtggcgatggcgaagaagacgaaggccaacaagacattcacatccaaccacgtgttcgtctttatctcgtgcccaggactccccgagaaagtgatcggatcccaggagcagttggaattcatgaagaagtgcatcaccgacgaggtcgacagccacaaggcgatccttgccaagcatcagatcaacgaggtcgaggtggtctacgagtctgtggatggtcacaagagaattgtgatccgcgatgagaccggtgtcactacggaggtgatcaccgagttcagtgaagcgtcgctcggagtctacccagtcatcaatactatcgagaagaagcgtctcgctgctcgccgagtcaactcatcctacatctacgacttcccaattatcttcggaatggctgctatgaacttctggaaatcggcgagctctgccatggagctccccaacgaaatggctcaagctttgaaggagcaacgctggcgcgagttcttccaaattcgagagctcgtcttggagaatggagttttgactgagatctccgatgctgagattctcaagaaacgatctgccaacgctctgaacaactgtggaatggtcgcctggatcatgacactgtacactccagaaaagccacgtggtttcgacttgatcgtcatcggaaacgacgtgaccttccaatccggatccttcggaaccgccgaggatgatctcttcgccgccgcctccacctactcccgtgagcacaagttgccacgtgtcaacgtctcagtgaactctggagcacgcatcggactttccacgaagatctcgaaacttgtgaagcttcaactggagaatgaggataagccggaacaaggattcgagtacatttacattgatggagagcacaaggcacagattgagggagaagttgtgtatgaggagttgggcaatggaagactgaagatccttgccgtcatcggagcaaagaacgagaagatcggagtggagaacctccaaggatccggcctgattgctggagaaacagcgagagcctacgctgaagtgccgacctactgctacgtgacaggaagatccgttggaatcggagcctacacggctcgtctggctcatcgaatcgttcagcacaagcagtctcacttgatccttaccggatatgaagctctgaatactctactcggaaagaaggtctacacatcgaacaatcaactcggaggacctgaagtgatgttccgaaatggagtgactcacgccgtcgttgacaatgatctggagggaatcgccaaggtgatccgatggatgtcattcctgccgacacccacagaagagttcccgttcttctcgaagcacggagatgattgttcggctcgtgacgttgtgatcccatcggattcggaacagaacacctacgacgtcagagatcttattgattccaagaacctctctaaccagactggaatctgcgacacgatgtcgttcgatgagatctgcggtgactgggccaagtcgatcgttgcaggccgagcccgtctctgcggaatcccgatcggagttgtttcttcggaattccgaaacttctccaccatcgtcccagctgatcctgctattgatggatctcaagtacagaatacacagcgtgcggggcaggtgtggtacccggattctgcgttcaagactgctgaggctatcaatgatctgaacaaggagaaccttccactgatgatcatcgcctcgctgcgtggattctcaggaggacagaaggatatgtacgacatggtgctgaagttcggagcacagatcgtcgatgctctagctgtctacaatcgtccagtcatcgtctacatcccggaagccggagagcttcgtggtggagcctgggctgtgctggactcgaagatccgtccggagttcatccacctagtggccgatgagaaatctcgtggaggaatcctcgaaccgaatgcagtcgtcggaatcaagttccgcaagccaatgatgatggagatgatgaagcgatccgatccgacttactcgaagctttccagttccaccgagccagaagctcgtgagcagttagaggagagatatgaggagttgagcaagacctacaggaatgcgtcggtcgagtttgcggatgctcacgatcgttggcagaggatgaagagcgtcggagtggtggagcatgtcacatcgctgacgaactctcggcgactcttctcggagttgctcaggaatgagctcgccaaagttggaatggcagagatctactcgtcagctcctcacacagtgaagccgtgcctcgcaacagcgatgacatgggttgaaacgaatctccgatcatatgtgcaaccgaacagctcaatggacgagcaatacacacaaattgagcagtattacgagacgcagtttgtcgatgatcttgtcattgcgattaatgaggatcggaaacgatatgaacagcagctcaacacgtttatgaacaaaatttcttcgaagcgacgataa

SEQ ID NO: 4729 - protein, 2054 aa, Caenorhabditis elegans
MVVNGQKPDIRTIVVSGNSLTNDAADQYESMEQFIHSHVADIEKRRPIKRLLVATNGIAAMRCLMTAKKFLHHTFRNDNLIHFVCMTTEDEIQSMSESLRMPNITLAESPSGTNKNNFANVDEILKHAIKYEVDAVWAGWGHASENPDLPRRLNDHNIAFIGPPASAMFSLGDKIASTIIAQTVGVPTVAWSGSGITMESIERSRGDFVVVPEDLLEQACVANYKEGLEALKTHNIGFPLMIKASEGGGGKGIRKCTKVEDFKSMFEEVAQEVQGSPIFLMKCVDGARHIEVQLLADRYENVISVYTRDCSIQRRCQKIIEEAPAIIASSHIRKSMQEDAVRLAKYVGYESAGTVEYLYLPASEGQEEHYYFLELNPRLQVEHPTTEMVSNISIPAIQLQIAMGLPLHKIKDIRKLYDLPIDGDSELPDEVLVDTKLHAIAARITCENPDDSFRPSTGKVYEINFPSSQDAWAYFSVGRGSSVHQFADSQFGHIFTRGTSRTEAMNTMCSTLKHMTIRSSFPTQVNYLVDLMHDADFINNAFNTQWLDKRIAMKIKQKCSLSMSVIIAVSAAVIGSSRVTGVFESFEESIDRGQVRPPNDLTETFIFDLVKDLNIYSLKVVRSAENTFVIILNGSKVTVGVKELQNGEFMVTHCEIVYRCAFEETKEAYKVTVNNEIITFEKDNDVSVLKSPYTGKLLQWKKEDGDWLNVGDVYATAESMKMVFQVEVAKAPGRLQRVVNEGDPIHPGSVLAKLVDQTESEADRAQPFHGTFLEWSWHSSKANEQSKFNDCLAQCQNLLAGSTPMDSACIITELFHHLNESHTAHASEVLNQLLRDYINVEKYFEGKVYDDSVGEIKEDHLSRKDVVRTIYSHTQIKSKNIVMKALLGALKQGSGSKFIPSLLDNLRQIGNLHHTEEISNLAREILLFYHSMCYKNNYSEITASGLRPTGQEVKAWLDGPLSRRPDSSGWKVIHEYFFDETIGSQCLDRYVAMHISAEEGSIGNTYPLPQMKCTIDHFTLTATPKSFNKVVLKGNKLIVVRLSLDSKTFNQQCFSSEKFLDCLKTNFRKYCKKTDVINVSIFVKITDDLEAHQDPSTLTEQEEQRVCYAQNAVVDMKTILEKEFRVNRVNTVLCLNDRPLPQLTIFEQVRLEKDRLPANSYPVLSKLSTVRVSQHDDPTSNFAKLFVRQQLIIPGNNAEEVQKKISQAVYLALDNACTAAQVAMAKKTKANKTFTSNHVFVFISCPGLPEKVIGSQEQLEFMKKCITDEVDSHKAILAKHQINEVEVVYESVDGHKRIVIRDETGVTTEVITEFSEASLGVYPVINTIEKKRLAARRVNSSYIYDFPIIFGMAAMNFWKSASSAMELPNEMAQALKEQRWREFFQIRELVLENGVLTEISDAEILKKRSANALNNCGMVAWIMTLYTPEKPRGFDLIVIGNDVTFQSGSFGTAEDDLFAAASTYSREHKLPRVNVSVNSGARIGLSTKISKLVKLQLENEDKPEQGFEYIYIDGEHKAQIEGEVVYEELGNGRLKILAVIGAKNEKIGVENLQGSGLIAGETARAYAEVPTYCYVTGRSVGIGAYTARLAHRIVQHKQSHLILTGYEALNTLLGKKVYTSNNQLGGPEVMFRNGVTHAVVDNDLEGIAKVIRWMSFLPTPTEEFPFFSKHGDDCSARDVVIPSDSEQNTYDVRDLIDSKNLSNQTGICDTMSFDEICGDWAKSIVAGRARLCGIPIGVVSSEFRNFSTIVPADPAIDGSQVQNTQRAGQVWYPDSAFKTAEAINDLNKENLPLMIIASLRGFSGGQKDMYDMVLKFGAQIVDALAVYNRPVIVYIPEAGELRGGAWAVLDSKIRPEFIHLVADEKSRGGILEPNAVVGIKFRKPMMMEMMKRSDPTYSKLSSSTEPEAREQLEERYEELSKTYRNASVEFADAHDRWQRMKSVGVVEHVTSLTNSRRLFSELLRNELAKVGMAEIYSSAPHTVKPCLATAMTWVETNLRSYVQPNSSMDEQYTQIEQYYETQFVDDLVIAINEDRKRYEQQLNTFMNKISSKRR

SEQ ID NO: 4730 - DNA, 6843 bp, Schizosaccharomyces pombe
  CDS (1)..(6843)
atgcgccagagcgttacctcttcctcttcctgtagcaagctctacgcgataaaagcaaccatttcccttccacgactcttttaccgtagactgagaactatggctcctcgtgtagcctcccattttctgggaggcaattccttagataaagcacctgcaggaaaggtgaaagattatattgcatcacacggaggacacactgttatcacgtctattcttattgctaataatggtattgcggccgtgaaagaaatccgaagcattcggaaatgggcttatgaaaccttcaataatgaaagagctatcaagtttactgttatggcaacgccagatgatttaaaagttaatgccgattatattcgtatggccgatcagtatgtcgaagtacctggcggctcaaataacaataattatgctaatgtcgaacttatcgttgacattgctgaacgtatgaacgtccatgctgtttgggctggttggggacacgcatctgaaaaccctaaattgcctgagatgctttctgccagtagtaagaaaatcgtttttattggtcctccaggtagcgcaatgcgtagtcttggtgacaaaattagttctacaatcgttgctcaaagtgctcgtgtaccttgtatgtcttggtccggtaatgaactcgaccaagtacgtattgatgaagagacaaacattgttactgttgacgatgatgtttatcaaaaagcctgtattcgctctgcagaagaaggtattgccgtcgccgagaagattggttatcccgtcatgattaaggcctctgaaggcggtggtggtaaaggtattcgtcaggttacttcaaccgaaaagtttgctcaagcattccaacaagtacttgatgaactccctggatctcccgtttttgttatgaaacttgctggacaagcacgccatttggaagttcaaattttagctgatcaatatggtaataatatttctctttttggtcgtgattgttccgttcaacgccgtcatcaaaaaattattgaggaggctcctgttaccatcgcacctgccgctaccttccatgaaatggagcgtgccgccgtgcgtttaggtgaattggtcggttacgcttctgctggtaccattgagtatctttatgagccagagaatgacaggttctatttccttgaactgaaccctcgtttacaggtcgagcatccaactaccgaaatggtttctggcgttaatttacccgctgcacaacttcaagttgctatgggtttgcctcttagtcgtattccacacattcgtgagctctatggcttaccacgtgatggtgactctgaaatcgattttttctttcaaaatcccgaatcttttaaagtacagaaggtccctactcctaaaggccattgtgttgcctgtcgtattacgtctgaagatcccggcgaaggatttaaaccatcgagcggtatgattaaagatctcaactttcgttcttctagcaatgtgtggggttatttctctgttggtactgctggtggaattcatgagtttgcggattcccaattcggtcatattttttcatttgcagaatctcgtgaatcctctcgcaaatcgatggtggttgcgttaaaagaattatctattcgtggtgattttagaactactgtcgaatatctcgtgcgtctccttgaaactaaggagttttctgaaaatgagtttaccacaggatggctagatcggcttattgcacaaaaagttacatctgctcgtcccgacaagatgcttgctgttgtatgtggtgctcttgtccgtgctcatgctactgccgatactcagtaccgtgctttcaaatcctaccttgaacgcggtcaagtaccgtcccgtgaatttttgaaaaatgtgtatgatattgaatttatttatgataacactcgctatcgttttaccgcatctcgttcttctccaggctcttatcatttgtttttaaatggttctcgttgtactgctggtgtccgttctttgactgatggtggattgttagttttgctaaacggacattcctatacagtatactatcgtgatgaggtaactggtactcgtatatctatcgataacctttcttgtatgctggaacaagaaaatgatcctactcaattaagaactccttcccctggcaagttggttcgtttcttggttgaaacaggtgagcatattaaagccggtgaagcgtatgcagaggtagaagttatgaaaatgattatgcctttagtagcaaccgaagatggtgttgttcaattgataaagcaacccggtgcatctttagacgccggtgatattcttggaatactcacgcttgatgatcctagccgtgtcacccatgcattaccatttgatggtcagcttcctaattggggtgagcctcaaattgcgggaaataagccttgtcaacgctatcatgctcttttgtgtattcttttggacattctaaagggatatgataaccaaatcattctcaacagtacctacaatgaatttgttgaagtccttcgtaatcatgaattgccctatagcgaatggagtgctcattattcagcattggttaatagaatctctcctgtacttgataagctttttgtatctataatcgaaaaagccagatctcgtaaagctgaatttcctgccaaacagcttgaggttgctattcagacttattgtgatggtcaaaatttggcgacgactcaacaattaaaggtccaaattgcacctctccttaaaatcatatctgactacaaagacggcctcaaagttcatgaatacaatgttattaaaggtttgctcgaagaatattataatgttgaaaagttgttctctggaattaataagcgagaagaagatgttattcttcgtctacgtgacgaaaataaagatgatgttgataaagttattgcgttggctttatctcattctcgtataggatctaagaataacttgttaattacaattcttgatctaatgaagtccgaaccatcaacttttgtttctctgtactttaatgacattttgaggaagcttacagatttggattcaagggttacttctaaagtgtctctaaaggctcgtgagttgttaattacatgtgctatgccttctcttaatgagcgattctctcaaatggagcacatattgaaatcgtctgtagttgaaagtcattatggtgatgctaaattctcacaccgtacaccatctttagacattctgaaagaattgattgattctaaatatacagtctttgatgttttacctgctttcttttgtcacaccgacccatgggtatctttagctgctcttgaggtatatgttagacgtgcttatcgtgcctactctgttcttgaaatcaactatcataccgaggccggaactccgtatgtactcacgtggcgttttcagcttcattcaagtggtgctccgggtttgggtgccaactcaactaatggttccaatttccctgcaagcactactccttcatacgaaaacagcaatcgacgcctgcagtctgttagtgatctttcttggtatgtcaataaaacagactctgagccattccgttttggtacaatgattgccgcagaaactttcgatgaattggaaaataaccttgcccttgcaatcgaccgtttaccactttctcgtaattactttaatgctggtttaacgttggatggcaattcttcttcagctaacgataacactcaagaattaactaatgtagtgaacgttgcgttaacctcaactggtgatttggatgattctgctattgttagcaagcttaaccaaatccttagtgatttccgtgatgatttgcttgagcataatgttagaagagtgacaattgttggtggcagaattaacaagtctgcttatccttcctactatacttatcgtgtttccgctgaacaaaaagacggcaatcttgtacactataacgaagatgagcgtattcgtcatattgaacctgcattggcattccaattagaattgggtcgtctatcgaacttcaatattgaacccgttttcaccgataatcataacattcatgtttatcgtgctaccgccaaaaatatggatacagataagcgattctttactcgtgcattagttagaccaggaagattacgtgacgagatacctactgctgagtatcttatatccgaaacccatcgtttaattaatgatattttggatgctttggaagttatcggtcatgaacaaacagacttgaatcatattttcattaactttacaccagcctttggtcttgctcctaagcaagttgaagctgccctcggcggatttttggaacgttttggccgtcgtttatggcgcttgagagtaactgcagctgaaattcgtattatttgcacggacccatcaactaacactttgtttcctcttcgtgtcattatttctaatgtttctggatttgttgtgaacgttgaaatttatgctgaagtcaagactgagaataattcttggatatttaagagtatcggacaacctggatccatgcatcttcgccccatcagtacaccttatcctaccaaagaatggcttcaacctcgtcgttacaaagctcaattaatgggcactactttcgtttatgacttcccagaattattccgtcgcgccttcaccgatagctggaaaaaggttccaaatgggcgatccaaagttactataccccagaatatgtttgaatgtaaggagcttgttgctgacgaacatggtgtattacaggaagtcaatagggagcctggaactaactcctgtggtatggtagcatggtgcattactgttaagacgcctgaatatcctaatggacgaaaaattatcgtagtggctaacgacatcactttccaaattggttcttttgggccccaagaggatgaatacttttataaagttactcaattggcacgtcaacgcggtattcctcgtatttacctcgctgccaattccggtgcacgtattggagttgctgatgaaatcgtccctcttttcaatattgcttgggtcgatcccgatagtccagaaaagggttttgattatatctatcttactccagaggcatatgagcgtcttcagaaagaaaatcccaatattctcaccactgaggaggttgttactgaaactggggaacttcgccataagattaccacaatcattggctcaagcgagggtcttggtgttgaatgtttgcgtggatccggtctgattgctggtgtcacatctcgcgcatacaatgacatttttacatgtactttggtcacttgtcgtgctgttggtattggcgcgtacttggttcgtctcggccaaagagctgtacaaatcgaaggccaaccaattattctaacaggtgcacccgcccttaacaaggttttaggccgtgaggtctatacctccaacttgcaattaggtggtactcaagttatgcatagaaatggtatatcccatcttactagtcaagatgattttgatggcatttcgaaaattgtaaactggatttcctatatccccgataaacgtaacaatccagtaccaatttcaccatcatcagatacatgggatcgtgatgtggagttctatccttctcaaaatggttacgatcctcgttggttaattgccggaaaggaagatgaagattctttcttgtatggtttatttgacaaaggatctttccaggaaactttgaatggctgggccaagactgttgttgttggtcgtgctagaatgggcggaattcctactggtgtgattgctgtcgagactcgtactattgaaaacactgtaccggctgatccagctaaccctgactctactgaacaagtattaatggaggctggtcaagtttggtatcccaactcagccttcaagactgctcaagcaatcaatgacttcaaccatggtgaacagttacctctttttattcttgctaattggcgtggattttctggtggtcaacgtgatatgtttaatgaggtactcaaatatggttcttatatcgtagatgctttggcttcttataaacaacctgtatttgtatacattcctccattcagtgaacttagaggtggctcttgggttgtagtagatccaaccatcaatgaggatcaaatggaaatgtacgcagatgaagagagtagagctggtgttttggaacctgaaggtatggtcagtattaaattcagacgtgaaaagttgctttctttgatgcgacgctgtgatcataaatatgcatcattgtgcaatgagcttaaaagagatgatttgagtgctgatgacctttcaactataaaggtcaagttgatggaacgcgaacagaagcttatgccaatttatcaacaaattagtattcattttgccgacttgcatgatcgtgttggtcgtatggttgcaaagaaggttgtccgtaaaccgttgaaatggacagaagctagacgtttcttttactggcgtctccgcagacgtttgaatgaacattatgctcttcaaaagattacccagctcattccttccttgactatccgtgaatctcgtgagtatctccagaaatggtatgaagagtggtgtggaaagcaagattgggatgaatctgataagtctgttgtttgttggattgaggaacataacgacgatttgagtaagagaactcaggaacttaagagtacttattacagtgagcgtctttctaaactccttcgttcagataggaagggaatgatagacagccttgcacaagttttgaccgagctcgacgaaaatgaaaagaaagaattggccggaaaactcgcgtcggttaattaa

SEQ ID NO: 4731 - protein, 2280 aa, Schizosaccharomyces pombe
MRQSVTSSSSCSKLYAIKATISLPRLFYRRLRTMAPRVASHFLGGNSLDKAPAGKVKDYIASHGGHTVITSILIANNGIAAVKEIRSIRKWAYETFNNERAIKFTVMATPDDLKVNADYIRMADQYVEVPGGSNNNNYANVELIVDIAERMNVHAVWAGWGHASENPKLPEMLSASSKKIVFIGPPGSAMRSLGDKISSTIVAQSARVPCMSWSGNELDQVRIDEETNIVTVDDDVYQKACIRSAEEGIAVAEKIGYPVMIKASEGGGGKGIRQVTSTEKFAQAFQQVLDELPGSPVFVMKLAGQARHLEVQILADQYGNNISLFGRDCSVQRRHQKIIEEAPVTIAPAATFHEMERAAVRLGELVGYASAGTIEYLYEPENDRFYFLELNPRLQVEHPTTEMVSGVNLPAAQLQVAMGLPLSRIPHIRELYGLPRDGDSEIDFFFQNPESFKVQKVPTPKGHCVACRITSEDPGEGFKPSSGMIKDLNFRSSSNVWGYFSVGTAGGIHEFADSQFGHIFSFAESRESSRKSMVVALKELSIRGDFRTTVEYLVRLLETKEFSENEFTTGWLDRLIAQKVTSARPDKMLAVVCGALVRAHATADTQYRAFKSYLERGQVPSREFLKNVYDIEFIYDNTRYRFTASRSSPGSYHLFLNGSRCTAGVRSLTDGGLLVLLNGHSYTVYYRDEVTGTRISIDNLSCMLEQENDPTQLRTPSPGKLVRFLVETGEHIKAGEAYAEVEVMKMIMPLVATEDGVVQLIKQPGASLDAGDILGILTLDDPSRVTHALPFDGQLPNWGEPQIAGNKPCQRYHALLCILLDILKGYDNQIILNSTYNEFVEVLRNHELPYSEWSAHYSALVNRISPVLDKLFVSIIEKARSRKAEFPAKQLEVAIQTYCDGQNLATTQQLKVQIAPLLKIISDYKDGLKVHEYNVIKGLLEEYYNVEKLFSGINKREEDVILRLRDENKDDVDKVIALALSHSRIGSKNNLLITILDLMKSEPSTFVSLYFNDILRKLTDLDSRVTSKVSLKARELLITCAMPSLNERFSQMEHILKSSVVESHYGDAKFSHRTPSLDILKELIDSKYTVFDVLPAFFCHTDPWVSLAALEVYVRRAYRAYSVLEINYHTEAGTPYVLTWRFQLHSSGAPGLGANSTNGSNFPASTTPSYENSNRRLQSVSDLSWYVNKTDSEPFRFGTMIAAETFDELENNLALAIDRLPLSRNYFNAGLTLDGNSSSANDNTQELTNVVNVALTSTGDLDDSAIVSKLNQILSDFRDDLLEHNVRRVTIVGGRINKSAYPSYYTYRVSAEQKDGNLVHYNEDERIRHIEPALAFQLELGRLSNFNIEPVFTDNHNIHVYRATAKNMDTDKRFFTRALVRPGRLRDEIPTAEYLISETHRLINDILDALEVIGHEQTDLNHIFINFTPAFGLAPKQVEAALGGFLERFGRRLWRLRVTAAEIRIICTDPSTNTLFPLRVIISNVSGFVVNVEIYAEVKTENNSWIFKSIGQPGSMHLRPISTPYPTKEWLQPRRYKAQLMGTTFVYDFPELFRRAFTDSWKKVPNGRSKVTIPQNMFECKELVADEHGVLQEVNREPGTNSCGMVAWCITVKTPEYPNGRKIIVVANDITFQIGSFGPQEDEYFYKVTQLARQRGIPRIYLAANSGARIGVADEIVPLFNIAWVDPDSPEKGFDYIYLTPEAYERLQKENPNILTTEEVVTETGELRHKITTIIGSSEGLGVECLRGSGLIAGVTSRAYNDIFTCTLVTCRAVGIGAYLVRLGQRAVQIEGQPIILTGAPALNKVLGREVYTSNLQLGGTQVMHRNGISHLTSQDDFDGISKIVNWISYIPDKRNNPVPISPSSDTWDRDVEFYPSQNGYDPRWLIAGKEDEDSFLYGLFDKGSFQETLNGWAKTVVVGRARMGGIPTGVIAVETRTIENTVPADPANPDSTEQVLMEAGQVWYPNSAFKTAQAINDFNHGEQLPLFILANWRGFSGGQRDMFNEVLKYGSYIVDALASYKQPVFVYIPPFSELRGGSWVVVDPTINEDQMEMYADEESRAGVLEPEGMVSIKFRREKLLSLMRRCDHKYASLCNELKRDDLSADDLSTIKVKLMEREQKLMPIYQQISIHFADLHDRVGRMVAKKVVRKPLKWTEARRFFYWRLRRRLNEHYALQKITQLIPSLTIRESREYLQKWYEEWCGKQDWDESDKSVVCWIEEHNDDLSKRTQELKSTYYSERLSKLLRSDRKGMIDSLAQVLTELDENEKKELAGKLASVN

SEQ ID NO: 4732 - DNA, 1773 bp, Streptomyces coelicolor
  CDS (1)..(1773)
atgcgcaaggtgctcatcgccaatcgtggcgaaatcgctgtccgcgtggcccgggcctgccgggacgccgggatcgcgagcgtggccgtctacgcggatccggaccgggacgcgttgcacgtccgtgccgctgatgaggcgttcgccctgggtggtgacacccccgcgaccagctatctggacatcgccaaggtcctcaaagccgcgcgcgagtcgggcgcggacgccatccaccccggctacggattcctctcggagaacgccgagttcgcgcaggcggtcctggacgccggcctgatctggatcggcccgcccccgcacgccatccgcgaccgtggcgaaaaggtcgccgcccgccacatcgcccagcgggccggcgcccccctggtcgccggcacccccgaccccgtctccggcgcggacgaggtcgtcgccttcgccaaggagcacggcctgcccatcgccatcaaggccgccttcggcggcggcgggcgcggcctcaaggtcgcccgcaccctcgaagaggtgccggagctgtacgactccgccgtccgcgaggccgtggccgccttcggccgcggggagtgcttcgtcgagcgctacctcgacaagccccgccacgtggagacccagtgcctggccgacacccacggcaacgtggtcgtcgtctccacccgcgactgctccctccagcgccgccaccaaaagctcgtcgaggaggcccccgcgccctttctctccgaggcccagacggagcagctgtactcatcctccaaggccatcctgaaggaggccggctacggcggcgccggcaccgtggagttcctcgtcggcatggacggcacgatcttcttcctggaggtcaacacccgcctccaggtcgagcacccggtcaccgaggaagtcgccggcatcgacttggtccgcgagatgttccgcatcgccgacggcgaggaactcggttacgacgaccccgccctgcgcggccactccttcgagttccgcatcaacggcgaggaccccggccgcggcttcctgcccgcccccggcaccgtcaccctcttcgacgcgcccaccggccccggcgtccgcctggacgccggcgtcgagtccggctccgtcatcggccccgcctgggactccctcctcgccaaactgatcgtcaccggccgcacccgcgccgaggcactccagcgcgcggcccgcgccctggacgagttcaccgtcgagggcatggccaccgccatccccttccaccgcacggtcgtccgcgacccggccttcgcccccgaactcaccggctccacggaccccttcaccgtccacacccggtggatcgagacggagttcgtcaacgagatcaagcccttcaccacgcccgccgacaccgagacggacgaggagtcgggccgggagacggtcgtcgtcgaggtcggcggcaagcgcctggaagtctccctcccctccagcctgggcatgtccctggcccgcaccggcctggccgccggggcccgccccaagcgccgcgcggccaagaagtccggccccgccgcctcgggcgacaccctcgcctccccgatgcagggcacgatcgtcaagatcgccgtcgaggaaggccaggaagtccaggaaggcgacctcatcgtcgtactcgaggcgatgaagatggaacagcccctcaacgcccacaggtccggcaccatcaagggcctcaccgccgaggtcggcgcctccctcacctccggcgccgccatctgcgagatcaaggactga

SEQ ID NO: 4733 - protein, 590 aa, Streptomyces coelicolor
MRKVLIANRGEIAVRVARACRDAGIASVAVYADPDRDALHVRAADEAFALGGDTPATSYLDIAKVLKAARESGADAIHPGYGFLSENAEFAQAVLDAGLIWIGPPPHAIRDRGEKVAARHIAQRAGAPLVAGTPDPVSGADEVVAFAKEHGLPIAIKAAFGGGGRGLKVARTLEEVPELYDSAVREAVAAFGRGECFVERYLDKPRHVETQCLADTHGNVVVVSTRDCSLQRRHQKLVEEAPAPFLSEAQTEQLYSSSKAILKEAGYGGAGTVEFLVGMDGTIFFLEVNTRLQVEHPVTEEVAGIDLVREMFRIADGEELGYDDPALRGHSFEFRINGEDPGRGFLPAPGTVTLFDAPTGPGVRLDAGVESGSVIGPAWDSLLAKLIVTGRTRAEALQRAARALDEFTVEGMATAIPFHRTVVRDPAFAPELTGSTDPFTVHTRWIETEFVNEIKPFTTPADTETDEESGRETVVVEVGGKRLEVSLPSSLGMSLARTGLAAGARPKRRAAKKSGPAASGDTLASPMQGTIVKIAVEEGQEVQEGDLIVVLEAMKMEQPLNAHRSGTIKGLTAEVGASLTSGAAICEIKD

SEQ ID NO: 4734 - DNA, 1773 bp, Streptomyces coelicolor
  CDS (1)..(1773)
atgcgcaaggtgctcatcgccaatcgtggcgaaatcgctgtccgcgtggcccgggcctgccgggacgccgggatagcgagcgtggccgtctacgcggatccggaccgggacgcgttgcacgtccgtgccgctgatgaggcgttcgccctgggtggtgacacccccgcgaccagctatctggacatcgccaaggtcctcaaagccgcgcgcgagtcgggcgcggacgccatccaccccggctacggtttcctctcggagaacgccgacttcgcgcaggcggtcctggacgccggcctgatctggatcggcccgcccccgcacgccatccgcgaccgtggcgaaaaggtcgccgcccgccacatcgcccagcgggccggcgcccccctggtcgccggcacccccgaccccgtctccggcgcggacgaggtcgtcgccttcgccaaggagcacggcctgcccatcgccatcaaggccgccttcggcggcggcgggcgcggcctcaaggtcgcccgcaccctcgaagaggtgccggagctgtacgactccgccgtccgcgaggccgtggccgccttcggccgcggggagtgcttcgtcgagcgctacctcgacaagccccgccacgtggagacccagtgcctggccgacacccacggcaacgtggtcgtcgtctccacccgcgactgctccctccagcgccgccaccaaaagctcgtcgaggaggcccccgcgcccttcctctccgaggcccagacggagcagctgtactcatcctccaaggccatcctgaaggaggccggctacgtcggcgccggcaccgtggagttcctcgtcggcatggacggcacgatctccttcctggaggtcaacacccgcctccaggtcgagcacccggtcaccgaggaagtcgccggcatcgacctggtccgcgagatgttccgcatcgccgacggcgaggaactcggctacgacgaccccgccctgcgcggccactccttcgagttccgcatcaacggcgaccaccccggccgcggcttcctgcccgcccccggcaccgtcaccctcttcgacgcgcccaccggccccggcgtccgcctggacgccggcgtcgagtccggctccgtcatcggccccgcctgggactccctcctcgccaaactgatcgtcaccggccgcacccgcgccgaggcactccagcgcgcggcccgcgccctggacgagttcaccgtcgagggcatggccaccgccatccccttccaccgcacggtcgtccgcgacccggccttcgcccccgaactcaccggctccacggaccccttcaccgtccacacccggtggatcgagacggagttcgtcaacgagatcaagcccttcaccacgcccgccgacaccgagacggacgaggagtcgggccgggagacggtcgtcgtcgaggtcggcggcaagcgcctggaagtctccctcccctccagcctgggcatgtccctggcccgcaccggcctggccgccggggcccgccccaagcgccgcgcggccaagaagtccggccccgccgcctcgggcgacaccctcgcctccccgatgcagggcacgatcgtcaagatcgccgtcgaggagggccaggaagtccaggaaggcgacctcatcgtcgtactcgaggcgatgaagatggaacagcccctcaacgcccacaggtccggcaccatcaagggcctcaccgccgaggtcggcgcctccctcacctccggcgccgccatctgcgagatcaaggactga

SEQ ID NO: 4735 - protein, 590 aa, Streptomyces coelicolor
MRKVLIANRGEIAVRVARACRDAGIASVAVYADPDRDALHVRAADEAFALGGDTPATSYLDIAKVLKAARESGADAIHPGYGFLSENADFAQAVLDAGLIWIGPPPHAIRDRGEKVAARHIAQRAGAPLVAGTPDPVSGADEVVAFAKEHGLPIAIKAAFGGGGRGLKVARTLEEVPELYDSAVREAVAAFGRGECFVERYLDKPRHVETQCLADTHGNVVVVSTRDCSLQRRHQKLVEEAPAPFLSEAQTEQLYSSSKAILKEAGYVGAGTVEFLVGMDGTISFLEVNTRLQVEHPVTEEVAGIDLVREMFRIADGEELGYDDPALRGHSFEFRINGDHPGRGFLPAPGTVTLFDAPTGPGVRLDAGVESGSVIGPAWDSLLAKLIVTGRTRAEALQRAARALDEFTVEGMATAIPFHRTVVRDPAFAPELTGSTDPFTVHTRWIETEFVNEIKPFTTPADTETDEESGRETVVVEVGGKRLEVSLPSSLGMSLARTGLAAGARPKRRAAKKSGPAASGDTLASPMQGTIVKIAVEEGQEVQEGDLIVVLEAMKMEQPLNAHRSGTIKGLTAEVGASLTSGAAICEIKD

SEQ ID NO: 4736 - DNA, 3933 bp, Aedes aegypti (yellow fever mosquito)
  CDS (69)..(3656)
ctttacaaattttacaaaccgcgcacctctacttagcataaggaacagacactaatatcgccatcaccatgtccatgtgcggtgcccaaattgccttaaaagccttcaaaagggctccccgtgtcagaatttggtccatgaccaagaatgcttattctacaaagatagagtacaagccgattcgatccgtgctggttgcgaatcgtggcgaaattgccatccgtgtcttccgagcatgtaacgaactgggcattcggtcggtagcggtatactcggagcaggataaaatgcacatgcaccgtcagaaagcggatgaatcgtacatggtgggcaagggtctcgcaccggtcgaggcttacctaagcattccagagattataagagtttgtaaggagaacgacgtcgacgcggtgcatcccggctacggtttcctatccgagcgatccgactttgcccaagccgtcatcgatgccggtctccgattcatcggtccgtctccgaaggtcgtgcagcagatgggagataaggtggccgctcgcaaggcagccatcgaagccggtgttcccatcgtacccggaactgatggtcccgtaacgaccaaggaagaggctctcgacttctgcaagaaacacggactaccagtgatcttcaaggctgcttacggcggtggtggtcgaggcatgagagtggtacggaaaatggaagaggttgaagataacttccagcgagccagttcggaagctaaagcagccttcggtaacggtgccatgttcatcgaaaagttcatcgaacgaccacgacatattgaggtacagctcctcggagacaaggctggcaatgttgtccatttgtacgaacgtgactgttcggtgcaaagacgtcatcagaaagtcgttgaaattgcccctgctccacggctacctcgagaagtacgtgacaaaatgaccgaatatgccgtcaagctggccaagcatgttggctacgaaaacgccggaacagtagagttcctctgtgatgaatcgggcaatttctacttcatcgaagtgaacgctcgcctccaggtagagcacaccgttacagaagaaattaccggtattgatctcgtacaatcacaaatccgagtagctgaaggcatgacgttgccagagcttggatacaatcaagaaaacatcaaaactcagggctatgccatccagtgccgtgttacgactgaagaccctgccaatgacttccaaccgagtacgggtcgtctggaagtattcagatctggtgaaggtatgggcatccgtctggacagtgcctctgcttacgctggtgccattatctcaccatattacgattcactcctggtcaaagtaatttcacacgcttccgatttgcaatcatccgctgccaaaatgaaccgagcattgcgtgagttccgtattcgcggtgtcaaaacgaacatcccgttcctgctgaacgtgttggaaaaccagaaattcctgaacggtgttctggatacgtacttcattgacgagcatccccagctgttccgctttgccaaatccaagaaccgtgcccagaaactgctgaactaccttggagaagtgctggtcaacggacctaccactcccctggcgacaaagctgaagcctgctgaagttcagccacatgttccacagttgccgttggatttgtcaccagaagcactggcagcagaggaaaagggcaaaaaagtaactgaaccaccaagaggattcaaggatatcttgcgagaacaaggaccggaaggatttgccaaggcagttcgagctcagaaaaatcttctgctgatggataccacttttcgcgatgcccatcagtcgcttttggctacccgtgtccgaacgcatgacttgctgaagatttctccatatgtatcgcacaagttcaacaacctctactcgctggagaattggggcggtgctaccttcgacgttgccctacgtttcttgcatgagtgtccgtgggagcgtctggaagatatgcgcaagcaaattccaaacattccattccaaatgttactccgaggtgccaatgctgttggttataccaactatccagacaacgtcgtccacaagttctgcgagctctcggttcaatgcggcatggacattttccgagtgttcgattctttgaactacctgcccaacctgattctgggaatggaagcagctggtaatgccggaggtgttgttgaagccgcaatctcttacacgggagacgtcagtgatccaaccaagaagaagtatgacctcaaatactacaccaatcttgccgacgaattggtcaaagctggcacacacattctttgcatcaaagatatggctggattacttaaacctcaagctgccaagctgctcatcgctgccatccgtgaaaagcacccagacgttccaattcacattcatactcacgacacatctggagcaggtgttgcatctatgctggcttgcgctgaagccggagctgatgttgtggacgttgctgtggattcgatgtccggaatgacatctcaacccagtatgggcgctgttgttgcctcactgcagggaactccactggataccggcctgaatctgcgtgacatcagtgaatattctgcttattgggagcagaccagaaccttgtacgctccatttgagtgtacgacaaccatgaagtcaggaaacgccgatgtgtacctcaatgaaatccccggaggccagtacaccaatcttcagttccaagcctactctctgggattgggcgacttcttcgaggatgtcaagaaggcctatcgcgaagctaacctgctactgggtgacattattaaggttactccgtcttccaaggttgttggtgatttggctcagttcatggtacaaaaccatcttacggctgaccaggttatggaacgggccgaagaactctccttccccaagtccgtgatcgaattcctgcaaggcgctattggaactcctcatggtggatttcctgaaccattccgttcccgagtacttaaggatatgcctcgtattgagggacgccctggtgcttcgttgaatccattggatttcgacaaacttaaaaaagacctccaagaatctcaccccgatgtctcagaccgcgatgtcatgtctgctgctctgtaccctcaagtaactaacgattacctcaacttcagagactccttcggaccagtagataagctggatacccgcgtattcctgactgggcctaaggtgggcgaagagtttgaagtcactattgaaaagggcaagacgcttggcttcaaaactcttgctatggcagaagatttaacatcgaacggcgaacgagaagtcttctttgaactaaatggtcaactgcggtcggtcatggttcgcgataaggaagccgtcaaggaactccatattcatccaaaggccaccaagggaaacaaggatcaagttggtgccccgatgcctggttccgtcatcgaaatcaaagtaaaagtaggagatcgcgtcgagaagggtcagccgttggtggtgctatcggcgatgaagatggaaatggttgttcaatcaccacgggctggtgtcgtgaaatcgctcgatatctcctccggcatgaaactggaaggcgaagacttgatcctcacattggaatagattctgcgatcttttggatgatttggacagcaaatgaacaatttacaaaagacgtgcggctgctaagttatttgatgtgcggtattgaaacattgaacaggtcttcgttgaacatttagtggtttaatttcaagggggaatgtacatttgggttcgttttgtcgagtaatgttaacgtgttctactgtaagaagcttttttgtttataaatagagatactacgcttatttttgattcatgttttgagttgaaaatacaggtaaatactcaaaatcat

SEQ ID NO: 4737 - protein, 1195 aa, Aedes aegypti (yellow fever mosquito)
MSMCGAQIALKAFKRAPRVRIWSMTKNAYSTKIEYKPIRSVLVANRGEIAIRVFRACNELGIRSVAVYSEQDKMHMHRQKADESYMVGKGLAPVEAYLSIPEIIRVCKENDVDAVHPGYGFLSERSDFAQAVIDAGLRFIGPSPKVVQQMGDKVAARKAAIEAGVPIVPGTDGPVTTKEEALDFCKKHGLPVIFKAAYGGGGRGMRVVRKMEEVEDNFQRASSEAKAAFGNGAMFIEKFIERPRHIEVQLLGDKAGNVVHLYERDCSVQRRHQKVVEIAPAPRLPREVRDKMTEYAVKLAKHVGYENAGTVEFLCDESGNFYFIEVNARLQVEHTVTEEITGIDLVQSQIRVAEGMTLPELGYNQENIKTQGYAIQCRVTTEDPANDFQPSTGRLEVFRSGEGMGIRLDSASAYAGAIISPYYDSLLVKVISHASDLQSSAAKMNRALREFRIRGVKTNIPFLLNVLENQKFLNGVLDTYFIDEHPQLFRFAKSKNRAQKLLNYLGEVLVNGPTTPLATKLKPAEVQPHVPQLPLDLSPEALAAEEKGKKVTEPPRGFKDILREQGPEGFAKAVRAQKNLLLMDTTFRDAHQSLLATRVRTHDLLKISPYVSHKFNNLYSLENWGGATFDVALRFLHECPWERLEDMRKQIPNIPFQMLLRGANAVGYTNYPDNVVHKFCELSVQCGMDIFRVFDSLNYLPNLILGMEAAGNAGGVVEAAISYTGDVSDPTKKKYDLKYYTNLADELVKAGTHILCIKDMAGLLKPQAAKLLIAAIREKHPDVPIHIHTHDTSGAGVASMLACAEAGADVVDVAVDSMSGMTSQPSMGAVVASLQGTPLDTGLNLRDISEYSAYWEQTRTLYAPFECTTTMKSGNADVYLNEIPGGQYTNLQFQAYSLGLGDFFEDVKKAYREANLLLGDIIKVTPSSKVVGDLAQFMVQNHLTADQVMERAEELSFPKSVIEFLQGAIGTPHGGFPEPFRSRVLKDMPRIEGRPGASLNPLDFDKLKKDLQESHPDVSDRDVMSAALYPQVTNDYLNFRDSFGPVDKLDTRVFLTGPKVGEEFEVTIEKGKTLGFKTLAMAEDLTSNGEREVFFELNGQLRSVMVRDKEAVKELHIHPKATKGNKDQVGAPMPGSVIEIKVKVGDRVEKGQPLVVLSAMKMEMVVQSPRAGVVKSLDISSGMKLEGEDLILTLE

SEQ ID NO: 4738 - DNA, 1542 bp, Sulfolobus metallicus
  CDS (1)..(1542)
atgccaccatttggaaaagtacttgtttcaaatagaggagagatagccgtaagcgtaatgaagagaattaaagagatgggaatgaaggcagtagctgtctactctgaggcagataaatatgccctccacgtaaaatatgcggacgaagcctactacataggacctgcaccttctattgagagttatctgaacattgaaaggattatagatgcagcggagaaagcacatgcagacgcagtacatccgggttacggtttcctgtcggagagagcagacttcgctgaggccgtagagaaggcaggtatgactttcattggaccctcatctgaggtaatgaacagggtaaagagtaagctagacggaaaaagaattgcaaaagaagcaggaacgcctattgcccccggatctgacggaccagttggatcgttggatgaggcattgaaacttacagagaaaataggatacccagtaatggtaaaagcagcttatggaggtggaggtatagggataacaagagccgacaatcctgatcagttgatggacatatggggtagaaaccaaaggttagctaaggaagccttcggtaggccagacttgtatatagagaaagctgcggttagaccgagacacatcgagactcagcttattggagataaatacggaacttatgtagttgcatttgaaagggagtgtacaatccagaggagaaatcagaaacttatagaggaggctccgtctccggccctaacttgggaaaagagggaagagttcattgatgcatcagttaagttcggcaagaagattggttacttcgctttaggaactatggaattcgcatactctgacacgaccaaggatctgtacttcctggagcttaacaagagattacaagtagagcatggaattactgagcttgtaactgggatcgatctagtgaaactccaaataaggttagtagcaggagaacatatgcctttcactcaggaggaactaaagaagagactcagaggacacgcaatagaatataggataaacgctgaagatccgttaaacaacttcaccggtagttcaggttttgtaacatattataaggaaccaagcggacctggagtgaggcttgatacagggataatggaaggaagctatgtacctccattctatgattcattggtagctaagctcatggtatacggagagaacagagctagggcaatagaagtaggaaggagagcattgagagacctacagataggaggtataaagaccacaatacctctctacaagctaataatggatgacgaagattaccagaatggaaacttcactaccgcatacatagcggataagagtgagatattcacaaagaagctcagggagaaggaaatgctgaagacagctttagctgcatcagtctacaatagaggattgctgagaggatctagcggaaataacaacgtacaagctcaagataacggcaaacctagatctgcatggaagacatatggagttcaggctcaggcctctgcaagggtgatgtggtaa

SEQ ID NO: 4739 - protein, 513 aa, Sulfolobus metallicus
MPPFGKVLVSNRGEIAVSVMKRIKEMGMKAVAVYSEADKYALHVKYADEAYYIGPAPSIESYLNIERIIDAAEKAHADAVHPGYGFLSERADFAEAVEKAGMTFIGPSSEVMNRVKSKLDGKRIAKEAGTPIAPGSDGPVGSLDEALKLTEKIGYPVMVKAAYGGGGIGITRADNPDQLMDIWGRNQRLAKEAFGRPDLYIEKAAVRPRHIETQLIGDKYGTYVVAFERECTIQRRNQKLIEEAPSPALTWEKREEFIDASVKFGKKIGYFALGTMEFAYSDTTKDLYFLELNKRLQVEHGITELVTGIDLVKLQIRLVAGEHMPFTQEELKKRLRGHAIEYRINAEDPLNNFTGSSGFVTYYKEPSGPGVRLDTGIMEGSYVPPFYDSLVAKLMVYGENRARAIEVGRRALRDLQIGGIKTTIPLYKLIMDDEDYQNGNFTTAYIADKSEIFTKKLREKEMLKTALAASVYNRGLLRGSSGNNNVQAQDNGKPRSAWKTYGVQAQASARVMW

SEQ ID NO: 4740 - DNA, 1335 bp, Bacillus subtilis
  CDS (1)..(1335)
atgtttacaaaagtactgatcgccaatcgcggagaaattgcaatgagaattatccgaacatgcagccgtctcggcatcaaaacggtcgcggtttattctgaagcagacagagacgctccccatacaaaggcggccacggaggcttatttgatcggggaatcaagagtcagtgaaagttatttaaatatagagagaatcatagagacagcgaaaaaagcaaacgccgatgccatccacccgggatacgggttattatcagaaaacagccgattcgctgaacgctgcaagcaagaaaacatcgtgtttatcggccctgcacccgatatcatcgcaaagatggggagcaaaattgaagcacgtaaagcaatggaagcggcaggtgtccctgtagtacccggtgtttccgaatccctcggagacattcaggaagcttgccgcactgcaagtcaaatcggctatcctgtcatgctgaaagcttcagcgggcggaggcggcatcggtatgcagcttgttcaaaacgaggaagcattaagaaaggcgtacgaggggaacaaaaagcgcgcagcagattttttcggtgacgggtcgatgtatatagagaaagttattgaacatgcccgccacatcgaagttcagcttttagccgatcatttcggccatacaatacacctgtttgaacgcgattgctctgttcagaggcggcatcaaaaggtcattgaagaagcgccgtcaccatttttagacgataaactaagaatgaagatcgggcaaacggccgtaaaagcagcgaaagcgatcggctatacaaatgcaggcacgatcgaatttttagttgacccgaatcaaaacttttatttcctcgaaatgaatacgagattgcaagttgaacatcccgtgactgaagaaataacgggcctggacttagttgagcagcagttacggattgctgcgggccatacactcacattctcccagcaagacattaaacgaaacgggcatgcgatagaggtcagaatatacgcagaagatcccaagaccttctatccgtcaccaggtacgatcactgcgttttcactccctgaccaaaaaggggtcagacacgaatgtgcggtcgcaaaagacagcaccgttactcctttttatgacccgatgatcgccaagatgatcgtcaaaggccaaaccagagcggatgcaattgaaaagctggagtcagcgctccgcgactatcggatagagggaatcaaaacaaatcttccgcttctcatacaggctgcggcatcaaaagcatttaaagaaggtaatgtcacgactgactttttgaaacaacacctataa

SEQ ID NO: 4741 - protein, 444 aa, Bacillus subtilis
MFTKVLIANRGEIAMRIIRTCSRLGIKTVAVYSEADRDAPHTKAATEAYLIGESRVSESYLNIERIIETAKKANADAIHPGYGLLSENSRFAERCKQENIVFIGPAPDIIAKMGSKIEARKAMEAAGVPVVPGVSESLGDIQEACRTASQIGYPVMLKASAGGGGIGMQLVQNEEALRKAYEGNKKRAADFFGDGSMYIEKVIEHARHIEVQLLADHFGHTIHLFERDCSVQRRHQKVIEEAPSPFLDDKLRMKIGQTAVKAAKAIGYTNAGTIEFLVDPNQNFYFLEMNTRLQVEHPVTEEITGLDLVEQQLRIAAGHTLTFSQQDIKRNGHAIEVRIYAEDPKTFYPSPGTITAFSLPDQKGVRHECAVAKDSTVTPFYDPMIAKMIVKGQTRADAIEKLESALRDYRIEGIKTNLPLLIQAAASKAFKEGNVTTDFLKQHL

SEQ ID NO: 4742 - DNA, 6822 bp, Brassica napus
  CDS (1)..(6822)
atggagatgagagctttggtttcgtgttctgctgccggaaatggagcttctgatcggtttagactctccaatgtttcaccatggatcacatcagctcgtggtgcaagtggcagtgactccccagccacagtgaagctgggaagcagctctatgatcagagccttcaaaggagtttcgatttacaaaaacaagaccagaagaaatgttttgtctcaaaggaacaaacagtttcgtcctatggcctacttaggaaggaaggacttgagcagccctgatccgacctccttctgcgataatgggactggatccattaatgggaatgatcatagtgctgtaagagtgtctcaagtcgatgagttctgtaaggctcacggtggaaaaaggccaatccatcgcattttggttgctaccaacggaatggcagctgtcaagtttatacgaagtgttagagcatggtcttaccaaacatttggctcggaaaaatccatatcattggtggccatggcgactcctgaagacatgcggatcaatgcggaacatatcagaatcgctgatcagtttatgcaagtcccgggtggaacgaacaataacaattatgctaatgttcatcttattgtagagatggctgaagcaacaggtgtggatgcagtttggcctggttggggtcatgcatctgaaaaccctgagttacctgatgcattaaaggccaaaggagtcatatttcttggtcctacagcagcctcaatgttagcattaggggataagattggttcgtccttgattgcacaagctgctgatgtacctactctgccatggagtggttcccatgttaaaatacctcctggtagcagcttggtaacgatccccgaggagatgtacaggcaagcttgtgtctacactaccgaagaagcggttgctagttgtcaagttgtgggctatccggcaatgatcaaagcatcgtggggtggtggcggtaaaggcattaggaaggttcatgatgatgatgaggttagggctctattcaagcaagttcaaggtgaggtcccaggctcgccgatattcataatgaaggttgcttcacagagtcggcatttagaggtgcagctgctatgtgaccaatatggaaatgtttcagctttgcatagccgtgattgtagcgtccagagaagacaccaaaagatcatcgaggagggtcccatcactgtggctccccgagataccgtgaagaagctggagcaggcagctagaaggttggccaagagtgttaactatgttggagctgctactgttgagtttctctacagcatggacactggggactacttcttcttagagcttaaccctaggttacaggtagagcaccctgtaaccgagcggatcgctgacataaatctaccagctgcccaagttgctgtcggtatgggaatccctctctggcaaatccctgagataagacggttctatggtatagaacaatatgattcgtggaggacaacatctttgctagcctccccttttaattttgataaagctgaatctgtaaggccaaaaggtcattgtgtcgctgtccgggtgacaagcgaggatcctgatgacgggtttaaacccaccagcggtcaagtgcaggagcttagttttaagagcaacccaaatgtgtggggttacttctctgtcaagtctggtggaggcatccacgagttctcagattctcagtttggacatgtttttgcatttggggaatccagagccatggcaatagcaaatatggttcttgcgctgaaagaaattcaaattcgtggagaagttaggactaacgttgactacacgattgaccttctacatgcttttgattaccgggaaaacaaaattcacactggttggttggacagtagaattgctatgcgggtccgagcagagaggcctccatggtacctctctgttgtcagcggggctctctataaagcatcagcgactggtgctgccgtggtctcggattacattgcttatcttgacaaggggcaaattcccccaaagcatatatctcttgtgcattctcaagtgtctctgaatattgaaggaagtaaatatacgattgatgtggtccggagtggatcaggaagctacaagctaagaatgaacaactcagaagtggcagcagaaatacacactctacgtgatggaggtttgttgatgcagttggatggtaaaagccatgttatatatgcacaggaagaaacctcaggcacccgtcttctgattgacggcaaaacttgtttacttcagaatgaacacgacccttcaaaattaatggctgagacaccgtgcaagctacttaggtatctggtttcagatgatagcagcattgatgctgatacaccctatgcagaggttgaggtcatgaagatgtgcatgccgcttctttcacctgcgtcaggagttatccattttaaaatgtgtgaaggacaagtcatgctgcctggtgaacttatagccaatcttgatcttgctgatccttcgactgtaagaaaggccgaacccttccatggagggttcccaagattagggcttccaacggaaatttctgctaaagttcatcagagatgtgctgcaactttagatgctgctcgcatgattcttgccggctatgagcatcaagtagatgaggttgtgcaagactttgtttcttgccttgatagccctgaactcccattccttcagtggcaagagtgctttgcagttctggcgacacggttaccaaaagatctcagaatcatgctagaatcaaagtatatggaatatgagtgtatctccaggaactccttgaccgcagattttcctgccaaacttttaaaaggcattctagaggctcatgtagcatcttgtgatgagactgagagaggtgcccttgcaaggctcattgaaccattgatgagccttgcaaagtgttacgaaggtggtagagaaagtcatgcctgtgttattgttcgttccctctttgaggaatatctatcagtagaagaattattcaacaataacatgctggctgatgttatagaacgtatgcgtcacgaatacaagaaagatcggtccaagattgtggatatagtgctgtcacaccagggcctaaaaagcaaaaacaagctcgttctcggactcatggagcattttgttaatgctaatcctgctatgtacagggataaacttatcagattcttgaaacttaaccatactaactactctgaggtggtgctcaaggcgagtcaattactcaaacagagaaaattaagtgaacttcgttctagcatcctgtcggagttagaaatgtttgcagaggatggggaaaatatggatactcccaagaggaagtgtgccatggaagatcttgtgagcgcacctttagctgttgaagatgctctcgtgggactatttgaccacagcgaccgcacacttcaaagactggttgttgaaacttatattcgtagattgtaccaggatgcagtggcaccaatatggttttattgcttctgggagttcctagacgatcatatggaaagaaaaaacagtgagggctcagatgaccaagagacatctgaaaaagtttttgttgagaagcgtagaaagaaaaaaaaggggtttatggttataatcaaatcgctggagtttctgccgaatataataactgcagcagcactgacagaaacaaaccacatcgactatggtgaatctgccggatctcctctatctggcaatataatgcacattgctgttttagacagtgagaatgaggaggaccaagctcaagaaagagtggagaaaattctcaaagaggaagaagttagttcgagcctgtgttccgcaggtgtgggtgtggtgagctgtataatcgagcgagatgaaggacgaacacctattagacattcgttccattggtcgatggagaaacagtactatgcagaagagccgatgctgcgccatcttgaacctcctctctccatataccttgagttggataagctgagaggatatgaaaatatacaatatacccctacaagagatcgtcaatggcatctgtatactgtcacagataacaagccggtgccagtcaggaggatgttcctgagatctcttgttcgacaagggcaggataaccaacttagccaaacgcttgttagatctttgatggatgcgatggaggaacttgagctgaatgcccataaggaggatggtgcgaaaccagaccacgcacatatgttcctttgcctacttcgtgagcagcacattaatgatcttggtgccttaccccaggttgaagaaactggaatagagatgatcttagaagaaacagtacgagagatacacaagtcagctggagtgagaatgcataggttgggtgtgtgcgagtgggaagtgcggctgcggttggcaagtggcgtttggagggctgtggttacaaacgtgacaggccgtacctgcactgtccatgtaagaagttctccttccttaccattatatttgattggacctttgcatggaaccccgatcaatgatcaatataagccactgggacatcttgtcaggcaacgattagccgcaaggaggagtaacactacttactgctatgatttcccgttggcatttgagacagccttggaagagttgtgggaatcacaacacccgggagttaagaaaccgtttaagaacactctgaccaatgttgaagagcttgtattctctactccagaaggttctcttattccggttaaaagaccaccgggtctcaacgactgcggaatggtggcatggaccctagagatgtcgactcctgagtttccaaagggacggaaaattatcatagtcgccaatgacgttaccttcaaagctgggtcttttggtcctagagaggacgcgtttttcctcgctgtgactgaactcgcttgcgcggagaagcttcccttgatttacttagcagcaaactctggcgcccggctaggggtggctgaagaagtcaaagcctgctttaaagttggatggtcggatgaagtttcccctgagaatggttttcagtatatatacctaagccctgaggatcacgaaaggattggatcatctgtcattgcgcacgaaataaagctgcccagcggggaaacgaggtgggtcattgatacaatcgttggtaaagaagatggtattggcgtagagaatctaacgggaagcggggcaatagcgggtgcttactcgagggggtacagggaaacttttactttaacctttgtcagtggaagaacggttggcattggcgcttaccttgcccgtctgggtatgcggtgcatacagaggttagaccagcctataattttgactggcttttcgacgctgaacaagttacttgggcgtgaggtctacacctctcacatgcaactcggcggccccaaaatcatgggtgcaaatggtgttgttcatctcacagtctcagatgatctggaaggcgtgtcggcgatcctaaactggctgagctacgttcctgctcacgcgggtggtcctcttcctcttcctcttctttcccctttagatccaccggagagaactgtggagtacgtcccagagaactcttgcgacccccgagctgctatagctggggtcaatgacaacgccggtaaatggcttggcggtatctttgataaaaacagctttatggagactctcgaaggctgggcgaggacggttgtgaccggtagagcgaaactagggggagtacctgttggagttgtagcagttgagacgcagaccgtgacgcagattattccagcggatcctggacaggtggactcgcacgaaagagtggttccgcaggcagggcaagtctggttccctggctcagcagccaagacggctcaagcgctcatggatttcaaccgggaagggcttccgttgtttatcctagcgaactggcgagggttttccggcgggcagagagatcttttcgaaggaatactccaggctggttcagctatcgtcgaaaatttgagaacgtatggccagccagtgtttgtgtacatccccaagatgggagagctgcgaggcggagcgtgggtggttgttgatagccagattaattcggattacgttgaaatgtatgctgacgaaacttcacgtgggaatgtgctcgagccggaagggatgatagagatcaaatttagaaagagagagatgttggagtgcatggggaggttggaccagaagctgatcagtctcaaagcaaaactgcgagacgccaaacaaagcgagatggaacttatcaagcaacagattaaagctcgtaagaagcagcttttaccgctttacatccaaatcgccaccaaatttgcggatcttcacgacacgtccatgaggatggcagcgaaaggagtgatcaaaagcgttgtggaatggagcggttcgcgatcattcttctataaaaagctcattaggagaattgcggagagctctctggtgaaaaatgtgatagaagcttcgggagacaacttatcgtataaatctgcaatgggtttgattaaggattggttctgcaagtctgatgttgcaaaggggaaagaagaggcatggacagacgaccaagtgttctttacatggaaggagaatgttggtaactacgaatccgagctcagcgagttgagagcacagaaactgctgaagcaacttgcggagattgggaattcatctgatctgcaggctctgccccagggacttgctaatattctacacaaggtggagcctttgaaaagagaacagctagtggatgctctaagaaaggtgttgagttga

SEQ ID NO: 4743 - protein, 2273 aa, Brassica napus
MEMRALVSCSAAGNGASDRFRLSNVSPWITSARGASGSDSPATVKLGSSSMIRAFKGVSIYKNKTRRNVLSQRNKQFRPMAYLGRKDLSSPDPTSFCDNGTGSINGNDHSAVRVSQVDEFCKAHGGKRPIHRILVATNGMAAVKFIRSVRAWSYQTFGSEKSISLVAMATPEDMRINAEHIRIADQFMQVPGGTNNNNYANVHLIVEMAEATGVDAVWPGWGHASENPELPDALKAKGVIFLGPTAASMLALGDKIGSSLIAQAADVPTLPWSGSHVKIPPGSSLVTIPEEMYRQACVYTTEEAVASCQVVGYPAMIKASWGGGGKGIRKVHDDDEVRALFKQVQGEVPGSPIFIMKVASQSRHLEVQLLCDQYGNVSALHSRDCSVQRRHQKIIEEGPITVAPRDTVKKLEQAARRLAKSVNYVGAATVEFLYSMDTGDYFFLELNPRLQVEHPVTERIADINLPAAQVAVGMGIPLWQIPEIRRFYGIEQYDSWRTTSLLASPFNFDKAESVRPKGHCVAVRVTSEDPDDGFKPTSGQVQELSFKSNPNVWGYFSVKSGGGIHEFSDSQFGHVFAFGESRAMAIANMVLALKEIQIRGEVRTNVDYTIDLLHAFDYRENKIHTGWLDSRIAMRVRAERPPWYLSVVSGALYKASATGAAVVSDYIAYLDKGQIPPKHISLVHSQVSLNIEGSKYTIDVVRSGSGSYKLRMNNSEVAAEIHTLRDGGLLMQLDGKSHVIYAQEETSGTRLLIDGKTCLLQNEHDPSKLMAETPCKLLRYLVSDDSSIDADTPYAEVEVMKMCMPLLSPASGVIHFKMCEGQVMLPGELIANLDLADPSTVRKAEPFHGGFPRLGLPTEISAKVHQRCAATLDAARMILAGYEHQVDEVVQDFVSCLDSPELPFLQWQECFAVLATRLPKDLRIMLESKYMEYECISRNSLTADFPAKLLKGILEAHVASCDETERGALARLIEPLMSLAKCYEGGRESHACVIVRSLFEEYLSVEELFNNNMLADVIERMRHEYKKDRSKIVDIVLSHQGLKSKNKLVLGLMEHFVNANPAMYRDKLIRFLKLNHTNYSEVVLKASQLLKQRKLSELRSSILSELEMFAEDGENMDTPKRKCAMEDLVSAPLAVEDALVGLFDHSDRTLQRLVVETYIRRLYQDAVAPIWFYCFWEFLDDHMERKNSEGSDDQETSEKVFVEKRRKKKKGFMVIIKSLEFLPNIITAAALTETNHIDYGESAGSPLSGNIMHIAVLDSENEEDQAQERVEKILKEEEVSSSLCSAGVGVVSCIIERDEGRTPIRHSFHWSMEKQYYAEEPMLRHLEPPLSIYLELDKLRGYENIQYTPTRDRQWHLYTVTDNKPVPVRRMFLRSLVRQGQDNQLSQTLVRSLMDAMEELELNAHKEDGAKPDHAHMFLCLLREQHINDLGALPQVEETGIEMILEETVREIHKSAGVRMHRLGVCEWEVRLRLASGVWRAVVTNVTGRTCTVHVRSSPSLPLYLIGPLHGTPINDQYKPLGHLVRQRLAARRSNTTYCYDFPLAFETALEELWESQHPGVKKPFKNTLTNVEELVFSTPEGSLIPVKRPPGLNDCGMVAWTLEMSTPEFPKGRKIIIVANDVTFKAGSFGPREDAFFLAVTELACAEKLPLIYLAANSGARLGVAEEVKACFKVGWSDEVSPENGFQYIYLSPEDHERIGSSVIAHEIKLPSGETRWVIDTIVGKEDGIGVENLTGSGAIAGAYSRGYRETFTLTFVSGRTVGIGAYLARLGMRCIQRLDQPIILTGFSTLNKLLGREVYTSHMQLGGPKIMGANGVVHLTVSDDLEGVSAILNWLSYVPAHAGGPLPLPLLSPLDPPERTVEYVPENSCDPRAAIAGVNDNAGKWLGGIFDKNSFMETLEGWARTVVTGRAKLGGVPVGVVAVETQTVTQIIPADPGQVDSHERVVPQAGQVWFPGSAAKTAQALMDFNREGLPLFILANWRGFSGGQRDLFEGILQAGSAIVENLRTYGQPVFVYIPKMGELRGGAWVVVDSQINSDYVEMYADETSRGNVLEPEGMIEIKFRKREMLECMGRLDQKLISLKAKLRDAKQSEMELIKQQIKARKKQLLPLYIQIATKFADLHDTSMRMAAKGVIKSVVEWSGSRSFFYKKLIRRIAESSLVKNVIEASGDNLSYKSAMGLIKDWFCKSDVAKGKEEAWTDDQVFFTWKENVGNYESELSELRAQKLLKQLAEIGNSSDLQALPQGLANILHKVEPLKREQLVDALRKVLS

SEQ ID NO: 4744 - DNA, 1599 bp, Corynebacterium glutamicum
  CDS (1)..(1599)
atgactgctatcacccttggcggtctcttgttgaaaggaataattactctagtgtcgactcacacatcttcaacgcttccagcattcaaaaagatcttggtagcaaaccgcggcgaaatcgcggtccgtgctttccgtgcagcactcgaaaccggtgcagccacggtagctatttacccccgtgaagatcggggatcattccaccgctcttttgcttctgaagctgtccgcattggtaccgaaggctcaccagtcaaggcgtacctggacatcgatgaaattatcggtgcagctaaaaaagttaaagcagatgccatttacccgggatacggcttcctgtctgaaaatgcccagcttgcccgcgagtgtgcggaaaacggcattacttttattggcccaaccccagaggttcttgatctcaccggtgataagtctcgcgcggtaaccgccgcgaagaaggctggtctgccagttttggcggaatccaccccgagcaaaaacatcgatgagatcgttaaaagcgctgaaggccagacttaccccatctttgtgaaggcagttgccggtggtggcggacgcggtatgcgttttgttgcttcacctgatgagcttcgcaaattagcaacagaagcatctcgtgaagctgaagcggctttcggcgatggcgcggtatatgtcgaacgtgctgtgattaaccctcagcatattgaagtgcagatccttggcgatcacactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgtcttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgactttgaaactgctgttgctcgtgcacagcgcgcgttggctgagttcaccgtgtctggtgttgcaaccaacattggtttcttgcgtgcgttgctgcgggaagaggacttcacttccaagcgcatcgccaccggattcattgccgatcacccgcacctccttcaggctccacctgctgatgatgagcagggacgcatcctggattacttggcagatgtcaccgtgaacaagcctcatggtgtgcgtccaaaggatgttgcagctcctatcgataagctgcctaacatcaaggatctgccactgccacgcggttcccgtgaccgctga

SEQ ID NO: 4745 - protein, 532 aa, Corynebacterium glutamicum
MTAITLGGLLLKGIITLVSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDR

SEQ ID NO: 4746 - DNA, 3728 bp, Corynebacterium glutamicum
  CDS (165)..(3587)
cgcaaccgtgcttgaagtcgtgcaggtcaggggagtgttgcccgaaaacattgagaggaaaacaaaaaccgatgtttgattgggggaatcgggggttacgatactaggacgcagtgactgctatcacccttggcggtctcttgttgaaaggaataattactctaatgtcgactcacacatcttcaacgcttccagcattcaaaaagatcttggtagcaaaccgcggcgaaatcgcggtccgtgctttccgtgcagcactcgaaaccggtgcagccacggtagctatttacccccgtgaagatcggggatcattccaccgctcttttgcttctgaagctgtccgcattggtaccgaaggctcaccagtcaaggcgtacctggacatcgatgaaattatcggtgcagctaaaaaagttaaagcagatgccatttacccgggatacggcttcctgtctgaaaatgcccagcttgcccgcgagtgtgcggaaaacggcattacttttattggcccaaccccagaggttcttgatctcaccggtgataagtctcgcgcggtaaccgccgcgaagaaggctggtctgccagttttggcggaatccaccccgagcaaaaacatcgatgagatcgttaaaagcgctgaaggccagacttaccccatctttgtgaaggcagttgccggtggtggcggacgcggtatgcgttttgttgcttcacctgatgagcttcgcaaattagcaacagaagcatctcgtgaagctgaagcggctttcggcgatggcgcggtatatgtcgaacgtgctgtgattaaccctcagcatattgaagtgcagatccttggcgatcacactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgtcttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgactttgaaactgctgttgctcgtgcacagcgcgcgttggctgagttcaccgtgtctggtgttgcaaccaacattggtttcttgcgtgcgttgctgcgggaagaggacttcacttccaagcgcatcgccaccggattcattgccgatcacccgcacctccttcaggctccacctgctgatgatgagcagggacgcatcctggattacttggcagatgtcaccgtgaacaagcctcatggtgtgcgtccaaaggatgttgcagctcctatcgataagctgcctaacatcaaggatctgccactgccacgcggttcccgtgaccgcctgaagcagcttggcccagccgcgtttgctcgtgatctccgtgagcaggacgcactggcagttactgataccaccttccgcgatgcacaccagtctttgcttgcgacccgagtccgctcattcgcactgaagcctgcggcagaggccgtcgcaaagctgactcctgagcttttgtccgtggaggcctggggcggcgcgacctacgatgtggcgatgcgtttcctctttgaggatccgtgggacaggctcgacgagctgcgcgaggcgatgccgaatgtaaacattcagatgctgcttcgcggccgcaacaccgtgggatacaccccgtacccagactccgtctgccgcgcgtttgttaaggaagctgccagctccggcgtggacatcttccgcatcttcgacgcgcttaacgacgtctcccagatgcgtccagcaatcgacgcagtcctggagaccaacaccgcggtagccgaggtggctatggcttattctggtgatctctctgatccaaatgaaaagctctacaccctggattactacctaaagatggcagaggagatcgtcaagtctggcgctcacatcttggccattaaggatatggctggtctgcttcgcccagctgcggtaaccaagctggtcaccgcactgcgccgtgaattcgatctgccagtgcacgtgcacacccacgacactgcgggtggccagctggcaacctactttgctgcagctcaagctggtgcagatgctgttgacggtgcttccgcaccactgtctggcaccacctcccagccatccctgtctgccattgttgctgcattcgcgcacacccgtcgcgataccggtttgagcctcgaggctgtttctgacctcgagccgtactgggaagcagtgcgcggactgtacctgccatttgagtctggaaccccaggcccaaccggtcgcgtctaccgccacgaaatcccaggcggacagttgtccaacctgcgtgcacaggccaccgcactgggccttgcggatcgtttcgaactcatcgaagacaactacgcagccgttaatgagatgctgggacgcccaaccaaggtcaccccatcctccaaggttgttggcgacctcgcactccacctcgttggtgcgggtgtggatccagcagactttgctgccgatccacaaaagtacgacatcccagactctgtcatcgcgttcctgcgcggcgagcttggtaaccctccaggtggctggccagagccactgcgcacccgcgcactggaaggccgctccgaaggcaaggcacctctgacggaagttcctgaggaagagcaggcgcacctcgacgctgatgattccaaggaacgtcgcaatagcctcaaccgcctgctgttcccgaagccaaccgaagagttcctcgagcaccgtcgccgcttcggcaacacctctgcgctggatgatcgtgaattcttctacggcctggtcgaaggccgcgagactttgatccgcctgccagatgtgcgcaccccactgcttgttcgcctggatgcgatctctgagccagacgataagggtatgcgcaatgttgtggccaacgtcaacggccagatccgcccaatgcgtgtgcgtgaccgctccgttgagtctgtcaccgcaaccgcagaaaaggcagattcctccaacaagggccatgttgctgcaccattcgctggtgttgtcaccgtgactgttgctgaaggtgatgaggtcaaggctggagatgcagtcgcaatcatcgaggctatgaagatggaagcaacaatcactgcttctgttgacggcaaaatcgatcgcgttgtggttcctgctgcaacgaaggtggaaggtggcgacttgatcgtcgtcgtttcctaaacctttctgtaaaaagccccgcgtcttcctcatggaggaggcggggctttttgggccaagatgggagatgggtgagttggatttggtctgattcgacacttttaagggcagagatttgaagatggagaccaaggctcaaag

SEQ ID NO: 4747 - protein, 1140 aa, Corynebacterium glutamicum
MSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDRLKQLGPAAFARDLREQDALAVTDTTFRDAHQSLLATRVRSFALKPAAEAVAKLTPELLSVEAWGGATYDVAMRFLFEDPWDRLDELREAMPNVNIQMLLRGRNTVGYTPYPDSVCRAFVKEAASSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASAPLSGTTSQPSLSAIVAAFAHTRRDTGLSLEAVSDLEPYWEAVRGLYLPFESGTPGPTGRVYRHEIPGGQLSNLRAQATALGLADRFELIEDNYAAVNEMLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIDRVVVPAATKVEGGDLIVVVS

SEQ ID NO: 4748 - DNA, 7371 bp, Rattus norvegicus
  CDS (1)..(7371)
atggtcttgcttctctttctgacttacctggttttctcctgcctgaccatttcctggttaaaaatctgggggaagatgacagactcgaggccgctcagcaacagtaaggtggatgcaagcctccttccgagcaaggaggagtcttttgcctcggaccagtcagaggagcatggcgactgcagctgtccgttgacaactcctgaccaggaggagctggcctcccacggaggtcctgtagatgccagtcagcagaggaactctgtaccaacctcacaccagaagcctccgaggaacccactatcttccaatgacacctgttcctccccagaactccaaaccaacggggtagcagcacctggctcagaggttccagaagccaacgggttgcctttcccagccaggcctcagacccagagaacgggatcccccactagggaggacaagaagcaggcacccatcaagaggcagctgatgaccagctttatcctgggctccctcgatgacaactcctctgacgaggaccctagttctaactcctttcagacctcctctcggaagggcagcagggatagcctgggcacctgttcccaggaggctgcattgaacacagctgatcctgagtctcacacacctactatgaggcccagcatgtctggactccatctggtgaagagaggccgtgaacacaagaaactggacctgcacagagatttcactgtagcttccccagccgaatttgtcacccgctttggaggcaacagggttatcgagacggtgctcatcgccaataatggtatcgctgcggtcaagtggatgcgctccatccgccgctgggcctatgagatgttccgtaatgaacgcgctatccggtttgtggttatggtgacacccgaggatcttaaggccaacgcagagtactacaagatggcggacccagtacttccggtcccaggaggacccaataataacaactacgccaacgttgagctgatcatagacattgccaagagaatccctgtgcaggccgtgtgggctggctggggccacgcttcggaaaaccccaaacttccagagctactgtgcaagcacgggattgcttttctaggtccccgagtgaggccaatgttgggcctgggagacaggctctcctccaccattgtagcccagacattgcagatcccaactctaccctggagcggaagcggtctcacagtggagtggacggaggacagccagcatcagggcaaatgcatcagcgtcacggaagacgtttatgaacaaggctgtgtgagagatgtggacgaaggcttgcaggcagcagaaaaagtaggatttcctctgatgatcaaagcctctgaaggtggaggagggaaaggaatccggcaggctgagagtgcagaggacttcccatgctttttcagacaggtgcagagtgagatcccgggctcgcccatctttctcatgaagctggcccagaatgcccggcacttggaggtccaggtcttggcagatcagtatgggaacgcagtgtccctgtttggacgagactgctccatccagaggcggcaccagaagatcattgaggaggctccggccaacatcgctgctccggctgtgtttgagttcatggaacagtgtgccgtcctcctggccaagactgtggtttatgtgagcgcgggaaccgtggggtacctatacagccaggatggcagctttcacttcttggagctgaacccacgcctgcaggtggaacatccctgcactgaaatgattgcagatgtcaacctgcccgctgcacagttacagatcgccatgggcgtgcccctgcaccggctgaaggacatacggcttctgtacggagagtccccctggggagtgacccccgtttcttttgagacccctttgagccctcccattgcccgaggccatgtcattgcagccaggatcaccagcgaaaacccagacgaggcctttaagccaagctcagggacagtacaggagctgaacttccgcagcaacaagaacgtgtggggttacttcagcgtggccgctgctggaggcttgcacgagtttccgatttcccagtttgggcactgcttctcctggggcgagaaccaggaagaggctatttcgaacatggtggtggctttgaaagaactgtctatccggggtgacttccggaccaccgtggaatatctcgtcaaccttctggagacggagagcttacagaacaatgatatcgacacggggtggctggaccacctcatcgctcagcgggtgcaggcagagaagccggacatcatgctcggggtggtgtttggggccttgaacgtggcagacgcaatgttcagaacctgtattacggaattcctgcattccttggaaaggggtcaggtcctcccggctgattctctgctgaacatcgtggacgttgaattgatttacggaggcatcaaatatgttctcaaggtggcccggcagtccctgaccatgtttgtcctcatcatgaatggttgccacatcgagatcgatgcccaccggccgaacgatgggggcctgctcctgtcctacaatggtagcagttacactacatacatgaaggaagaggtggacagttaccggatcactatcggcaataagacatgcgtgtttgaaaaggaaaacgaccccaccgtcctgagatccccctcggctgggaagctgatgcagtacacggtggaggatggccagcacgtggaagtcgggagcagctatgctgagatggaggtgatgaagatgatcatgaccctgaacgtgcaagagagcggccgggtgaactacatcaagcgaccaggggcggtattggaggctggctgcgtggtggcaaagctagaactcgatgacccttcaaaagtgcacgcggcacagccgttcacaggggagctccccgcccagcagactctgcccatcctcggggagaggctgcatcaggtgttccacagcgtcttggaaaatctgaccaatgtcatgaatggctactgcctgcccgagcccttcttcagcatgaagctgaaggactgggtggagaagcccatgatgactctccggcatccctccctacctctgctggagctgcaggagatcatgaccagcgtggcagaccgcatcccggttccggtggagaaggcagtccgcagggtgtttgcgcaggacgccagcaacatcacttcggtgctctgccagttccccagccagcagatagccaccatcctggactgccacgccgccaccctgcagcgtaaggtggaccgagaggccttcttcatgaacacacagagcatcgtgcagctgatccagagataccgcagtgggacccgtggcatcatgaaggctgtggtgctagacctcctgaggagatatctgaacgtggagcatcatttccagcaagcccactatgacaagtgtgtgatcaacctgagggagcagttcaaggcggacatgactcgggtgctggactgcatcttctcacactcacaagtggccaagaagaaccagctggtgaccatgttgatagatgagctgtgtggcccagaccccaccctgtcagaagagctgacctccatcctcaaggaactcacgcagttgagcaggagtgagcactgcaaggtggccctcagagccaggcaggtcctgattgcctctcacctcccctcctacgagctgcggcacaaccaggtggagtcatcttcctgtcagccattgacatgtaatggccaccagttctgcccggaaaacctcaagaaactaatactttcggaaacgaccatattcgatgtcctgcccactttcttctatcacgctaacaaggtcgtctgtatggcgtccctggaggtttatgtgaggagaggttacatcgcctacgagttaaacagcctacagcaccgggagctccctgacggcacctgcgtggtggagttccagttcatgctgccgtcttcccaccccaaccggatggccatgcccatcaatgtctctgaccctgacctgctgagacacagtaaggaactcttcatggacagtggcttctccccactgtgtcaccagcggatgggggccatggtggccttcaggagatttgaggagttcaccaggaacttcgatgaagtcatctcctgctttgccaacgtgcctacagacactcctctcttcagtaaggcgtgcacttccctctactcagaggaggacagcaagagccttcaagaggagcccatccacatcctgaatgtggccatccagtgcgccgaccacatggaggacgagagactggtgccggttttccgtgcctttgtacagtccaagaaacacatccttgtggattacggactgcgaagaatcacattccttatcgcccaagagaaggaatttcccaagttcttcacgttcagagcgagagatgagtttgcagaagaccggatttaccgccacttggagccgggcctggccttccagctggagctgagccggatgcgcaactttgacttgacggccgtgccctgtgccaaccataagatgcatctttacctgggagccgccaaggtgaaggaagggctggaggtgactgaccacaggttcttcatccgagccatcataaggcactcagacctgatcaccaaggaagcctccttcgagtacctgcagaatgaaggggagcggctgctgctggaagccatggacgagctggaggtggcgttcaacaacaccagcgtgcgcactgactgcaaccacatcttcctcaacttcgtggcccacgtcatcatggacccactcaagatcgaggagtcggtgcgtgccatggtcatgcgttacggcagtcggctgtggaagctccgtgtgctgcaggcacaagttaagatcaacatccgtcagacgacctcggactgcgccgtccccattcgcctcttcatcaccaacgagtccggctactacctggacatcagcctctacaaagaagtgaccgactccagatccggaaacatcatgtttcattccttcggcaacaaacaagggagcctgcacgggatgctgatcaacacgccctacgtcaccaaggatctgctccaagccaagcgattccaggcgcagtccctggggaccacctatgtgtacgacttcccagagatgttcaggcaggctctctttaaattgtggggctccccagagaagtacgggcccgatatcctgacatacacagagctggtgttggactcccagggccagctggtggagatgaaccggcttcctggttgtaacgaggtgggcatggtggttttcaaaatgaggttcaagaccccggagtatccagaaggccgggacactatcgtcatcggcaacgacattaccttccaaatcggctctttcggcataggagaggacttcctgtatctacgggcatcggagatggcccggacagagggcatcccccaaatctatctggcagccaacagcggcgccgtattgggcctgtccgaggagatcaagcagatattccaagtggcatgggtggaccctgaggatccctacaaaggatttagatacctgtacctgtacctgacgccccaagactacacccagatcagctcccagaactccgtgcactgcaaacacatcgaggacgaaggcgagtcaggtattatcgttgatgtcatcgggaaggacagcagcctgggtgtggagaacctgcggggctcgggcatgattgcaggagaggcttctctggcttacgaaaaaaatgtcaccatcagcatggtcgactgccgcgccatcggaatcggggcttacctggtgaggctgggccagcgggtgatccaggtggaaaactcccacatcatcctcacgggagccggtgctctcaacaaggttctgggaagagaggtctacacatccaacaaccaactgggcggtgtgcagatcatgcacaccaacggggtctcccacgtcacggtgccagatgacttcgagggggtctgcaccattctggaatggctgtcatatataccaaaggacaatcaaagcccagtccccatcatcactccttctgaccccatcgacagggaaattgaattcaccccaaccaaagctccctatgaccccaggtggctgctggcagggaggcctcacccaactctgaaggggacctggcagagtggattcttcgaccatggcagtttcaaggaaatcatggcaccctgggaccagactgtggtgactggacgagcaaggctggggggcatccctgtaggggtgattgccgtggagactcggtctgtggaggtggctgtccctgctcacccagccaacttggattctgaggccaagatcatccagcaggcaggccaggtgtggttcccggactctgccttcaagacggctcaggtcatcagggacttcaaccaggagcatctgcttctcatgatctttgctaactggagaggcttctcgggcggcatgaaagacatgtccgagcagatgctgaagtttggcgcctacatcgtggacagtctccgtctgtccaagcagccagtcctcatctatatccctcccggtgccgaactccgagggggctcctgggttgtcctcgactccagcatcaaccccctgtgcatagagatgtacgcagacaaagagagcagggggggtgttctggagcccgagggcactgtggagattaagttccggaagaaagatttggtgaagaccataaggaggattgacccagtgtgcaagaaactcctggaaccagctggggacacccagctccctgacaaggaccggaaagagctggagagccagctgaaggcccgggaggacctgctgctccccatctaccaccaggtggcagtgcagttcgccgacctgcatgacacgccgggccacatgctgaagaagggaatcatttctgatgtcctggagtggaagaccacacgtacttacttctactggaggctgcgccggctgctgctggaggcacaggtgaagcaggagattctgcgagccagccctgagctgagccatgagcacacgcagtccatgctgcgacgctggtttgtggagaccgagggcgccgtcaaggcctacctgtgggacagcaaccaggtggtagtccagtggctggaacagcactggtcagccagggacaacctgcgttccactatccgagagaacctcaattatctgaagcgggactctgtcctcaagaccatccaaagcctagttcaagaacacccagaggcgaccatgggactgtgtggatacctgagccagcacctcacgcccgctgagcagatgcaggtggttcagctgctgtcgaccacggagagcccagcttcccactga

SEQ ID NO: 4749 - protein, 2456 aa, Rattus norvegicus
MVLLLFLTYLVFSCLTISWLKIWGKMTDSRPLSNSKVDASLLPSKEESFASDQSEEHGDCSCPLTTPDQEELASHGGPVDASQQRNSVPTSHQKPPRNPLSSNDTCSSPELQTNGVAAPGSEVPEANGLPFPARPQTQRTGSPTREDKKQAPIKRQLMTSFILGSLDDNSSDEDPSSNSFQTSSRKGSRDSLGTCSQEAALNTADPESHTPTMRPSMSGLHLVKRGREHKKLDLHRDFTVASPAEFVTRFGGNRVIETVLIANNGIAAVKWMRSIRRWAYEMFRNERAIRFVVMVTPEDLKANAEYYKMADPVLPVPGGPNNNNYANVELIIDIAKRIPVQAVWAGWGHASENPKLPELLCKHGIAFLGPRVRPMLGLGDRLSSTIVAQTLQIPTLPWSGSGLTVEWTEDSQHQGKCISVTEDVYEQGCVRDVDEGLQAAEKVGFPLMIKASEGGGGKGIRQAESAEDFPCFFRQVQSEIPGSPIFLMKLAQNARHLEVQVLADQYGNAVSLFGRDCSIQRRHQKIIEEAPANIAAPAVFEFMEQCAVLLAKTVVYVSAGTVGYLYSQDGSFHFLELNPRLQVEHPCTEMIADVNLPAAQLQIAMGVPLHRLKDIRLLYGESPWGVTPVSFETPLSPPIARGHVIAARITSENPDEAFKPSSGTVQELNFRSNKNVWGYFSVAAAGGLHEFPISQFGHCFSWGENQEEAISNMVVALKELSIRGDFRTTVEYLVNLLETESLQNNDIDTGWLDHLIAQRVQAEKPDIMLGVVFGALNVADAMFRTCITEFLHSLERGQVLPADSLLNIVDVELIYGGIKYVLKVARQSLTMFVLIMNGCHIEIDAHRPNDGGLLLSYNGSSYTTYMKEEVDSYRITIGNKTCVFEKENDPTVLRSPSAGKLMQYTVEDGQHVEVGSSYAEMEVMKMIMTLNVQESGRVNYIKRPGAVLEAGCVVAKLELDDPSKVHAAQPFTGELPAQQTLPILGERLHQVFHSVLENLTNVMNGYCLPEPFFSMKLKDWVEKPMMTLRHPSLPLLELQEIMTSVADRIPVPVEKAVRRVFAQDASNITSVLCQFPSQQIATILDCHAATLQRKVDREAFFMNTQSIVQLIQRYRSGTRGIMKAVVLDLLRRYLNVEHHFQQAHYDKCVINLREQFKADMTRVLDCIFSHSQVAKKNQLVTMLIDELCGPDPTLSEELTSILKELTQLSRSEHCKVALRARQVLIASHLPSYELRHNQVESSSCQPLTCNGHQFCPENLKKLILSETTIFDVLPTFFYHANKVVCMASLEVYVRRGYIAYELNSLQHRELPDGTCVVEFQFMLPSSHPNRMAMPINVSDPDLLRHSKELFMDSGFSPLCHQRMGAMVAFRRFEEFTRNFDEVISCFANVPTDTPLFSKACTSLYSEEDSKSLQEEPIHILNVAIQCADHMEDERLVPVFRAFVQSKKHILVDYGLRRITFLIAQEKEFPKFFTFRARDEFAEDRIYRHLEPGLAFQLELSRMRNFDLTAVPCANHKMHLYLGAAKVKEGLEVTDHRFFIRAIIRHSDLITKEASFEYLQNEGERLLLEAMDELEVAFNNTSVRTDCNHIFLNFVAHVIMDPLKIEESVRAMVMRYGSRLWKLRVLQAQVKINIRQTTSDCAVPIRLFITNESGYYLDISLYKEVTDSRSGNIMFHSFGNKQGSLHGMLINTPYVTKDLLQAKRFQAQSLGTTYVYDFPEMFRQALFKLWGSPEKYGPDILTYTELVLDSQGQLVEMNRLPGCNEVGMVVFKMRFKTPEYPEGRDTIVIGNDITFQIGSFGIGEDFLYLRASEMARTEGIPQIYLAANSGAVLGLSEEIKQIFQVAWVDPEDPYKGFRYLYLYLTPQDYTQISSQNSVHCKHIEDEGESGIIVDVIGKDSSLGVENLRGSGMIAGEASLAYEKNVTISMVDCRAIGIGAYLVRLGQRVIQVENSHIILTGAGALNKVLGREVYTSNNQLGGVQIMHTNGVSHVTVPDDFEGVCTILEWLSYIPKDNQSPVPIITPSDPIDREIEFTPTKAPYDPRWLLAGRPHPTLKGTWQSGFFDHGSFKEIMAPWDQTVVTGRARLGGIPVGVIAVETRSVEVAVPAHPANLDSEAKIIQQAGQVWFPDSAFKTAQVIRDFNQEHLLLMIFANWRGFSGGMKDMSEQMLKFGAYIVDSLRLSKQPVLIYIPPGAELRGGSWVVLDSSINPLCIEMYADKESRGGVLEPEGTVEIKFRKKDLVKTIRRIDPVCKKLLEPAGDTQLPDKDRKELESQLKAREDLLLPIYHQVAVQFADLHDTPGHMLKKGIISDVLEWKTTRTYFYWRLRRLLLEAQVKQEILRASPELSHEHTQSMLRRWFVETEGAVKAYLWDSNQVVVQWLEQHWSARDNLRSTIRENLNYLKRDSVLKTIQSLVQEHPEATMGLCGYLSQHLTPAEQMQVVQLLSTTESPASH

SEQ ID NO: 4750 - DNA, 3916 bp, Aspergillus terreus
  CDS (139)..(3720)
gtcgacccacgcgtccgcatcttctccctccctccctccctccctccttatttattcaattgatcctcccccaatctctaaacctctcactccccaattacctcctccacccccacctctcctctcctacacatcacaatggcggccccctatcgtcagccagaggaggcagtcgatgactccgagttcatcgacgaccatcatgatcacctccgcgacaccgtccaccatcgcctccgggccaactccgccatcatgcagttccagaagatcctcgtcgccaaccgcggcgaaatccccattcggatcttccgtaccgctcacgaactctccctccagacggtcgccatcttctcccatgaggaccgtctctccatgcaccgtcagaaggccgacgaggcctacatgatcggccaccgcggccagtacacccccgtcggcgcctatctggccgccgatgagatcgtcaagatcgccctcgagcatggcgtccacttgatccaccccggctacgggttcttatccgaaaacgccgactttgcccgcaaggtcgagaaggctggcatggtcttcgtcggtcccacccccgacaccattgacagcctcggtgacaaggtctccgcccgtcagctggccatccgctgcaacgtccccgtcgtgcccggcaccgagggccccgtcgagcgctacgaggaggtcaaggccttcaccgacacctatggcttccccatcatcatcaaggccgccttcggtggtggtggtcgcggcatgcgtgtcgtgcgcaaccaggccgatctgcgcgactccttcgagcgtgccacctccgaggcccgctccgcctttggcaacggcaccgtcttcgtcgagcgcttcctcgacaagcccaagcacatcgaggtccagctgctcggtgacaaccacggcaacgtcgtccacctcttcgagcgtgactgctccgtccagcgtcgtcaccagaaggtcgtcgaggtcgcccccgccaaggacctgcccacggatgtgcgcgaccgcatcctgtccgacgccgtgaagctggccaagtcggtcaactaccgcaacgccggtaccgccgagttcctggtggaccagcagaaccgccactactttatcgagatcaacccccgtatccaggtcgagcacaccattacggaagaaatcaccggcatcgatatcgtcgccgcccagatccagatcgccgctggcgccacgctggagcagctcggtctgactcaggaccgcatctctacccgcggcttcgccatccagtgccgtatcaccaccgaggatccctccaagggcttctctcccgacaccggcaagatcgaggtctaccggtccgccggtggtaacggtgtccgtctcgacggtggaaacggcttcgccggtgccatcatcaccccccactacgactccatgctggtcaagtgcacctgccgcgggtccacctatgaaatcgcccgtcgcaaggtcgttcgtgccctggtcgagttccgtatccgcggcgtgaagaccaacatccccttcctgacctccctgctgagtcaccccacctttgtcgatggcaactgctggaccaccttcatcgacgacacccccgaactgttcgctctggtgggctcgcagaaccgcgcccagaagctgctcgcctaccttggtgatgtcgccgtcaacggcagcagcatcaagggtcagatgggtgagcccaagttcaagggcgagatcatcaagcccaagctgctggatgcccagggtaagccgctggacgtctcgcagccctgcaccaagggttggaagcagatcatcgaccaggagggccccgtcgcctttgccaaggccgtccgcgccaacaagggctgcttgatcatggacactacctggcgtgacgcccatcagtcgctgctggccacccgtgtgcgcaccattgacctgttgaacatcgcccacgagaccagccacgccctgtccaacgcctacagtttggaatgctggggtggtgccaccttcgacgtcgccatgcgcttcctctacgaggacccctgggaccgtctgcgcaagatgcgcaaggccgtgcccaacatccccttccagatgctcctccgtggcgccaacggcgtggcttactcctccctccccgacaacgccatctaccacttctgtaagaacgccaagaagtgcggtgtcgacatcttccgtgtcttcgacgccttgaacgacatcgaccagctcgaagtcggcatcaaggccgtccacgccgccgagggtgtggttgaggctaccgtttgctacagcggtgacatgctgaaccccaaaaagaagtacaatctggagtactacctggcgctggtcgacaagatcgtcgccctgaagccccacgtcctcggcatcaaggatatggccggtgtgctcaagccccaggccgcgcgcctgctggtcggctccatccgcgagcgctaccccgacctccccatccacgtccacacccacgactccgccggtactggtgtggcgtcgatgatcgcctgcgcccaggccggcgccgacgccgtggatgccgccaccgacagcatgtccggcatgacctcgcagcccagcatcggtgccatcctcgcctccctcgagggcaccgagcacgaccccggcctcaactcggcccacgtgcgcgccctcgacagctactgggcccagctgcgtctgctgtactcgcccttcgaggccaatctcaccggccccgacccggaggtctacgagcacgagatccccggtggccagctgaccaacctcatcttccaggctagccagctgggtctgggccagcagtgggccgagaccaagaaggcctacgaggtggccaatgacctgctgggtgacatcgtcaaggtcacgcccacctccaaggtggtcggcgatctggcccagttcatcgtctccaacaagctgagcgcgcaggacgtggtcgaccgcgccgccgagctagacttccccggctccgtcctggagttcctcgagggcctgatgggccagccctttggcgggttccctgagccgctgcggtcccgcgcgctgcgcaaccgccgcaagctcgacaagcggcccggtctgtatctggagccgctggatctggccgcgatcaagaatcagatccgcgagcagttcggcagcgccaccgagtacgacgtggccagctacgccatgtaccccaaggtgtttgaggactacaagaagtttgtgcagaagtacggcgacctctcggtgctgccaacgcgctacttcctggccaagcccgagatcggcgaggagttccacgtcgagctggagaagggtaaggtgctgatcctcaagctgctggccatcgggcccttgtccgagcagaccggccagcgcgaggtgttctacgaggtcaacggtgaggtgcgccaggtcagcatcgacgacaagaaggcctcgatcgacaacacggcgcgccccaaggcggatgtgggcgacagcagccaggtcggcgcgcccatgagcggtgtggtggtcgagatccgcgtgcacgacggtctggaggtgaagaagggagatcctctggctgttctgagcgccatgaagatggaaatggtgatctcggctccacacagcggcaaggtgtccggattgctggtcaaggagggcgattctgtggacggccaggatctggtctgcaagatcaccaaggcgtaaggttggtggaggaaaagtacagggtggggccgcatgtttagattagagcatgttttatgaattatgattgggttcggtttagttattgatgaatatttgaatgtttgatttttgaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4751 - protein, 1193 aa, Aspergillus terreus
MAAPYRQPEEAVDDSEFIDDHHDHLRDTVHHRLRANSAIMQFQKILVANRGEIPIRIFRTAHELSLQTVAIFSHEDRLSMHRQKADEAYMIGHRGQYTPVGAYLAADEIVKIALEHGVHLIHPGYGFLSENADFARKVEKAGMVFVGPTPDTIDSLGDKVSARQLAIRCNVPVVPGTEGPVERYEEVKAFTDTYGFPIIIKAAFGGGGRGMRVVRNQADLRDSFERATSEARSAFGNGTVFVERFLDKPKHIEVQLLGDNHGNVVHLFERDCSVQRRHQKVVEVAPAKDLPTDVRDRILSDAVKLAKSVNYRNAGTAEFLVDQQNRHYFIEINPRIQVEHTITEEITGIDIVAAQIQIAAGATLEQLGLTQDRISTRGFAIQCRITTEDPSKGFSPDTGKIEVYRSAGGNGVRLDGGNGFAGAIITPHYDSMLVKCTCRGSTYEIARRKVVRALVEFRIRGVKTNIPFLTSLLSHPTFVDGNCWTTFIDDTPELFALVGSQNRAQKLLAYLGDVAVNGSSIKGQMGEPKFKGEIIKPKLLDAQGKPLDVSQPCTKGWKQIIDQEGPVAFAKAVRANKGCLIMDTTWRDAHQSLLATRVRTIDLLNIAHETSHALSNAYSLECWGGATFDVAMRFLYEDPWDRLRKMRKAVPNIPFQMLLRGANGVAYSSLPDNAIYHFCKNAKKCGVDIFRVFDALNDIDQLEVGIKAVHAAEGVVEATVCYSGDMLNPKKKYNLEYYLALVDKIVALKPHVLGIKDMAGVLKPQAARLLVGSIRERYPDLPIHVHTHDSAGTGVASMIACAQAGADAVDAATDSMSGMTSQPSIGAILASLEGTEHDPGLNSAHVRALDSYWAQLRLLYSPFEANLTGPDPEVYEHEIPGGQLTNLIFQASQLGLGQQWAETKKAYEVANDLLGDIVKVTPTSKVVGDLAQFIVSNKLSAQDVVDRAAELDFPGSVLEFLEGLMGQPFGGFPEPLRSRALRNRRKLDKRPGLYLEPLDLAAIKNQIREQFGSATEYDVASYAMYPKVFEDYKKFVQKYGDLSVLPTRYFLAKPEIGEEFHVELEKGKVLILKLLAIGPLSEQTGQREVFYEVNGEVRQVSIDDKKASIDNTARPKADVGDSSQVGAPMSGVVVEIRVHDGLEVKKGDPLAVLSAMKMEMVISAPHSGKVSGLLVKEGDSVDGQDLVCKITKA

SEQ ID NO: 4752 - DNA, 3195 bp, Corynebacterium glutamicum
  CDS (872)..(2647)
aagctttcgctgagctgatgaaccgcaagggcatcgctcgcgatgacaccgttgttgtctacggtgacaagtccaactggtgggctgcgttcaccctgtgggtcttcgaactgttcggccactccgatgtccgcctgctcaacggcggccgcgacgcgtggatggctgaagagcgcgacacctcctacgtggttccggagtacccctccgccaactaccccgtcgtggagcgtgtcgacgaaaaccagcgcgcgttcgtggctgaggtgctcggttcgctcacgcaatccggtggcatgacgcttgtcgacgtcaggaccccttcggagttctccggattggatgagcacggcaacccaacctcaaacaccggcgtgcttcgtggtggacacatcccaggcgcgatcaacctggattggtcggacgctgttcttcccaacggaaacttccgcacccgtgcagagttggacaagctctacgccgatctcaacccagctgacgataccgttgtctactgccaggttggcgaccgcgcggcccacacctggttcgtgctgaagtatctgctcggtttcaacaacgtccgaaactatgacggatcgtgggcagaatggggcaatatggttcgcatgccgatcgaaactggcgaaaacaccaaaaataacgtttcggtgtcatagaataggcgtatcccctttttgcctgaacataagccatatttcctgcctaaaacagaagaattcccccagaatatgagtaagtcctcatatctggttgagttcttcggggttgagtgtgcaagaatattcactattggtcaggcaactatgtgtctacccactgagtcatcaatttaaatcaggagttattaatgtcagtcgagactaggaagatcaccaaggttcttgtcgctaaccgtggtgagattgcaatccgcgtgttccgtgcagctcgagatgaaggcatcggatctgtcgccgtctacgcagagccagatgcagatgcaccattcgtgtcatatgcagacgaggcttttgccctcggtggccaaacatccgctgagtcctaccttgtcattgacaagatcatcgatgcggcccgcaagtccggcgccgacgccatccaccccggctacggcttcctcgcagaaaacgctgacttcgcagaagcagtcatcaacgaaggcctgatctggattggaccttcacctgagtccatccgctccctcggcgacaaggtcaccgctcgccacatcgcagataccgccaaggctccaatggctcctggcaccaaggaaccagtaaaagacgcagcagaagttgtggctttcgctgaagaattcggtctcccaatcgccatcaaggcagctttcggtggcggcggacgtggcatgaaggttgcctacaagatggaagaagtcgctgacctcttcgagtccgcaacccgtgaagcaaccgcagcgttcggccgcggcgagtgcttcgtggagcgctacctggacaaggcacgccacgttgaggctcaggtcatcgccgataagcacggcaacgttgttgtcgccggaacccgtgactgctccctgcagcgccgtttccagaagctcgtcgaagaagcaccagcaccattcctcaccgatgaccagcgcgagcgtctccactcctccgcgaaggctatctgtaaggaagctggctactacggtgcaggcaccgttgagtacctcgttggctccgacggcctgatctccttcctcgaggtcaacacccgcctccaggtggaacacccagtcaccgaagagaccaccggcatcgacctggtccgcgaaatgttccgcatcgcagaaggccacgagctctccatcaaggaagatccagctccacgcggccacgcattcgagttccgcatcaacggcgaagacgctggctccaacttcatgcctgcaccaggcaagatcaccagctaccgcgagccacagggcccaggcgtccgcatggactccggtgtcgttgaaggttccgaaatctccggacagttcgactccatgctggcaaagctgatcgtttggggcgacacccgcgagcaggctctccagcgctcccgccgtgcacttgcagagtacgttgtcgagggcatgccaaccgttatcccattccaccagcacatcgtggaaaacccagcattcgtgggcaacgacgaaggcttcgagatctacaccaagtggatcgaagaggtttgggataacccaatcgcaccttacgttgacgcttccgagctcgacgaagatgaggacaagaccccagcacagaaggttgttgtggagatcaacggccgtcgcgttgaggttgcactcccaggcgatctggcactcggtggcaccgctggtcctaagaagaaggccaagaagcgtcgcgcaggtggtgcaaaggctggcgtatccggcgatgcagtggcagctccaatgcagggcactgtcatcaaggtcaacgtcgaagaaggcgctgaagtcaacgaaggcgacaccgttgttgtcctcgaggctatgaagatggaaaaccctgtgaaggctcataagtccggaaccgtaaccggccttactgtcgctgcaggcgagggtgtcaacaagggcgttgttctcctcgagatcaagtaagttcttggattcctgttagtcaaaaaccgggtcgcatctgatgttcagatgtggcccggttttactatttgtgaatacactctgcccctgttgtacattcgacaacaagatttcggtaaaaaggtggtcaaaatcaggaaatcttgttgtcgaatgtacaccgcattgtgggctttcacggttcgctgcgttgattgttatttagccagcctgctccccacacttaaccggtgatcaacgagcccacatacccgggcgcggtgctggaacagcccgagaaatttaagatcgtttggggttggctgctcgcccgctgatacttctcgttcaatggagtggatgaaccttcgcggattgcggttccattggcgtagccttgccagttgatctcggtggtgtctttcatggtgtgctccccttgtggttttttattttctttaacgctaatcggctgacggctttcaatgcacaaggtaaaatttgtgtaattgtgtcgtgtggatttgaaggtttttgtaaatctagttaaatcatgaggtcataagctt

SEQ ID NO: 4753 - protein, 591 aa, Corynebacterium glutamicum
MSVETRKITKVLVANRGEIAIRVFRAARDEGIGSVAVYAEPDADAPFVSYADEAFALGGQTSAESYLVIDKIIDAARKSGADAIHPGYGFLAENADFAEAVINEGLIWIGPSPESIRSLGDKVTARHIADTAKAPMAPGTKEPVKDAAEVVAFAEEFGLPIAIKAAFGGGGRGMKVAYKMEEVADLFESATREATAAFGRGECFVERYLDKARHVEAQVIADKHGNVVVAGTRDCSLQRRFQKLVEEAPAPFLTDDQRERLHSSAKAICKEAGYYGAGTVEYLVGSDGLISFLEVNTRLQVEHPVTEETTGIDLVREMFRIAEGHELSIKEDPAPRGHAFEFRINGEDAGSNFMPAPGKITSYREPQGPGVRMDSGVVEGSEISGQFDSMLAKLIVWGDTREQALQRSRRALAEYVVEGMPTVIPFHQHIVENPAFVGNDEGFEIYTKWIEEVWDNPIAPYVDASELDEDEDKTPAQKVVVEINGRRVEVALPGDLALGGTAGPKKKAKKRRAGGAKAGVSGDAVAAPMQGTVIKVNVEEGAEVNEGDTVVVLEAMKMENPVKAHKSGTVTGLTVAAGEGVNKGVVLLEIK

SEQ ID NO: 4754 - DNA, 3558 bp, Schizosaccharomyces pombe
  CDS (1)..(3558)
atgacttctaaatatgatgcgttgttgcacaatcaaagtaccaacacaaaccctttcagcaagttgcaggatcgttcctccttgttaggagagaagtttaccaaggtgttggtagctaatcgatctgaaattgctattcgtgtcttccgaactgctcatgaactttcgatgcacactgtcgccatttactcgtatgaagacatactgtcgatgcatcgtcaaaaggccgacgaatcctatccaattggcaaggtcggtcagtacagtccagtaggagcttatctggctattgacgaaatcgtcagcatcgccaaacgcaccggtgccaacttggttcatccaggatacggtttcctttccgaaaacgccgaatttgccagaaaggtaaacgaagctggcatgcaatttgtaggcccctcccccgaagtcattgactctcttggtgacaaaacgaaagctcgtgcaatcgccattcgctgtggtgtcccagtcgttcctggtactccaggtcccgtcgaacactatgaagaagctgaggcttttgttaaggaatatggcctccccgttatcatcaaggctgccatgggtggtggtggccgtggtatgcgtgtcgttcgttctgccgataccttgaaggagtcatttgagcgtgctcgttctgaggcccttgcttcatttggtgatggcactgtgttcattgaacgctttttggataaacccaagcatattgagattcaacttatggctgataaggctggaaatgtcattcatttacatgagcgtgattgttccgtacaacgtcgtcatcaaaaggtcgtggagattgctccggccaaagatttggatcctaagatccgtcaagcactttatgacgatgccatcaagattgccaaggaagtgaagtattgcaacgccggtactgcagaattcttgctcgatcaaaaaggacgtcactattttattgagattaatcctcgtattcaggttgaacatacgattactgaggaaattaccggtgtcgatattgtatcggctcagttgcacgttgctgctggttttacccttccagaaattggtttgacccaagacaaaattagcactcgcggctttgctattcaatgccgtgttaccactgaggatcctaacaatggctttgctcccgacattggtaagattgaagtttatcgttccgctggtggaaatggtgtccgtttggatggtgctaacggtttcgcgggttctgtcattactcctcattatgactctatgctcgtcaagtgtacatgccatgatgctacatatgaatatacccgtcgtaagatgattcgttcattaatcgagttccgtgtccgtggtgtcaaaaccaacattccttttgttttgcgtttattgatgcacgatacttttatccaaggaaactgttggacaacttttattgatgacactcctgaattgtttcaactttatcgttcccgtaatcgcgctcaaaaacttctggcctacctcggtgatcttgctgtcaacggcagctctattaagggccaaaatggtgagccagctcttaagtcggagattgtcatgcccgttttgttagacagtacaggaaatcaaattgatgtttctcatccatctgaaaaaggttggcgtaaattattgttagacaacggtcctgctgcctttgccaaggctgtgagaaatcacaagcgtggtcttatcatggataccacttggcgcgatgcccatcaatccttattggctacccgtgttcgtaccattgatctggtaaatattgctccatatacgagccatgcccttgcttccgcttattctttggagatgtggggaggtgccacctttgacgtctctatgcgattccttcatgaatgtccatgggatcgtttgcgtagactccgtaagttggttcctaacattcctttccaaatgcttttacgtggtgccaatggtttatgctattcaagtttgccggataacgttatttactttttctgtgaacaagccaaaaagaacggtatcgatatcttccgtgttttcgatgccttgaacgatgttaataacctttctcttggaattgatgctgccaagcgcgccggcggtgttgttgaggccactatgtgttactctggcgatatgttaaatcccaagaagaagtataaccttgattactatgttaaccttgttgataaaatggttgaaatgggtattcacattttaggtatcaaggatatggctggcgttatgaaacctaaagctgctcgtcttcttatttctgccattcgggagaaacatccagagttacctattcatgttcacacccacgattctgccggtactgctgttgcttccatggctgcggctttggaggcaggagctgacgttgttgatgttgcaactgatagcatgtctggtcttacatcccaacctagctttggcgccgttttggcctctgtcgatggtactgataagcaattggagtttgataacaatcaattacgcgaaattgatagttattgggctcaaatgcgtttgctttactctccgtttgaatctgaaatcaagggtactgactcagatgtgtataaccacgaaattcccggtggtcaattaaccaaccttaaattccaagctacctcccttggattgggcactcaatgggctgaaactaagaaagcgtacattgaagccaataaattgcttggagatattattaaggtcactcccacttcaaaggtggttggtgatttagcccaatttatggttcaaaataaacttagtgctgaggatgttgagaatcgtgcgaccactttggacttccctgcttcagtactcgatttcttccaaggcttaatgggtcaaccatatggcggttttccagagcctttgcgtactaatgtacttaaaggtcgtcgtcaacctttgactgatcgtccaggtaaattccttcctgctgctgatttcgatgctatccgcaaattattgtcagagaagtttggtgtttcttcagattgtgatatcgctgcctacacccaatttcctggtgtctttgaggaatatcgtcaatttgtcgatcgctatggtgatttgaccactgttcctactaaattcttcttatctagacctgaaatgaacgaagaaatgcacgttgaaattgatcaaggtaagactttaatcgttaaatttgtcgctcttggaccattgaaccctcgtactggacaacgtgaagtttatttcgagttgaacggtgagaaccgccatgttactgttgaagataagaaagcagctatagaaactgttaccagacctcgtgctgatcctggtaatcctggacacgttgcagcccccatgagtggaacaattgtcgaaattcgtgttaaggaaggtgcgaaggttaagaagggagatattattgctgttttaagtgctatgaagatggaaattgttattagtgctcctcacagtggtgtgctcaagtctttggccgttgttcagggtgattctgtgaatggtggtgatttgtgtgctgttcttgaacacgagtaa

SEQ ID NO: 4755 - protein, 1185 aa, Schizosaccharomyces pombe
MTSKYDALLHNQSTNTNPFSKLQDRSSLLGEKFTKVLVANRSEIAIRVFRTAHELSMHTVAIYSYEDILSMHRQKADESYPIGKVGQYSPVGAYLAIDEIVSIAKRTGANLVHPGYGFLSENAEFARKVNEAGMQFVGPSPEVIDSLGDKTKARAIAIRCGVPVVPGTPGPVEHYEEAEAFVKEYGLPVIIKAAMGGGGRGMRVVRSADTLKESFERARSEALASFGDGTVFIERFLDKPKHIEIQLMADKAGNVIHLHERDCSVQRRHQKVVEIAPAKDLDPKIRQALYDDAIKIAKEVKYCNAGTAEFLLDQKGRHYFIEINPRIQVEHTITEEITGVDIVSAQLHVAAGFTLPEIGLTQDKISTRGFAIQCRVTTEDPNNGFAPDIGKIEVYRSAGGNGVRLDGANGFAGSVITPHYDSMLVKCTCHDATYEYTRRKMIRSLIEFRVRGVKTNIPFVLRLLMHDTFIQGNCWTTFIDDTPELFQLYRSRNRAQKLLAYLGDLAVNGSSIKGQNGEPALKSEIVMPVLLDSTGNQIDVSHPSEKGWRKLLLDNGPAAFAKAVRNHKRGLIMDTTWRDAHQSLLATRVRTIDLVNIAPYTSHALASAYSLEMWGGATFDVSMRFLHECPWDRLRRLRKLVPNIPFQMLLRGANGLCYSSLPDNVIYFFCEQAKKNGIDIFRVFDALNDVNNLSLGIDAAKRAGGVVEATMCYSGDMLNPKKKYNLDYYVNLVDKMVEMGIHILGIKDMAGVMKPKAARLLISAIREKHPELPIHVHTHDSAGTAVASMAAALEAGADVVDVATDSMSGLTSQPSFGAVLASVDGTDKQLEFDNNQLREIDSYWAQMRLLYSPFESEIKGTDSDVYNHEIPGGQLTNLKFQATSLGLGTQWAETKKAYIEANKLLGDIIKVTPTSKVVGDLAQFMVQNKLSAEDVENRATTLDFPASVLDFFQGLMGQPYGGFPEPLRTNVLKGRRQPLTDRPGKFLPAADFDAIRKLLSEKFGVSSDCDIAAYTQFPGVFEEYRQFVDRYGDLTTVPTKFFLSRPEMNEEMHVEIDQGKTLIVKFVALGPLNPRTGQREVYFELNGENRHVTVEDKKAAIETVTRPRADPGNPGHVAAPMSGTIVEIRVKEGAKVKKGDIIAVLSAMKMEIVISAPHSGVLKSLAVVQGDSVNGGDLCAVLEHE

SEQ ID NO: 4756 - DNA, 1620 bp, Arabidopsis thaliana
  CDS (1)..(1620): n means a or g or c or t/u
atggacgcttctatgattaccaattccaaatccattacttctccaccctctttagccttagggaagtcaggaggaggaggagttatcagaagttcactatgtaacttaatgatgccaagcaaagttaacttccctagacaaagaactcaaactctaaaggttagccagaagaaactcaagagagctactagtggtggtcttggtgttacatgcagtggtggtgataagattctcgtagcgaatcgaggtgaaattgcagttcgtgttatcagaactgctcatgaaatggggattccttgtgttgctgtgtattctactatagataaagatgctcttcatgttaaattagctgatgaagctgtttgtattggtgaagctcctagtaaccagtcgtatttggtgattccgaatgttctgtctgcggctattagccgtggatgtacaatgcttcatcctggatatggttttctttcggagaacgctctctttgttgaaatgtgtagagaccatgggatcaattttattggacctaatcctgataccatccgtgttatgggagacaaagcgactgcaagagagacaatgaaaaatgcaggggttcccactgtaccagggagtgatgggctattgcagagtacagaagaagctgtcagggtcgccaatgagattggtttccctgtaatgatcacggcaacagctggtggtggtggacgtggaatgcgtcttgctaaggaaccgggagagtttgtaaaactgttgcagcaagctaagagcgaggctgctgctgcttttgggaatgatggatgttatctggagaagttcgttcaaaaccctagacatattgagttccaggtgctggcagataaatttggaaatgttgttcactttggtgagcgtgactgcagcatccagaggcgtaaccaaaagcttctggaagaaccttctccagcattgaccgctgaattgcgaaaagccatgggtgatgcagcagtcgcagcagcagcatccattgggtacattggtgttggtactgtggagtttcttttagatganagaggttccttctacttcatggaaatgaacactaggatccaggtggagcatcctgtgacagagatgatttactctgttgatttgatagaggagcagattcgtgttgcaatgggagagaaacttcgttacaaacaggaagatattgtgctcagagggcactcaattgaatgtcgtatcaatgcagaagatccatttaaaggattcagacctggacctggcagaataacatcatacctgccatctggaggtcctttcgttagaatggacagccatgtctattccgactatgttgtgcctccaagctatgattctcttcttgggaagcttattgtgtgggctccaacgagggaaaaagcaattgaacggatgaagcgggcgcttaatgacactatcattacaggggttccaacgactatcaattaccacaaacttatccttgatgttgaggatttcaaaaatggaaaagttgatacagctttcatcgtcaagcatgaagaggagctagctgagttagtgggatatgaagcctttggtaaagctgaacatagagataggagaattgcatga

SEQ ID NO: 4757 - protein, 539 aa, Arabidopsis thaliana
  misc_feature (351)..(351): Xaa can be Asp or Glu
MDASMITNSKSITSPPSLALGKSGGGGVIRSSLCNLMMPSKVNFPRQRTQTLKVSQKKLKRATSGGLGVTCSGGDKILVANRGEIAVRVIRTAHEMGIPCVAVYSTIDKDALHVKLADEAVCIGEAPSNQSYLVIPNVLSAAISRGCTMLHPGYGFLSENALFVEMCRDHGINFIGPNPDTIRVMGDKATARETMKNAGVPTVPGSDGLLQSTEEAVRVANEIGFPVMITATAGGGGRGMRLAKEPGEFVKLLQQAKSEAAAAFGNDGCYLEKFVQNPRHIEFQVLADKFGNVVHFGERDCSIQRRNQKLLEEPSPALTAELRKAMGDAAVAAAASIGYIGVGTVEFLLDXRGSFYFMEMNTRIQVEHPVTEMIYSVDLIEEQIRVAMGEKLRYKQEDIVLRGHSIECRINAEDPFKGFRPGPGRITSYLPSGGPFVRMDSHVYSDYVVPPSYDSLLGKLIVWAPTREKAIERMKRALNDTIITGVPTTINYHKLILDVEDFKNGKVDTAFIVKHEEELAELVGYEAFGKAEHRDRRIA

SEQ ID NO: 4758 - DNA, 3727 bp, Bacillus stearothermophilus
  CDS (92)..(3535)
gtcgacagcagaaaagaggtctgactttttagaaagtgtatttacaaaatagaaaaagttttatagtttaaattagaaaggaggaaagacgatgaagacaagacgaattcgcaaagtgctcgtagctaaccgcggggagatcgccatccgcgttttccgcgcctgcacggagcttggcatccgcaccgtggccatttactcgaaggaagatgtcggctcataccaccgctataaagcggatgaagcgtatttagtcggtgaaggaaaaaagccgattgaggcgtatttggatattgaaggcatcattgagattgccaaggcccacgatgtcgatgcgattcacccaggatatgggtttttttcagaaaatattcaatttgctaaacggtgccgtgaagaaggaattattttttttggcccgaatgagaaccatttggacatgttcggcgacaaggtgaaagcgcgccatgcggcggtgaacgctggcattccggtcattccgggcagcgacgggccggtcgacggccttgaggacgttgtcgctttcgccgaagcgcacggctatccgatcatcattaaagcagcacttggcggcggtgggcgcggcatgcgattcgtccgttcgaagtcggaagttaaagaagcgtttgagcgtgccaaatcggaagcaaaagcggcgtttggcagcgatgaggtgtatgttgaaaagttgatcgaaaatccaaagcacattgaagtgcaaattttaggtgactatgaaggaaatatcgttcacctttatgaacgcgactgctcggtgcagcgccgccaccaaaaagtcgtcgaagtcgcgccgagcgtctcgctgtcggacgagctgcgccaacgcatttgcgaggcagcggttcagcttatgagaagcgtcggttatgtcaatgccggcacggtcgaatttctcgtttcgggtgatgagttttatttcatcgaagtcaacccgcgcattcaagtcgagcatacgatcaccgagatgattactggaattgatatcgtccagtcgcaaattttaattgctgatggctgttcgcttcatagccatgaagtcggcattccgaagcaggaagacatccgcattaacggttatgccattcagtcgcgggtgacgacggaagacccgctcaataactttatgccagatactgggaaaataatggcgtatcgctccggtgggggctttggtgtacgtttggacgccggcaacggtttccaaggggcagtcattacgccgtattacgattccttgctcgtcaaattgtcgacatgggcgttgacgtttgagcaggcagcaagaaaaatgctgcgcaacttgcggacgttccgcattcgcgtatttaaaacgaacattccgttcttggaaaatgtcgtccaacatccgaagtttttatcaggcgaatacgatacgtcgttcatcgatacgacgccggaactattcgtgttcccacgccggaaagaccgcggaacgaaaatgctcacttacatcggcacagtgacggtcaatggattcccaggcatcggcaaaaagaaaaagccggtgtttgacaagccgcgcttgccaaaattgagcgaggcagagccgatcccggccggaacgaagcaaattttggacaagcatggccccgaggggcttgtccgctggattcaagaacagccgcgggtgctcttgaccgatacgacgttccgggacgctcatcagtcactgttggcgacacgagtccgcacggtcgatttagtgcgtgcagccgagccgagcgcgcgcttattgccgaatttattctcgcttgaaatgtggggcggggcgacgtttgatgtggcgtatcgctttttaaaagaggatccgtgggatcggcttctgaagctgcgcgacgcattcccgaacgtgttgttccaaatgttgctccgttctgccaacgccgtaggctacaaaaactatccggacaacgtcatccgcgagttcgtcgaaaaatcggcgcatgctggcatccatgtgttccgaattttcgacagtttaaactgggtgaaaggaatgacggtggcgatcgacgccgtccggcagagcggcaaaatcgctgaagcggcgatttgctatacgggtgatattttagatccgagccggtcgaaatacaatttggattactataaggcccttgcgaaagagcttgaacaggcgggtgcgcacattttggccattaaagatatggcggggctcttgaagccgcaggcggcgcatgtgctcatttccgggctcaaggaaacagtcgacattccgatttatttgcatacgcacgacacgagcggtaacggcatttatacgtacgcgaaagcgattgaagccggcgttgatattgttgatgtcgccatcagttcgatggccggcttaacgtctcagccgagcgccaatacgctttactatgcgcttgaagggaccgagcgggcgccggaagtcgacatttacggtcttgagcagttagcgcgctattgggaagatgtgcgcaagttttatcaagaatttgaaagcggcatgaacgcgccgcatacggaagtgtacatgcacgaaatgccaggcggtcaatacagcaacttgcagcagcaggcgaaagcggtcggtctcggcgatcggtgggatgaagtgaaagaaatgtaccgccgcgtcaacgacttgttcggcgatattgtcaaagtgacgccgtcatcgaaagtcgtcggcgatatggcgctttacatggtgcaaaacaacttgacggaacaagacattttcgagcgcggcgaaacgctgaacttccctgattcagtcgtcgagctgtttgaaggatatttaggccagccgcacggcggattcccgaaagagttgcagcgcattattttaaaaggacgcgagccgatcactgtccgtccgggggaactgctcgagccggttgattttgagcaaatgaaaaaagagctgtatgacaagcttggccgcgaagtgaccgactttgatgccattgcgtacgccctttatccgaaagtgtttcttgaatatgcagaaacggtggaaaaatacggcgatgtgtctgtactcgatacaccgacgttcttgtatggcatgcgccttggcgaggaaattgaagtggaaatcgagcgcggaaaaacgttgatcgttaagcttgtgtcgatcggccagccgcaggcggacggtacacgcgtcgtctacttcgagctgaacggtcaaccgcgtgaagttgtcatccgcgatgaaagcattaaaaccgcagtcgttgagcacattaaagcggatcggacgaacccgaaccatattgcggcgacgatgccgggtacggttgttaaagtgcttgtcgaaaaaggggaaaaagtcgacaaaggggaccatttaatggtcacggaagcaatgaaaatggaaacgaccgtgcaagcaccgtttgccggtgttgtcaaagacatttacgtcaaaagcggcgatgcgatccaggcaggcgatttgctcatggagttgtccaaataaaaaaacattgatcttggcacaagccggtttcctaaaaaagaggctgacctcaaaagtcgttaaaccgaccttttggggacagcctctgtttcttttctttactatttggttatttattccttttttgaaacgagaatttctccttatttctgaattttatcctgttttttctttgttggatcggttgtggcc

SEQ ID NO: 4759 - protein, 1147 aa, Bacillus stearothermophilus
MKTRRIRKVLVANRGEIAIRVFRACTELGIRTVAIYSKEDVGSYHRYKADEAYLVGEGKKPIEAYLDIEGIIEIAKAHDVDAIHPGYGFFSENIQFAKRCREEGIIFFGPNENHLDMFGDKVKARHAAVNAGIPVIPGSDGPVDGLEDVVAFAEAHGYPIIIKAALGGGGRGMRFVRSKSEVKEAFERAKSEAKAAFGSDEVYVEKLIENPKHIEVQILGDYEGNIVHLYERDCSVQRRHQKVVEVAPSVSLSDELRQRICEAAVQLMRSVGYVNAGTVEFLVSGDEFYFIEVNPRIQVEHTITEMITGIDIVQSQILIADGCSLHSHEVGIPKQEDIRINGYAIQSRVTTEDPLNNFMPDTGKIMAYRSGGGFGVRLDAGNGFQGAVITPYYDSLLVKLSTWALTFEQAARKMLRNLRTFRIRVFKTNIPFLENVVQHPKFLSGEYDTSFIDTTPELFVFPRRKDRGTKMLTYIGTVTVNGFPGIGKKKKPVFDKPRLPKLSEAEPIPAGTKQILDKHGPEGLVRWIQEQPRVLLTDTTFRDAHQSLLATRVRTVDLVRAAEPSARLLPNLFSLEMWGGATFDVAYRFLKEDPWDRLLKLRDAFPNVLFQMLLRSANAVGYKNYPDNVIREFVEKSAHAGIHVFRIFDSLNWVKGMTVAIDAVRQSGKIAEAAICYTGDILDPSRSKYNLDYYKALAKELEQAGAHILAIKDMAGLLKPQAAHVLISGLKETVDIPIYLHTHDTSGNGIYTYAKAIEAGVDIVDVAISSMAGLTSQPSANTLYYALEGTERAPEVDIYGLEQLARYWEDVRKFYQEFESGMNAPHTEVYMHEMPGGQYSNLQQQAKAVGLGDRWDEVKEMYRRVNDLFGDIVKVTPSSKVVGDMALYMVQNNLTEQDIFERGETLNFPDSVVELFEGYLGQPHGGFPKELQRIILKGREPITVRPGELLEPVDFEQMKKELYDKLGREVTDFDAIAYALYPKVFLEYAETVEKYGDVSVLDTPTFLYGMRLGEEIEVEIERGKTLIVKLVSIGQPQADGTRVVYFELNGQPREVVIRDESIKTAVVEHIKADRTNPNHIAATMPGTVVKVLVEKGEKVDKGDHLMVTEAMKMETTVQAPFAGVVKDIYVKSGDAIQAGDLLMELSK

SEQ ID NO: 4760 - DNA, 6765 bp, Arabidopsis thaliana
  CDS (1)..(6765)
atggctggctcggttaacgggaatcatagtgctgtaggacctggtataaattatgagacggtgtctcaagtggatgagttctgtaaagcacttagagggaaaaggccgatccatagtattttgatagctaacaatggaatggcggctgtgaagtttatacgtagtgtcagaacatgggcttatgaaacatttggtacggaaaaagccatattgttggtggggatggcaacccctgaagacatgcggatcaatgcggagcatatcagaatcgctgatcagtttgttgaggttcccggaggaaccaacaataacaattatgctaacgttcagctgattgtggagatggctgaagtaacacgcgtggatgcagtttggcctggttggggtcatgcatctgaaaaccccgaattacctgatgccctagatgcaaaaggaatcatatttcttggtcctccagcatcttcaatggcagcactgggagataagattggttcttcgttgattgcacaagctgctgatgtacccactctgccatggagtggttcccatgttaaaatacctcctaatagcaacttggtaaccatcccagaggagatctaccggcaagcatgtgtctacacaactgaagaagcgattgctagctgtcaagttgtcggttacccagcaatgatcaaagcatcgtggggtggtggtggtaaaggaatcaggaaggttcataatgatgatgaggttagggctctattcaagcaagttcagggtgaggtcccaggctcaccaatattcataatgaaggttgcgtcacagagtcggcatctagaggtccagctgctctgtgacaagcatggaaatgtttcagctctgcatagccgtgattgtagcgtccagagaagacatcaaaagatcatagaggagggtccaattactgtggctccgccagaaactgtcaagaaacttgaacaagcagctagaaggttggctaagagtgttaactatgttggagctgctactattgagtatctctacagtatggacactggggagtactacttcttagagcttaaccctcgcttacaggttgagcatcctgtcactgagtggattgccgagataaatcttcctgctgcccaagttgctgtggggatgggaattcctctctggcaaatccctgagataagacggttctatggaatagaacatggtggaggttatgattcttggcgaaaaacatctgttgtagccttcccttttgactttgataaagctcaatctataaggccaaaaggtcattgtgtggctgtacgtgtgacaagtgaggatcctgatgacgggttcaaaccaaccagcggtagagttcaggagttgagttttaagagcaagccaaatgtgtgggcgtacttctctgtcaagtctggtggaggcatccacgagttctcggattcccagtttggacatgtttttgcatttggggaatccagagccctggcgatagcgaatatggttcttgggctaaaagaaattcagatccgtggagaaattaggactaacgttgactacacgatcgaccttttacatgcttctgattaccgtgataacaaaattcacactggttggttggatagtaggattgctatgcgggtcagagctgagaggcctccatggtatctctctgttgtcggcggagctctctataaagcatcagcgaccagtgctgctgtggtttcagattacgttggttatctggagaaggggcaaatccctccaaagcatatatctcttgtacattctcaagtgtctctgaatattgaaggaagtaaatatacgattgatgtagtccggggtggatcaggaacctacaggctaagaatgaacaagtcagaagtggtagcagaaatacacactctacgtgatggaggtctgttgatgcagttggatggcaaaagccatgtgatatatgcagaggaagaagctgcaggaactcgtcttctcattgatggaagaacttgtttgctacagaatgaccacgatccatcaaagttaatggctgagacaccgtgcaagttgatgaggtatttgatttccgacaacagcaatattgacgctgatacgccttatgccgaagttgaggtcatgaagatgtgcatgccacttctttcacctgcttcaggagttatccattttaaaatgtctgaaggacaagccatgcaggctggtgaacttatagccaatcttgatcttgatgatccttctgctgtaagaaaggccgaacccttccatggaagtttcccaagattagggcttccaactgcaatatccggtagagttcatcagagatgtgccgcaacattaaatgctgcacgcatgattcttgctggctatgagcataaagtagatgaggttgttcaagacttacttaattgccttgatagccctgaactcccatttcttcagtggcaagagtgctttgcagttctggcgacacgactacctaaaaatctcaggaacatgctagaatcaaagtatagggaatttgagagtatttccagaaactctttgaccaccgatttccctgccaaacttttaaaaggcattcttgaggcacatttatcttcttgtgatgagaaagagagaggtgcccttgaaaggctcattgaaccattgatgagccttgcaaaatcttatgaaggtggtagagaaagtcatgcccgtgttattgttcattctctctttgaagaatatctatcagtagaagaattattcaatgataacatgctggctgatgttatagaacgcatgcgtcagctatacaagaaagatctgttgaaaattgtggatatagtgctctcacaccagggcataaaaaacaaaaacaaactcgttctccggctcatggagcagcttgtttaccctaatcctgctgcttacagagataaacttattcgattctcaacacttaaccatactaactactctgagttggcgctcaaggcgagtcaattacttgaacagaccaaactaagtgagcttcgttcaaacattgctagaagcctttcagagttagaaatgtttacagaggacggagaaaatatggatactcccaagaggaaaagtgccattaatgaaagaatagaagatcttgtaagcgcatctttagctgttgaagacgctctcgtgggactatttgaccatagcgatcacacacttcaaagacgggttgttgagacttatattcgcagattataccagccctacgtcgttaaagatagcgtgaggatgcagtggcaccgttctggtcttcttgcttcctgggagttcctagaggagcatatggaaagaaaaaacattggcttagacgatcccgacacatctgaaaaaggattggttgagaagcgtagtaagagaaaatggggggctatggttataatcaaatctttgcagtttcttccaagtataataagtgcagcattgagagaaacaaagcacaacgactatgaaactgccggagctcctttatctggcaatatgatgcacattgctattgtgggcatcaacaaccagatgagtctgcttcaggacagtggggatgaagaccaagctcaggaaagagtaaacaagttggccaaaattcttaaagaggaagaagtgagttcaagcctctgttctgccggtgttggtgtaatcagctgtataattcagcgagatgaaggacgaacacccatgagacattctttccattggtcgttggagaaacagtattatgtagaagagccgttgctgcgtcatcttgaacctcctctgtccatttaccttgagttggataagctgaaaggatactcaaatatacaatatacgccttctcgagatcgtcaatggcatctgtatactgttacagacaagccagtgccaatcaagaggatgttcctgagatctcttgttcgacaggctacaatgaacgatggatttatattgcagcaagggcaggataagcagcttagccaaacactgatctccatggcgtttacgtcgaaatgtgttctgaggtctttgatggatgccatggaggaactggaactgaatgcccataatgctgcaatgaaaccagatcacgcacatatgtttctttgcatattgcgtgacgagcagatagatgatcttgtgcctttccccaggagagttgaagtgaatgcggaggatgaagaaactacagttgaaatgatcttagaagaagcagcacgagagatacatagatctgttggagtgagaatgcataggttgggcgtgtgcgagtgggaagtgcggctgtggttggtgtcctctggactggcatgtggtgcttggagggttgtggttgcaaacgtgacaggccgtacatgcactgtccacatataccgagaagttgaaactcctggaagaaacagtttaatctaccactcaataaccaagaagggacctttgcatgaaacaccaatcagtgatcaatataagcccctgggatatctcgacaggcaacgtttagcagcaaggaggagtaacactacttattgctatgacttcccgttggcatttgggacagccttggaactgttgtgggcatcacaacacccaggagttaagaaaccatataaggatactctgatcaatgttaaagagcttgtattctcaaaaccagaaggttcttcgggtacatctctagatctggttgaaagaccacccggtctcaacgactttgggatggttgcctggtgcctagatatgtcgaccccagagtttcctatggggcggaaacttctcgtgattgcgaatgatgtcaccttcaaagctggttcttttggtcctagagaggacgcgtttttccttgctgttactgaactcgcttgtgccaagaagcttcccttgatttacttggcagcaaattctggtgcccgacttggggttgctgaagaagtcaaagcctgcttcaaagttggatggtcggatgaaatttcccctgagaatggttttcagtatatatacctaagccctgaagaccacgaaaggattggatcatctgtcattgcccatgaagtaaagctctctagtggggaaactaggtgggtgattgatacgatcgttggcaaagaagatggtattggtgtagagaacttaacaggaagtggggccatagcgggtgcttactcaaaggcatacaatgaaacttttactttaacctttgttagtggaagaacggttggaattggtgcttatcttgcccgcctaggtatgcggtgcatacagagacttgatcagccgatcatcttgactggcttctctacactcaacaagttacttgggcgtgaggtctatagctctcacatgcaactgggtggcccgaaaatcatgggcacaaatggtgttgttcatcttacagtctcagatgatcttgaaggcgtatcagcaattctcaactggctcagctacattcctgcttacgtgggtggtcctcttcctgttcttgcccctttagatccaccggagagaattgtggagtatgtcccagagaactcttgcgacccacgagcggctatagctggggtcaaagacaataccggtaaatggcttggaggtatctttgataaaaatagtttcattgagactcttgaaggctgggcaaggacggtagtgactggtagagccaagctcgggggaatacccgttggagttgttgcagttgagacacagactgtcatgcagatcatcccagccgatcctggacagcttgactctcatgaaagagtggttccgcaagcagggcaagtctggtttcctgattcagcggccaagactgctcaagcgcttatggatttcaaccgggaagagcttccattgtttatcctagcgaactggagagggttttcaggtgggcagagagatcttttcgaaggaatacttcaggcaggttcaactatagtagaaaatctgagaacctatcgtcagccagtgtttgtgtacatcccaatgatgggagagctgcgcggtggagcgtgggttgttgttgacagccagataaattcggattatgttgaaatgtatgctgatgaaacagctcgtggaaatgtgcttgagccagaagggacaatagagataaaatttagaacaaaagagctattagagtgcatgggaaggttggaccagaagctaatcagtctgaaagcaaaactgcaagatgccaagcaaagcgaggcctatgcaaacatcgagcttctccagcaacagattaaagcccgagagaaacagcttttaccagtttatatccaaatcgccaccaaatttgcagaacttcatgacacttccatgagaatggctgcaaagggagtgatcaaaagtgttgtggaatggagcggctcgcggtccttcttctacaaaaagctcaataggagaatcgctgagagctctcttgtgaaaaacgtaagagaagcatctggagacaacttagcatataaatcttcaatgcgtctgattcaggattggttctgcaactctgatattgcaaaggggaaagaagaagcttggacagacgaccaagtgttctttacatggaaggacaatgttagtaactacgagttgaagctgagcgagttgagagcgcagaaactactgaaccaacttgcagagattgggaattcctcagatttgcaagctctgccacaaggacttgctaatcttctaaacaaggtggagccgtcgaaaagagaagagctggtggctgctattcgaaaggtcttgggttga

SEQ ID NO: 4761 - protein, 2254 aa, Arabidopsis thaliana
MAGSVNGNHSAVGPGINYETVSQVDEFCKALRGKRPIHSILIANNGMAAVKFIRSVRTWAYETFGTEKAILLVGMATPEDMRINAEHIRIADQFVEVPGGTNNNNYANVQLIVEMAEVTRVDAVWPGWGHASENPELPDALDAKGIIFLGPPASSMAALGDKIGSSLIAQAADVPTLPWSGSHVKIPPNSNLVTIPEEIYRQACVYTTEEAIASCQVVGYPAMIKASWGGGGKGIRKVHNDDEVRALFKQVQGEVPGSPIFIMKVASQSRHLEVQLLCDKHGNVSALHSRDCSVQRRHQKIIEEGPITVAPPETVKKLEQAARRLAKSVNYVGAATIEYLYSMDTGEYYFLELNPRLQVEHPVTEWIAEINLPAAQVAVGMGIPLWQIPEIRRFYGIEHGGGYDSWRKTSVVAFPFDFDKAQSIRPKGHCVAVRVTSEDPDDGFKPTSGRVQELSFKSKPNVWAYFSVKSGGGIHEFSDSQFGHVFAFGESRALAIANMVLGLKEIQIRGEIRTNVDYTIDLLHASDYRDNKIHTGWLDSRIAMRVRAERPPWYLSVVGGALYKASATSAAVVSDYVGYLEKGQIPPKHISLVHSQVSLNIEGSKYTIDVVRGGSGTYRLRMNKSEVVAEIHTLRDGGLLMQLDGKSHVIYAEEEAAGTRLLIDGRTCLLQNDHDPSKLMAETPCKLMRYLISDNSNIDADTPYAEVEVMKMCMPLLSPASGVIHFKMSEGQAMQAGELIANLDLDDPSAVRKAEPFHGSFPRLGLPTAISGRVHQRCAATLNAARMILAGYEHKVDEVVQDLLNCLDSPELPFLQWQECFAVLATRLPKNLRNMLESKYREFESISRNSLTTDFPAKLLKGILEAHLSSCDEKERGALERLIEPLMSLAKSYEGGRESHARVIVHSLFEEYLSVEELFNDNMLADVIERMRQLYKKDLLKIVDIVLSHQGIKNKNKLVLRLMEQLVYPNPAAYRDKLIRFSTLNHTNYSELALKASQLLEQTKLSELRSNIARSLSELEMFTEDGENMDTPKRKSAINERIEDLVSASLAVEDALVGLFDHSDHTLQRRVVETYIRRLYQPYVVKDSVRMQWHRSGLLASWEFLEEHMERKNIGLDDPDTSEKGLVEKRSKRKWGAMVIIKSLQFLPSIISAALRETKHNDYETAGAPLSGNMMHIAIVGINNQMSLLQDSGDEDQAQERVNKLAKILKEEEVSSSLCSAGVGVISCIIQRDEGRTPMRHSFHWSLEKQYYVEEPLLRHLEPPLSIYLELDKLKGYSNIQYTPSRDRQWHLYTVTDKPVPIKRMFLRSLVRQATMNDGFILQQGQDKQLSQTLISMAFTSKCVLRSLMDAMEELELNAHNAAMKPDHAHMFLCILRDEQIDDLVPFPRRVEVNAEDEETTVEMILEEAAREIHRSVGVRMHRLGVCEWEVRLWLVSSGLACGAWRVVVANVTGRTCTVHIYREVETPGRNSLIYHSITKKGPLHETPISDQYKPLGYLDRQRLAARRSNTTYCYDFPLAFGTALELLWASQHPGVKKPYKDTLINVKELVFSKPEGSSGTSLDLVERPPGLNDFGMVAWCLDMSTPEFPMGRKLLVIANDVTFKAGSFGPREDAFFLAVTELACAKKLPLIYLAANSGARLGVAEEVKACFKVGWSDEISPENGFQYIYLSPEDHERIGSSVIAHEVKLSSGETRWVIDTIVGKEDGIGVENLTGSGAIAGAYSKAYNETFTLTFVSGRTVGIGAYLARLGMRCIQRLDQPIILTGFSTLNKLLGREVYSSHMQLGGPKIMGTNGVVHLTVSDDLEGVSAILNWLSYIPAYVGGPLPVLAPLDPPERIVEYVPENSCDPRAAIAGVKDNTGKWLGGIFDKNSFIETLEGWARTVVTGRAKLGGIPVGVVAVETQTVMQIIPADPGQLDSHERVVPQAGQVWFPDSAAKTAQALMDFNREELPLFILANWRGFSGGQRDLFEGILQAGSTIVENLRTYRQPVFVYIPMMGELRGGAWVVVDSQINSDYVEMYADETARGNVLEPEGTIEIKFRTKELLECMGRLDQKLISLKAKLQDAKQSEAYANIELLQQQIKAREKQLLPVYIQIATKFAELHDTSMRMAAKGVIKSVVEWSGSRSFFYKKLNRRIAESSLVKNVREASGDNLAYKSSMRLIQDWFCNSDIAKGKEEAWTDDQVFFTWKDNVSNYELKLSELRAQKLLNQLAEIGNSSDLQALPQGLANLLNKVEPSKREELVAAIRKVLG

SEQ ID NO: 4762 - DNA, 6783 bp, Triticum aestivum
  CDS (1)..(6783): y means t/u or c
atggtggaatctgaccaaataaacgggacgcccaacaggatgtcctcggtcgatgaattctgtaaagcgctcgggggtgactcgccgatacacagcgtgctggttgccaacaatgggatggctgcggtcaaattcatgcgcagcatccgcacctgggccttggagacctttgggaacgagaaggccattctcttggtggctatggcaactccagaggacctcaggataaatgcggagcacataagaatcgccgaccagttcttagaagttcctggtggaacgaacaataacaactatgcaaatgtacagctcatagtggagatagcagagagaactcgggtttctgcagtttggcctggctggggtcatgcttctgagaacccagaacttccagacgcgctcatggaaaagggaatcatttttcttgggccaccatcagccgcgatgggggcactaggcgataagattggttcttctcttattgcacaagcagcaggagttccaactcttccatggagcgggtcacatgtgaaagttccgcaagaaacctgccactcaatacctgaggagatctataagaacgcttgtgtttcaactacagacgaagcagttgctagttgtcaggtggtggggtatcctgcaatgatcaaggcatcatggggcgggggtggtaaaggaataaggaaggtacataatgatgatgaggtcagagcattgtttaagcaagtgcaaggagaagtccccggatcgcctatatttattatgaaggtggcatctcagagccgacatctagaggttcagttgctctgtgacaagcatggcaacgtggcagcactgcacagtcgagactgtagtgttcaaagaaggcaccaaaagatcattgaggagggaccaattacagttgctcctccagaaacaattaaagagcttgagcaggcagcaaggcggcttgctaaatgtgtgcaatatcagggtgctgctacagtagaatatctgtacagcatggaaacaggcgaatactatttcctggagcttaatccaaggttgcaggtagaacaccctgtgaccgaatggattgctgaaataaacttacctgcatctcaagttgtagtaggaatgggcataccactctacaacattccagagatcagacgcttttatggaatagaacatggaggtggctatcacgcttggaaggaaatatcagctgttgcaactaaatttgatctggacaaagcacagtctgtaaagccaaagggtcattgtgtagcagttagagttactagcgaggatccagatgatgggtttaagcctacaagtggaagagtggaagagctgaactttaaaagtaaacccaatgtttgggcctatttctctgttaagtccggaggtgcaattcatgagttctctgattcccagtttggtcatgtttttgcttttggggaatctaggtcattggcaatagccaatatggtacttgggttaaaagagatccaaattcgtggagagatacgcactaatgttgactacactgtggatctcttgaatgctgcagagtaccgagaaaataagattcacactggttggctagacagcagaatagcaatgcgtgttagagcagagaggcccccatggtacctttcagttgttggtggagctctatatgaagcatcaagcaggagctcgagtgttgtaaccgattatgttggttatctcagtaaaggtcaaataccaccaaagcacatctctcttgtcaatttgactgtaacactgaatatagatgggagcaaatatacgattgagacagtacgaggtggaccccgtagctacaaattaagaattaatgaatcagaggttgaagcagagatacattcgctgcgagatggcggactcttaatgcagttggatggaaacagtcatgtaatttacgccgagacagaagctgctggcacgcgtcttctaatcaatgggagaacatgcttattacagaaagagcatgatccttccaggttgttggctgatacaccatgcaagcttcttcggtttttggtcgcggatggttctcatgtggttgctgatacgccatatgctgaggtggaggtgatgaaaatgtgcatgccactgttactaccggcctctggtgtcattcactttgtcatgcctgagggtcaggccatgcaggcgagtgatctgatagcaaggttggatcttgatgacccatcttctgtgagaagggctgaaccatttcatggcacctttccaaaacttggacctcctactgctatttctggcaaagttcaccaaaagtttgctgcaagtgtgaattctgcccacatgatccttgcaggatatgaacataacatcaatcatgttgtacaagatttgctgaactgcctagacagccctgagctccctttcctgcagtggcaagaactcatgtccgttttggcaacccgactcccgaaagatcttaggaatgagttggatgctaagtacaaggagtatgagttgaatgctgacttccggaagagcaaggatttccctgccaagttgctaaggggagtcattgaggctaatcttgcatactgttccgagaaagatagggtcactagtgagaggcttgtagagccacttatgagtctggtcaagtcatatgagggtggaagagaaagccatgctcgtgcggttgtcaagtctctgtttgaggagtatttatctgttgaagaactcttcagcgatgacattcagtctgatgtgatagaacgtctacgacttcaacatgcaaaagaccttgagaaggtcgtatatattgtgttctcccaccagggtgtgaaaagtaaaaataaattaatactacggcttatggaagcattggtctatccaaatccatctgcatacagggaccagttgattcgcttctctgccctgaaccatacagcatactcggggctggcgcttaaagcaagccaacttcttgagcacaccaaattgagtgaactccgcacaagcatagcaagaagcctttcagagctggagatgtttactgaggaaggagagcggatttcaacacctaggaggaagatggctatcaatgaaaggatggaagatttagtatgtgcaccggttgcagttgaagacgcccttgtggctttgtttgatcacagtgatcctactcttcagcggagagtagtcgagacatacatacgcagattgtatcagcattatcttgcaaggggcagcgtccggatgcaatggcataggtctggtctaattgctttatgggaattctctgaagagcatattgaacaaagaaatgggcaatctgcgtcacttctaaagccacaagtagaggatccaattggcaggcgatggggtgtaatggttgtaatcaagtctcttcagcttctgtcaactgcaattgaagctgcattaaaggagacttcacactacggagcaggtgttggaagtgtctcaaatggtaatcctataaatttgaacggcagcaatatgctgcacattgctctggttggtatcaacaatcagatgagcactcttcaagacagtggtgatgaggatcaagcgcaagaaaggatcaacaaactctccaagattttgaaggataacactataacatcacatctcaatggtgctggtgttagggttgtcagctgcattatccaaagagatgaagggcgttcaccaatgcgccactccttcaaatggtcatctgacaagttatattatgaggaggacccgatgctccgccatgtggaatctcctttgtccaccttccttgaattggacaaagtgaatttagaaggttacaatgacgcgaaatacaccccatcacgtgatcgccagtggcacatgtacacactagtaaagaacaagaaagatccgagatcaaatgaccaaaggatgtttcttcgtaccatagtcagacagccaagtgtgaccaatgggtttttgtttggaagtattgataatgaagttcaagcctcgtcatcattcacatctaacagcatactcagatcattgatggcagctctagaagaaatagagttgcgtgctcacagtgagactgggatgtcaggccactcccacatgtatctgtgcataatgagagaacaacggttgtttgatctaattccatcttcaaggatgacgaatgaagttggtcaagatgagaagacagcatgcacactattgaagcatatggttatgaatatatatgagcatgttggtgtcaggatgcatcgcctttccgtgtgccagtgggaagtgaagctatggttggattgtgatgggcaggctaatggtgcttggagagttgttgttaccagtgtaactggcaatacctgcactgttgatatttaccgagaagtggaggaccccaatacacataagcttttctatcgctctgccacacccacagctggtcctttgcatggcattgcattgcatgagccatacaaacctttggatgctattgacctgaaacgtgccgctgctaggaaaaatgaaaccacatactgctatgatttcccattggcatttgaaacagcattgaagaagtcatgggaatctggtatttcacatgttgcagaatctaatgagcataaccagcggtatgctgaagtgacagagcttatatttgctgattcaactggatcatggggtactcctttggttccagttgagcgtcctccaggtagcaacaattttggtgttgttgcttggaacatgaagctctccacaccagaatttccaggtggccgggagattatagttgttgcaaatgatgtgacatttaaagctgggtcttttggtcctagagaagatgcattctttgatgctgtcacaaatcttgcttgtgagaggaaaattcctctaatctacttgtcagcaactgctggtgcaaggctcggtgtagcagaggaaataaaggcatgcttccatgttggatggtctgatgaccagagccctgaacgtggttttcactacatttacctcactgaacaagattattcacgtctaagctcttcagttatagcccatgagctaaaagtaccagaaagcggagaaaccagatgggttgttgataccattgttgggaaagaggacggacttggttgtgagaatctacatggaagtggtgccattgccagtgcctactctaaggcatatagagagacatttactctgacatttgtgactggccgagctattggaattggggcctatcttgctcggttaggaatgcggtgtatacaacgtcttgatcaaccaattattttgactgggtattctgcactgaacaagctcctggggcgcgaggtttatagctctcagatgcaactgggtggccccaaaatcatggctacaaatggagttgttcatctcactgtgtcagatgatcttgaaggtgtttctgctatcttgaaatggctcagctatgttcctccctatgttggtggtcctcttcctattgtaaaatctcttgatccaccagagagagctgtaacatactttccagagaattcatgtgatgcccgtgctgccatctgtggcattcaggacactcaaggcaagtggttgagtggtatgtttgacagagaaagctttgtggaaacgttagaaggatgggccaaaactgttattacyggaagggcaaagctgggtgggattccagttggtatcatagctgtggaaaccgagacagtgatgcaagtaatccctgctgaccctggtcagcttgattctgccgagcgtgtagtccctcaagckggacaggtgtggttcccagattcggccgcaaaaacrgcccaggcactgctggatttcaaccgtgaagagctcccgttgttcatacttgctaactggagaggcttttctggtgggcaaagggatctgtttgaaggaatccttcaggctggtyctatgattgttgagaatctgaggacgtayaagcagcctgcttttgtgtacataccaaaggctggagagctgcgtggaggtgcatgggttgtggtggacagcaagatcaatccggagcacattgagatgtatgccgagaggactgcgagagggaatgtccttgaggcaccgggactcattgagatcaaattcaagccaaatgaattggaagagagtatgctagggctggaccctgagttgatcagcctcaatgctaaactcctcaaagaaactagtgctagccctagcccttgggaaacggcggcggcggcagagaccatcaggaggagcatggctgctcggaggaagcagctgatgcccatatatactcaggttgccacccggtttgctgagttgcacgacacctccgcaagaatggctgccaaaggcgtgatcagtaaggtggtggactgggaggagtcccgggccttcttctacaggagactgcgaaggaggcttgccgaggactcgctcgccaaacaagtcagagaagccgccggcgagcagcagatgcccactcacagatcagccttggagtgcatcaggaaatggtacctggcctctcaaggaggagacggcgagaagtggggcgatgatgaagccttcttcacctggaaagatgatcctgacaagtatggcaagtatcttgaggagctgaaagccgagagagcgtctacactgctgtcgcatctcgctgaaacctcggacgccaaggccttgcccaacggtctctcgctcctcctcagcaaaatggatcctgcaaagagggagcaggttatggatggcctcaggcagcttcttggttga

SEQ ID NO: 4763 - protein, 2260 aa, Triticum aestivum
  misc_feature (1980)..(1980): Xaa can be Ser or Pro
MVESDQINGTPNRMSSVDEFCKALGGDSPIHSVLVANNGMAAVKFMRSIRTWALETFGNEKAILLVAMATPEDLRINAEHIRIADQFLEVPGGTNNNNYANVQLIVEIAERTRVSAVWPGWGHASENPELPDALMEKGIIFLGPPSAAMGALGDKIGSSLIAQAAGVPTLPWSGSHVKVPQETCHSIPEEIYKNACVSTTDEAVASCQVVGYPAMIKASWGGGGKGIRKVHNDDEVRALFKQVQGEVPGSPIFIMKVASQSRHLEVQLLCDKHGNVAALHSRDCSVQRRHQKIIEEGPITVAPPETIKELEQAARRLAKCVQYQGAATVEYLYSMETGEYYFLELNPRLQVEHPVTEWIAEINLPASQVVVGMGIPLYNIPEIRRFYGIEHGGGYHAWKEISAVATKFDLDKAQSVKPKGHCVAVRVTSEDPDDGFKPTSGRVEELNFKSKPNVWAYFSVKSGGAIHEFSDSQFGHVFAFGESRSLAIANMVLGLKEIQIRGEIRTNVDYTVDLLNAAEYRENKIHTGWLDSRIAMRVRAERPPWYLSVVGGALYEASSRSSSVVTDYVGYLSKGQIPPKHISLVNLTVTLNIDGSKYTIETVRGGPRSYKLRINESEVEAEIHSLRDGGLLMQLDGNSHVIYAETEAAGTRLLINGRTCLLQKEHDPSRLLADTPCKLLRFLVADGSHVVADTPYAEVEVMKMCMPLLLPASGVIHFVMPEGQAMQASDLIARLDLDDPSSVRRAEPFHGTFPKLGPPTAISGKVHQKFAASVNSAHMILAGYEHNINHVVQDLLNCLDSPELPFLQWQELMSVLATRLPKDLRNELDAKYKEYELNADFRKSKDFPAKLLRGVIEANLAYCSEKDRVTSERLVEPLMSLVKSYEGGRESHARAVVKSLFEEYLSVEELFSDDIQSDVIERLRLQHAKDLEKVVYIVFSHQGVKSKNKLILRLMEALVYPNPSAYRDQLIRFSALNHTAYSGLALKASQLLEHTKLSELRTSIARSLSELEMFTEEGERISTPRRKMAINERMEDLVCAPVAVEDALVALFDHSDPTLQRRVVETYIRRLYQHYLARGSVRMQWHRSGLIALWEFSEEHIEQRNGQSASLLKPQVEDPIGRRWGVMVVIKSLQLLSTAIEAALKETSHYGAGVGSVSNGNPINLNGSNMLHIALVGINNQMSTLQDSGDEDQAQERINKLSKILKDNTITSHLNGAGVRVVSCIIQRDEGRSPMRHSFKWSSDKLYYEEDPMLRHVESPLSTFLELDKVNLEGYNDAKYTPSRDRQWHMYTLVKNKKDPRSNDQRMFLRTIVRQPSVTNGFLFGSIDNEVQASSSFTSNSILRSLMAALEEIELRAHSETGMSGHSHMYLCIMREQRLFDLIPSSRMTNEVGQDEKTACTLLKHMVMNIYEHVGVRMHRLSVCQWEVKLWLDCDGQANGAWRVVVTSVTGNTCTVDIYREVEDPNTHKLFYRSATPTAGPLHGIALHEPYKPLDAIDLKRAAARKNETTYCYDFPLAFETALKKSWESGISHVAESNEHNQRYAEVTELIFADSTGSWGTPLVPVERPPGSNNFGVVAWNMKLSTPEFPGGREIIVVANDVTFKAGSFGPREDAFFDAVTNLACERKIPLIYLSATAGARLGVAEEIKACFHVGWSDDQSPERGFHYIYLTEQDYSRLSSSVIAHELKVPESGETRWVVDTIVGKEDGLGCENLHGSGAIASAYSKAYRETFTLTFVTGRAIGIGAYLARLGMRCIQRLDQPIILTGYSALNKLLGREVYSSQMQLGGPKIMATNGVVHLTVSDDLEGVSAILKWLSYVPPYVGGPLPIVKSLDPPERAVTYFPENSCDARAAICGIQDTQGKWLSGMFDRESFVETLEGWAKTVITGRAKLGGIPVGIIAVETETVMQVIPADPGQLDSAERVVPQAGQVWFPDSAAKTAQALLDFNREELPLFILANWRGFSGGQRDLFEGILQAGXMIVENLRTYKQPAFVYIPKAGELRGGAWVVVDSKINPEHIEMYAERTARGNVLEAPGLIEIKFKPNELEESMLGLDPELISLNAKLLKETSASPSPWETAAAAETIRRSMAARRKQLMPIYTQVATRFAELHDTSARMAAKGVISKVVDWEESRAFFYRRLRRRLAEDSLAKQVREAAGEQQMPTHRSALECIRKWYLASQGGDGEKWGDDEAFFTWKDDPDKYGKYLEELKAERASTLLSHLAETSDAKALPNGLSLLLSKMDPAKREQVMDGLRQLLG

SEQ ID NO: 4764 - DNA, 3375 bp, Mycobacterium tuberculosis
  CDS (1)..(3375)
atgttttccaaggtgctcgtcgccaatcgcggggagatcgcgatccgggcctttcgtgccgcctacgaactgggcgtcggaaccgtggccgtttatccgtacgaggaccgcaattcgcagcaccgtctcaaggcggacgagtcttaccagatcggcgacatcggtcacccggtgcatgcatacctgtcggtcgacgagatcgtcgcgacggcccgtcgggcgggtgccgacgctatctaccctggctacgggtttctatcggagaatccggatctggctgcggcatgcgcggcggcgggcatcagcttcgtcggtcccagcgccgaagtgcttgagctggctgggaataagtctcgcgccatcgcggcggcccgcgaagccggcttgcccgtgctgatgtcctcggcgccgtcggcctcggtcgacgaactgctgtcggttgcggccggcatgccgtttccgttgttcgtcaaggcagttgccggtggcgggggccggggtatgcgtcgtgtcggcgatatcgcggcgcttccggaggcgatcgaagccgccagccgggaagccgagtcggcgttcggggacccgacggtctatctcgagcaggcagtgatcaatccacgccacatcgaggtgcagattctggcggacaacctcggcgacgtgatccatctctatgagcgtgactgcagtgtgcagcgtcgccatcagaaggtcatcgagctggcgcccgcgccgcacctggacgccgagttgcgttacaagatgtgcgtcgatgcggtcgccttcgcccgccatatcgggtacagctgcgcgggcaccgtcgagttcctgctggacgagcgaggggagtatgtcttcatcgagatgaatccgcgggttcaggtggagcacacggtgaccgaggagattaccgacgtcgacctggtcgccagccagctgcgcattgccgccggggagacgctcgaacaattgggcctgcggcaggaggacatcgcaccgcatggcgccgcactacagtgccggatcaccaccgaggatccggccaacggcttccggccgacacgggccggatcagcgcgttgcgacccgccggcggtgccggtgtccgcctggacggcagcaccaacctggcgcagaaatcagcccgtacttcgactccatgctggtcaagctgacctgtcgggccgtgacctccctaccgcagtgagccgtgcgcgccgggcgatcgcggagttccggatccgcggggtatcgacgaatattccgttcctgcaagcggtcctggatgacccggacttccgagcgggccgggtcaccacgtccttcattgatgagcggccgcagctgctgaccgcgcgcgcctcggccgaccgcggcaccaagatccttaacttcctggccgatgtcaccgtcaacaacccgtatggctcgcgtccgtcaacgatctacccggacgacaagctgcccgatcttgatctgcgggccgcaccaccggccgggtccaagcagcgactagtcaagttggggccggaaggatttgctcgttggctgcgggagtcggccgcggtcggggtcaccgataccacattccgggatgctcaccagtcgttactggctacccgagtacgcaccagcggactgtcgcgggtggcaccgtatctcgcgcggaccatgccgcagctgttgtccgtggagtgttggggcggtgcgacttacgatgtggcgctgcgctttctcaaggaggatccctgggaacggctggccacactgcgtgcagcaatgcccaatatctgcttgcagatgctattgcggggccgcaataccgtgggctacacgccgtacccggaaatcgtgacgtcggcgtttgtgcaagaagcaacagccaccggtatcgacatctttcgtatcttcgacgcgctcaacaacatcgagtcgatgcgtccggcgatcgacgcagtacgcgaaacaggttctgcgatagcagaagtcgcgatgtgctacacgggcgaccttaccgatccgggtgaacagctgtacacgctggactactacctgaaactggctgagcagatcgtggacgccggcgcccatgtgctggcgatcaaggatatggctggactgttgcgcccgccggccgctcaaaggttggtcagcgccctgcgcagtcgcttcgacctgcccgttcacctgcacacccacgacacaccgggtggccagctcgccagctatgtggccgcttggcacgccggggccgatgccgtcgacggcgccgccgcgccgctggcgggaacgaccagccagcccgcgctgagctcgatcgttgctgccgctgcccacaccgagtacgacaccggcctgtcgctttcggcggtgtgcgccctggagccgtactgggaggcgttacgaaaagtgtatgcgccgttcgagtctgggttgccggggccgacggggcgggtttatcaccacgagattccgggcggccaactgtccaatctgcgccagcaagcaattgctcttggtctgggagatcgattcgaagagatcgaagaggcctacgcgggcgccgaccgagtgttgggcaggctggttaaggtcacgccaacgtccaaggtggtcggcgatctggcgctggcactggtcggcgccggtgtcagtgcagacgaattcgcctccgatccagcgcgatttggcatcccggaatcggtactcggatttctgcggggcgagctgggtgatccgcccggcgggtggcccgaaccgctgcgcactgcggcgctggccggtcgcggggcggccaggcccactgcgcaattggcggcggacgacgagattgccctatcgtcggtcggagccaagcgtcaggccaccctgaacaggctgttatttcccagtccaacaaaggaattcaatgagcaccgggaagcctacggcgacacgtcgcaattgtcggccaaccagttcttctatggtctgcgccaaggtgaagagcatcgggtgaagctggagcgtggggtggagctgttgatcgggctggaggccatttccgaacccgacgaacgcggcatgcgaacggtgatgtgcatcctcaacgggcagctgcggccggtgctagtgcgcgaccgcagcattgccagtgccgttccggccgccgagaaggccgaccgcggcaatcccggacacatcgccgcgccatttgccggagtcgtcacggtcggggtgtgcgtcggcgagcgggtcggcgccggccaaaccatcgccaccatcgaggcgatgaagatggaagccccgatcaccgccccggttgccggcaccgtggagcgggtggcggtgtcggacaccgcagagtggagggcggagacctgttggtggtggtga

SEQ ID NO: 4765 - protein, 1124 aa, Mycobacterium tuberculosis
MFSKVLVANRGEIAIRAFRAAYELGVGTVAVYPYEDRNSQHRLKADESYQIGDIGHPVHAYLSVDEIVATARRAGADAIYPGYGFLSENPDLAAACAAAGISFVGPSAEVLELAGNKSRAIAAAREAGLPVLMSSAPSASVDELLSVAAGMPFPLFVKAVAGGGGRGMRRVGDIAALPEAIEAASREAESAFGDPTVYLEQAVINPRHIEVQILADNLGDVIHLYERDCSVQRRHQKVIELAPAPHLDAELRYKMCVDAVAFARHIGYSCAGTVEFLLDERGEYVFIEMNPRVQVEHTVTEEITDVDLVASQLRIAAGETLEQLGLRQEDIAPHGAALQCRITTEDPANGFRPTRAGSARCDPPAVPVSAWTAAPTWRRNQPVLRLHAGQADLSGRDLPTAVSRARRAIAEFRIRGVSTNIPFLQAVLDDPDFRAGRVTTSFIDERPQLLTARASADRGTKILNFLADVTVNNPYGSRPSTIYPDDKLPDLDLRAAPPAGSKQRLVKLGPEGFARWLRESAAVGVTDTTFRDAHQSLLATRVRTSGLSRVAPYLARTMPQLLSVECWGGATYDVALRFLKEDPWERLATLRAAMPNICLQMLLRGRNTVGYTPYPEIVTSAFVQEATATGIDIFRIFDALNNIESMRPAIDAVRETGSAIAEVAMCYTGDLTDPGEQLYTLDYYLKLAEQIVDAGAHVLAIKDMAGLLRPPAAQRLVSALRSRFDLPVHLHTHDTPGGQLASYVAAWHAGADAVDGAAAPLAGTTSQPALSSIVAAAAHTEYDTGLSLSAVCALEPYWEALRKVYAPFESGLPGPTGRVYHHEIPGGQLSNLRQQAIALGLGDRFEEIEEAYAGADRVLGRLVKVTPTSKVVGDLALALVGAGVSADEFASDPARFGIPESVLGFLRGELGDPPGGWPEPLRTAALAGRGAARPTAQLAADDEIALSSVGAKRQATLNRLLFPSPTKEFNEHREAYGDTSQLSANQFFYGLRQGEEHRVKLERGVELLIGLEAISEPDERGMRTVMCILNGQLRPVLVRDRSIASAVPAAEKADRGNPGHIAAPFAGVVTVGVCVGERVGAGQTIATIEAMKMEAPITAPVAGTVERVAVSDTAEWRAETCWWW

SEQ ID NO: 4766 - DNA, 1362 bp, Synechococcus sp
  CDS (1)..(1362)
atgcgtttcaacaagatcctgatcgccaatcgcggcgaaatcgccctgcgcattctccgcacttgtgaagaactcgggatcggcacgatcgccgttcactccactgtggatcgcaacgcgctccatgtgcagttagcggacgaagcggtctgtattggcgaagcggccagcagcaaaagctatctcaatatccccaacatcattgcggcggccctgacccgtaatgccagcgccattcaccccggctatggcttcttggcggagaatgcccgctttgcagaaatctgcgccgatcaccatctcacctttattggccccagccccgattcgattcgagccatgggcgataaatccaccgctaaggaaacaatgcagcgggtcggcgttccgacgattccgggcagtgacggtctgctgacggatgttgattcggctgccaaagttgctgccgagatcggctatcccgtcatgatcaaagcgacggcggggggcggtggtcgcggtatgcggctggtgcgtgagcctgcagatctggaaaaactgttccttgctgcccaaggagaagccgaggcagcttttgggaatccaggactgtatctcgaaaaatttatcgatcgcccacgccacgttgaatttcagatcttggccgatgcctacggcaatgtagtgcatctaggcgagcgcgattgctccattcaacgtcgtcaccaaaagctgctcgaagaagcccccagtccggcgctatcggcagacctgcggcagaaaatgggcgatgccgccgtcaaagtcgctcaagcgatcggctacatcggtgccggcaccgtggagtttctggtcgatgcgaccggcaacttctacttcatggagatgaatacccgcatccaagtcgagcatccagtcacagaaatgattacgggactggacttgattgcggagcagattcggattgcccaaggcgaagcgctgcgcttccggcaagccgatattcaactgcgcggccatgcgatcgaatgccgtatcaatgcggaagatccggaatacaatttccggccgaatcctggccgcattacaggctatttaccgcccggcggccccggcgttcgtgtcgattcccatgtttataccgactacgaaattccgccctattacgattcgctgattggcaaattgattgtctggggtgcaacacgggaagaggcgatcgcgcggatgcagcgtgctctgcgggaatgcgccatcaccggcttgccgacgacccttagtttccatcagctgatgttgcagatgcctgagttcctgcgcggggaactctataccaactttgttgagcaggtgatgctacctcggatcctcaagtcctag

SEQ ID NO: 4767 - protein, 453 aa, Synechococcus sp
MRFNKILIANRGEIALRILRTCEELGIGTIAVHSTVDRNALHVQLADEAVCIGEAASSKSYLNIPNIIAAALTRNASAIHPGYGFLAENARFAEICADHHLTFIGPSPDSIRAMGDKSTAKETMQRVGVPTIPGSDGLLTDVDSAAKVAAEIGYPVMIKATAGGGGRGMRLVREPADLEKLFLAAQGEAEAAFGNPGLYLEKFIDRPRHVEFQILADAYGNVVHLGERDCSIQRRHQKLLEEAPSPALSADLRQKMGDAAVKVAQAIGYIGAGTVEFLVDATGNFYFMEMNTRIQVEHPVTEMITGLDLIAEQIRIAQGEALRFRQADIQLRGHAIECRINAEDPEYNFRPNPGRITGYLPPGGPGVRVDSHVYTDYEIPPYYDSLIGKLIVWGATREEAIARMQRALRECAITGLPTTLSFHQLMLQMPEFLRGELYTNFVEQVMLPRILKS

SEQ ID NO: 4768 - DNA, 3800 bp, Rhizobium etli
  CDS (150)..(3614)
atcgctgcatactgccggccgacaggctctggcatggcgagaaagtgcatttcgcagtcgcaagagaaattgaacttcccgtgacaagaagttaagaattttcttcgcgggtgcagcatgcccgcgtctgaacgacggaggagaccgttatgcccatatccaagatactcgttgccaatcgctctgaaatagccatccgcgtgttccgcgcggccaacgagcttggaataaaaacggtggcgatctgggcggaagaggacaagctggcgctgcaccgcttcaaggcggacgagagttatcaggtcggccgcggaccgcatcttgcccgcgacctcgggccgatcgaaagctatctgtcgatcgacgaggtgatccgcgtcgccaagctttccggtgccgacgccatccatccgggctacggcctcttgtcggaaagccccgaattcgtcgatgcctgcaacaaggccggcatcatcttcatcggcccgaaggccgatacgatgcgccagcttggcaacaaggtcgcagcgcgcaacctggcgatctcggtcggcgtaccggtcgtgccggcgaccgagccactgccggacgatatggccgaagtggcgaagatggcggcggcgatcggctatcccgtcatgctgaaggcatcctggggcggcggcggtcgcggcatgcgcgtcattcgttccgaggccgacctcgccaaggaagtgacggaagccaagcgcgaggcgatggcggccttcggcaaggacgaggtctatctcgaaaaactggtcgagcgcgcccgccacgtcgaaagccagatcctcggcgacacccacggcaatgtcgtgcatctcttcgagcgcgactgttccgttcagcgccgcaatcagaaggtcgtcgagcgcgcgcccgcaccctatctttcggaagcgcagcgccaggaactcgccgcctattcgctgaagatcgcaggggcgaccaactatatcggcgccggcaccgtcgaatatctgatggatgccgataccggcaaattttacttcatcgaagtcaatccgcgcatccaggtcgagcacacggtgaccgaagtcgtcaccggcatcgatatcgtcaaggcgcagatccacatcctggacggcgccgcgatcggcacgccgcaatccggcgtgccgaaccaggaagacatccgtctcaacggtcacgccctgcagtgccgcgtgacgacggaagatccggagcacaacttcattccggattacggccgcatcaccgcctatcgctcggcttccggcttcggcatccggcttgacggcggcacctcttattccggcgccatcatcacccgctattacgatccgctgctcgtcaaggtcacggcctgggcgccgaacccgctggaagccatttcccgcatggaccgggcgctgcgcgaattccgcatccgtggcgtcgccaccaacctgaccttcctcgaagcgatcatcggccatccgaaattccgcgacaacagctacaccacccgcttcatcgacacgacgccggagctcttccagcaggtcaagcgccaggaccgcgcgacgaagcttctgacctatctcgccgacgtcaccgtcaatggccatcccgaggccaaggacaggccgaagcccctcgagaatgccgccaggccggtggtgccctatgccaatggcaacggggtgaaggacggcaccaagcagctgctcgatacgctcggcccgaaaaaattcggcgaatggatgcgcaatgagaagcgcgtgcttctgaccgacaccacgatgcgcgacggccaccagtcgctgctcgcaacccgcatgcgtacctatgacatcgccaggatcgccggcacctattcgcatgcgctgccgaacctcttgtcgctcgaatgctggggcggcgccaccttcgacgtctcgatgcgcttcctcaccgaagatccgtgggagcggctggcgctgatccgagagggggcgccgaacctgctcctgcagatgctgctgcgcggcgccaatggcgtcggttacaccaactatcccgacaatgtcgtcaaatacttcgtccgccaggcggccaaaggcggcatcgatctcttccgcgtcttcgactgcctgaactgggtcgagaatatgcgggtgtcgatggatgcgattgccgaggagaacaagctctgcgaggcggcgatctgctacaccggcgatatcctcaattccgcccgcccgaaatacgacttgaaatattacaccaaccttgccgtcgagcttgagaaggccggcgcccatatcattgcggtcaaggatatggcgggccttctgaagccggctgctgccaaggttctgttcaaggcgctgcgtgaagcaaccggcctgccgatccatttccacacgcatgacacctcgggcattgcggcggcaacggttcttgccgccgtcgaagccggtgtcgatgccgtcgatgcggcgatggatgcgctctccggcaacacctcgcaaccctgtctcggctcgatcgtcgaggcgctctccggctccgagcgcgatcccggcctcgatccggcatggatccgccgcatctccttctattgggaagcggtgcgcaaccagtatgccgccttcgaaagcgacctcaagggaccggcatcggaagtctatctgcatgaaatgccgggcggccagttcaccaacctcaaggagcaggcccgctcgctggggctggaaacccgctggcaccaggtggcgcaggcctatgccgacgccaaccagatgttcggcgatatcgtcaaggtgacgccatcctccaaggtcgtcggcgacatggcgctgatgatggtctcccaggacctgaccgtcgccgatgtcgtcagccccgaccgcgaagtctccttcccggaatcggtcgtctcgatgctgaagggcgatctcggccagcctccgtctggatggccggaagcgctgcagaagaaagcattgaagggcgaaaagccctatacggtgcgccccggctcgctgctcaaggaagccgatctcgatgcggaacgcaaagtcatcgagaagaagcttgagcgcgaggtcagcgacttcgaattcgcttcctatctgatgtatccgaaggtcttcaccgactttgcgcttgcctccgatacctacggtccggtttcggtgctgccgacgcccgcctatttttacgggttggcggacggcgaggagctgttcgccgacatcgagaagggcaagacgctcgtcatcgtcaatcaggcggtgagcgccaccgacagccagggcatggtcactgtcttcttcgagctcaacggccagccgcgccgtatcaaggtgcccgatcgggcccacggggcgacgggagccgccgtgcgccgcaaggccgaacccggcaatgccgcccatgtcggtgcgccgatgccgggcgtcatcagccgtgtctttgtctcttcaggccaggccgtcaatgccggcgacgtgctcgtctccatcgaggccatgaagatggaaaccgcgatccatgcggaaaaggacggcaccattgccgaagtgctggtcaaggccggcgatcagatcgatgccaaggacctgctggcggtttacggcggatgagcgaacggcacgaaaggtttcgttcgcccgtccttgtcaggtcgcgctgatcacccgattgtgtaaagtcaggctgttaaaaggccgactttttcgaaaggttagcggcctcctcgccttgcccggcggggaggctttttcgtaaacttgcgtgcctgcccccccaagatcaatcaggaaacgatt

SEQ ID NO: 4769 - protein, 1154 aa, Rhizobium etli
MPISKILVANRSEIAIRVFRAANELGIKTVAIWAEEDKLALHRFKADESYQVGRGPHLARDLGPIESYLSIDEVIRVAKLSGADAIHPGYGLLSESPEFVDACNKAGIIFIGPKADTMRQLGNKVAARNLAISVGVPVVPATEPLPDDMAEVAKMAAAIGYPVMLKASWGGGGRGMRVIRSEADLAKEVTEAKREAMAAFGKDEVYLEKLVERARHVESQILGDTHGNVVHLFERDCSVQRRNQKVVERAPAPYLSEAQRQELAAYSLKIAGATNYIGAGTVEYLMDADTGKFYFIEVNPRIQVEHTVTEVVTGIDIVKAQIHILDGAAIGTPQSGVPNQEDIRLNGHALQCRVTTEDPEHNFIPDYGRITAYRSASGFGIRLDGGTSYSGAIITRYYDPLLVKVTAWAPNPLEAISRMDRALREFRIRGVATNLTFLEAIIGHPKFRDNSYTTRFIDTTPELFQQVKRQDRATKLLTYLADVTVNGHPEAKDRPKPLENAARPVVPYANGNGVKDGTKQLLDTLGPKKFGEWMRNEKRVLLTDTTMRDGHQSLLATRMRTYDIARIAGTYSHALPNLLSLECWGGATFDVSMRFLTEDPWERLALIREGAPNLLLQMLLRGANGVGYTNYPDNVVKYFVRQAAKGGIDLFRVFDCLNWVENMRVSMDAIAEENKLCEAAICYTGDILNSARPKYDLKYYTNLAVELEKAGAHIIAVKDMAGLLKPAAAKVLFKALREATGLPIHFHTHDTSGIAAATVLAAVEAGVDAVDAAMDALSGNTSQPCLGSIVEALSGSERDPGLDPAWIRRISFYWEAVRNQYAAFESDLKGPASEVYLHEMPGGQFTNLKEQARSLGLETRWHQVAQAYADANQMFGDIVKVTPSSKVVGDMALMMVSQDLTVADVVSPDREVSFPESVVSMLKGDLGQPPSGWPEALQKKALKGEKPYTVRPGSLLKEADLDAERKVIEKKLEREVSDFEFASYLMYPKVFTDFALASDTYGPVSVLPTPAYFYGLADGEELFADIEKGKTLVIVNQAVSATDSQGMVTVFFELNGQPRRIKVPDRAHGATGAAVRRKAEPGNAAHVGAPMPGVISRVFVSSGQAVNAGDVLVSIEAMKMETAIHAEKDGTIAEVLVKAGDQIDAKDLLAVYGG

SEQ ID NO: 4770 - DNA, 1422 bp, Wolinella succinogenes
  CDS (1)..(1422)
atgttcaaaaagattttgatcgccaatcgaggagagatcgccgttagaattattcgcgcctgtaatgacctaaacattgagagcgtggctatctactcgcgagccgatcgcgattcgatgcatgtgaagatggcggatgagacccatgaaatcagcgaagatcctatcaagggctatctcgaccctgatcgtattatcgaagtcgccaagctaagcggtgcggaggccattcacccagggtatggatttttgagcgaaaatgctctttttgccaagaaagttgccgaggcgggtttggtttggattggccccaatagcgaagtaatcgccaagatgggtgataaaaatgcggccagagagatcatgcagaggcatggaatccccgtggttcccggaacagaaccgctcaacaaggagagcatggagagtatcaaacgccatgccaggcgtatcggttaccccgtgattcttaaagcaagcagcgggggaggcggaagagggattagggtcgttcaaaaagaggaggagctagaggatagcttcaacgcctgcaagcgcgaagcgatggcatttttcaaaaatgatgatgtattcatggaaaaatatgtccaaaaccccaagcacatagagtttcaaatcttagccgataattatggcaatgtgattcatttgatggagcgtgattgttcaattcagcgtcgccatcaaaaactcgtagagatcgcgccctctcctactatgagtgaagatttgcgtcgtcgcatgggagcggtcgcggtggcggcggccaaggcgacaggctattcaaacgcgggaacagtagagtttttggtggatgattacaataacttctacttcatggagatgaacacgcgaatccaagtggagcatggcgtcactgaagagatcactggattggatctgatcggtcgtcagattcggattgccagcggcgagattttggacatgaatcaaaacgatgtcctctgccaaggttttgccattgaggtgcgcatcaatgccgaggatgttaaaaatgactttgtcccttccccgggtaaaatcacctcctactacccagctcttggaccttttgtgcgagtggatagctgtatctacaaagattatacgattcccccctattatgattcgatggtcgccaaactcattgtgcgcgctactagttatgatttggccgttaacaagatgaagcgtgcccttggggagtttaccgtgaggggaatcaagaccaccatcccttttcttatcaacatttgtaaagatcgtgactttcgcaagggcaactttgacacctcctatctcgagaagaagatgggcgagcttatgcccaaagatatcgaagagcctgcggacattgcagccgtgatcgcagcggctattgcggcacgtgcgggtctttag

SEQ ID NO: 4771 - protein, 473 aa, Wolinella succinogenes
MFKKILIANRGEIAVRIIRACNDLNIESVAIYSRADRDSMHVKMADETHEISEDPIKGYLDPDRIIEVAKLSGAEAIHPGYGFLSENALFAKKVAEAGLVWIGPNSEVIAKMGDKNAAREIMQRHGIPVVPGTEPLNKESMESIKRHARRIGYPVILKASSGGGGRGIRVVQKEEELEDSFNACKREAMAFFKNDDVFMEKYVQNPKHIEFQILADNYGNVIHLMERDCSIQRRHQKLVEIAPSPTMSEDLRRRMGAVAVAAAKATGYSNAGTVEFLVDDYNNFYFMEMNTRIQVEHGVTEEITGLDLIGRQIRIASGEILDMNQNDVLCQGFAIEVRINAEDVKNDFVPSPGKITSYYPALGPFVRVDSCIYKDYTIPPYYDSMVAKLIVRATSYDLAVNKMKRALGEFTVRGIKTTIPFLINICKDRDFRKGNFDTSYLEKKMGELMPKDIEEPADIAAVIAAAIAARAGL

SEQ ID NO: 4772 - DNA, 3603 bp, Wolinella succinogenes
  CDS (1)..(3603)
atgtttcaaaaggttttgattgccaatcgtggcgagattgcctgccgcatcatacgcacacttcaacacctccaaatcgcttctgtggcgatctatacggacgctgatgccgattctttgcatgtggatttggcggatgaggcctattgtattggagaatctcttgtgagtgagagttatcttcaaggggcaaaaatcttagagattgccaagcgaagcggagcggaagcgattcatcccggatatggatttttgagtgaaaatgccgcctttgccagagcttgcgagagagagggaatcgtctttatcggacctagacccgaacagatggaatcctttgggctcaaacacaccgccagagagctggcgattcaaagcggagtgccactgcttccggggtcggggcttttgagtgatctcttggaggccaagagtgaagccaagcgtatcggttaccctgtgatgctcaaaagtactgctgggggcggaggcatcggaatgcagctctgctccaatgagcaagagctagaagaatcgttcctcacggtgaagcggttgagcgagaatcacttcgccaatagcggagtttttttggaaaaatatgtgagcacggcacaccatattgaggtgcaggtttttggagataggaagggaaaagtgacgattctaggggatcgggactgttcgcttcagcgccgaaaccaaaaagtggtcgaggagactcctgcgcctcacctaagccaagagtgccgagaatcgctctatgcgtgcgccaagaagctcatggagagtgtctcttatctctcggcgggcacggtagagttcatctacgatcctctagaacaaaagttctactttttggaggtgaacactcgattgcaggtggagcatggaatcaccgaagaggtgagtggggtggatttggtggagtggatggtgcatcaagcctatggactagacccctctagtccaatcactccccaaggtcacgcaatcgaggtgcgcctttatgccgaagaccccgcgaaaaacttccagccaagctcagggcttttaagtgaagttcgattccccaaaggggtgcgatgtgacactttcgtgcgaacgggggtggaggtctctccctattatgaccctatgattgccaagctcattgtcaaaggagagagtcgagaggaagcgatagagaagctctcccaagcccttcaagagaccaaagtggaaggaatcgtgaccaacttggactaccttcttggtgtcacccagtcggagacttttttgaaaggggcgcagagcacgagattcttgaatgattttgtcgtggaggggagggggattgatatcctctctccgggagcccaaacgagtgtacaagattatccgggtcgtgaagggtattgggatgtgggagtgcctccctcgggggcttttgattctttgagttttcgctacgccaatgcgctggtagggaatcatctagaggcggcaggcttggagatggtgatgagcgggccaacactacgattcaaccaagaggcgatcatagcgctatgcggagcggagattcaagccgagcttgaggggcagatcgtgccgatgaataaggccatgttgattcccaaaggagccacgctcaagctcaaaaaaatccaaggcgcagggctgcgtgcctatttggcaattcgcggggggattgatgtgcctctctatctagggagtcgttccaccttcaccttggggcgttttggaggccatgcgggaaggaatcttgtcgcaggagatcggctcaaggtggctagcatgatgcagggggaggcgaggtttgaggtttgtgctcccatgcgcccttggggcgaactctgggagattggcgtgctctatggtcctcatggggcgcctgattttttcaccaataaagatatagagcgattctttgaggcggagtgggaggtgcatttcaattccaaccgcacaggtgtgcgcctcattggccctaagcctgattgggcgaggagagatgggggcgaggcgggcttgcatccctctaatattcacgacaatgcctacgccattggggcggtcgatttcacgggggatatgcctgtgattttggggcctgatgggccaagccttggagggtttgtctgccctgtgagtgtggtgagtgcggagtggtggaagattggacagctcaaagcaggggatagagtgagattcatccctattgcccatgaggatgccctagcgatgcttgatgcgcaagaggaggcgatccaaaatctcgctccttatgatgagcgcccctttttgagggctcttgcgcccaccacgcctagactctatgaggaggagggcgaaggggagctccctgcgcttgtggtgcgccaaagcggagacgcctatcttttggtggagtatggagagatgacgctggatattgcgcggagatttcgtgtgcatctgctcatggaggcgctccaaaagagtcagattcaaggaatcatcgatatcactccgggaattcgctcgctccaaattcacttcaatcccaaaatctgcgaccgaggagagctcattgagcggctcaagaggattgagcgcaatctcccctcagctgatgagatggaagtcccctctcgaacgctctatctgccgctctcatgggatgaccctgccactaaagcagcgatagagaagtatatgaccaccgtgcgacccgatgcgccttggtgtccgagcaatattgaatttattcgccgaatcaatggactatcgagtatagaagaggtgaagcgaatcgtctttgaggcgagctatcttgtgatgggcttaggagatgtctatttgggcgctcctgtggcgactccgctagaccctaggcatcgactcatcaccaccaagtacaatccagcgcgcacttggacacccgaaaatgccgtgggaatcgggggagcgtatatgtgcgtctatgggatggaggggccggggggctatcagtttgttgggcgaacagtgcaaatgtggaatcgctaccctaaagagggtgattttgtcgagggcaaaccttggcttttgcgcttttttgatcagattcgattctatgaggtgagcgctgaggagcttttgcgtttgagggaggagtttcctagggggcgcgtgaagcttagagttgaggaggggagttttagccttagggcgtatcaagcgtttttgtgtgaacatcaaagctccatcgaggcattcaagcgcacccagcagagcgcctttgaagaggagcggctcatgtgggagcgcacgggcttggctaatttcaacgcccaaggagaggcgctggagtcagagagtcaagaatcgctagatcttcctcaaggggttgtccaagtggaatccccattgcaggggaatctatggaagattcttgtccaagagggcgagagggtgagcgaggggcaggtggtgatgatctctgaatcaatgaagatggagattcctatcgaggcgagcgagagtggcacagtggtcaaagtgcttgtgaaagagggagagaatctccatgcaggcaaggggcttttgctccttgaagttgagaattcaaaggcataa

SEQ ID NO: 4773 - protein, 1200 aa, Wolinella succinogenes
MFQKVLIANRGEIACRIIRTLQHLQIASVAIYTDADADSLHVDLADEAYCIGESLVSESYLQGAKILEIAKRSGAEAIHPGYGFLSENAAFARACEREGIVFIGPRPEQMESFGLKHTARELAIQSGVPLLPGSGLLSDLLEAKSEAKRIGYPVMLKSTAGGGGIGMQLCSNEQELEESFLTVKRLSENHFANSGVFLEKYVSTAHHIEVQVFGDRKGKVTILGDRDCSLQRRNQKVVEETPAPHLSQECRESLYACAKKLMESVSYLSAGTVEFIYDPLEQKFYFLEVNTRLQVEHGITEEVSGVDLVEWMVHQAYGLDPSSPITPQGHAIEVRLYAEDPAKNFQPSSGLLSEVRFPKGVRCDTFVRTGVEVSPYYDPMIAKLIVKGESREEAIEKLSQALQETKVEGIVTNLDYLLGVTQSETFLKGAQSTRFLNDFVVEGRGIDILSPGAQTSVQDYPGREGYWDVGVPPSGAFDSLSFRYANALVGNHLEAAGLEMVMSGPTLRFNQEAIIALCGAEIQAELEGQIVPMNKAMLIPKGATLKLKKIQGAGLRAYLAIRGGIDVPLYLGSRSTFTLGRFGGHAGRNLVAGDRLKVASMMQGEARFEVCAPMRPWGELWEIGVLYGPHGAPDFFTNKDIERFFEAEWEVHFNSNRTGVRLIGPKPDWARRDGGEAGLHPSNIHDNAYAIGAVDFTGDMPVILGPDGPSLGGFVCPVSVVSAEWWKIGQLKAGDRVRFIPIAHEDALAMLDAQEEAIQNLAPYDERPFLRALAPTTPRLYEEEGEGELPALVVRQSGDAYLLVEYGEMTLDIARRFRVHLLMEALQKSQIQGIIDITPGIRSLQIHFNPKICDRGELIERLKRIERNLPSADEMEVPSRTLYLPLSWDDPATKAAIEKYMTTVRPDAPWCPSNIEFIRRINGLSSIEEVKRIVFEASYLVMGLGDVYLGAPVATPLDPRHRLITTKYNPARTWTPENAVGIGGAYMCVYGMEGPGGYQFVGRTVQMWNRYPKEGDFVEGKPWLLRFFDQIRFYEVSAEELLRLREEFPRGRVKLRVEEGSFSLRAYQAFLCEHQSSIEAFKRTQQSAFEEERLMWERTGLANFNAQGEALESESQESLDLPQGVVQVESPLQGNLWKILVQEGERVSEGQVVMISESMKMEIPIEASESGTVVKVLVKEGENLHAGKGLLLLEVENSKA

SEQ ID NO: 4774 - DNA, 1347 bp, Wolinella succinogenes
  CDS (1)..(1347)
atgcaaaagaagaagctagagaggattctcatcgccaatcgaggcgagatttcgcttcgagcgattcgcacgattcgcgagatgggcaagaagtctatcgcggtctattctacggctgatagagaggcaaactatctggatgtggctgacgctaaagtctgcatcggaggggataaatcaagcgagagctatcttaatatccccgcgattatctcagccgctgagctttttgaagcggatgcgatcttccctggatatggctttttgagtgaaaatcaaaattttgttgagatttgtcagcatcacggaatcgaattcatcggacccacgcctgaggtgatggtgctcatgagtgataagagcatggccaaagaggtgatgaaaaaggcgggtgtgcccgtgattcccggaagcgaaggcgcgctgagtggctacgaagaggccaaagaagaggcgaaaaagatcggctaccccgtgattcttaaagcttctgcgggaggaggggggcgagggatgagaatcgtcgaaaaagaggagaatctcatcaactcttatctagccgccgagagtgaagccctaagtgcctttggcgatgggactatctatatggagaagttcatcgataagcccaagcatatcgaggtgcaggtgcttgccgataagcatggcaacgctattcatgtgggagagcgagactgctctttgcagagacgccatcaaaaactcatcgaagaatcgcccgcactcgcccttcttccagagactcgcgagaagcttcttaaaaccgccattgaggccactaaagcgatcaagtatgtgggcgcgggaacctttgaatttttgcttgattccaaccaaaacttctatttcatggagatgaacactcgacttcaggtcgaacatcctgtgagcgagatggtgagtggattggatattgtagagtggatgattaaaatcgctgagggcgaagagctcccccctcaagaagagattcgctttaaaggtcatgcgattgagtgccgtatcaccgctgaagatccagagaagtttttcccttgtccaggaaagattaccaaatggatcgccccagggggcaactatgtgcgagtcgattctcacgcctatgcgggatatacggtgcccatgcattatgattcgatgattggaaagctgatcgtttggggtgagacgcgagatagagcgatcgctaggatggcgcgagctttgagtgagtttagtgttgaagggattaggacgacgatccctttccatcaaaagatgatggaaaatgtcgattttaaagaaagcaagattcatacgaagtatttggaacagaaggtgctttaa

SEQ ID NO: 4775 - protein, 448 aa, Wolinella succinogenes
MQKKKLERILIANRGEISLRAIRTIREMGKKSIAVYSTADREANYLDVADAKVCIGGDKSSESYLNIPAIISAAELFEADAIFPGYGFLSENQNFVEICQHHGIEFIGPTPEVMVLMSDKSMAKEVMKKAGVPVIPGSEGALSGYEEAKEEAKKIGYPVILKASAGGGGRGMRIVEKEENLINSYLAAESEALSAFGDGTIYMEKFIDKPKHIEVQVLADKHGNAIHVGERDCSLQRRHQKLIEESPALALLPETREKLLKTAIEATKAIKYVGAGTFEFLLDSNQNFYFMEMNTRLQVEHPVSEMVSGLDIVEWMIKIAEGEELPPQEEIRFKGHAIECRITAEDPEKFFPCPGKITKWIAPGGNYVRVDSHAYAGYTVPMHYDSMIGKLIVWGETRDRAIARMARALSEFSVEGIRTTIPFHQKMMENVDFKESKIHTKYLEQKVL

SEQ ID NO: 4776 - DNA, 1956 bp, Chromobacterium violaceum
  CDS (1)..(1956)
atgttcaacaagatcctgatcgccaacaggggtgagatagcctgccgcgtcatcaagaccgccaaggccctgggcatcgccaccgtcgcggtttattcggacgccgacgcgaacgcccgcttcgtcaagctggccgacgaggcctaccgcctcggcccggcgccggccgccgaatcctatctgcgcgccgacctgatcctggccatcgccagacaaagcggcgcccaggcggtgcatcccggctacggcttcctgtcggagaacgaagatttcgccgccgcatgcgaagccgccggcatcgccttcatcggcccgccggcctcggccatcgcggcgatgggcagcaaatccgccgccaaggcgctgatggagaaggccggcgtgccgctggtgcccggctaccatggcgacgaacaggatccggcgctgctgcaacagcaggccgacgccatcggctacccggtgctgatcaaggccagcgccggcggcggcggcaagggcatgcgcatcgtcgagcaggccggcgacttttccgccgccctcgcctcctgccagcgcgaagcgcgcgccagcttcggcgacgacaaggtgctggtcgagaaatacctgacccgcccgcgccacgtggagatccaggtcttcgccgacaagctgggcggctgcgtctacctgttcgaacgcgactgttcggtacagcgtcgccaccagaaagtgctggaagaagccccagccccccacctgccgcaggccacccgcgaggcgatgggccaggcggcggtggccgccgcgcgcgcggtgggctatgtcggcgccggcaccgtcgagttcatcatggacgtggacaccggcaagttctacttcatggaaatgaacacccggctgcaggtggaacacccggtgaccgagatgatcaccggccaggacctggtggcttggcagttggccgtcgccgccggcggcgcgctgccgctggctcaggaacagttggcgatgcgcggccacgcgatagaggcccgcatctacgccgaagaccccgacaagggctttctgccgtccaccggcacgctggcccacctggcgacgccggccgaatccgcccacgtgcgcatcgataccggcgtcgagcagggcgacgccatctcgccgttctacgatccgatgatcgccaagctgatcgtctggggcgagacccgcgaggccgcgctcaggcagatggatgccgcgctggcgcagtaccggatcgtgggcctgtccagcaatgtgtccttcctgcgccgcatcgtgaaccatcccagcttcgccagcggccaggtcgacaccggcctgatcgcccgccaccacgacgcgctgctgccgccgcccgccgcgccgaccgccaggcagctggccttgctggcgctggccgaagccctggcgcatccagccgcctaccccgcgcccgccggctggcggctgaacgggcggctgacgcgccgcttcgccttccagcgcgacgatgaagactacggcgtggaactccaataccaggacgacggctgcgtcgtccgcgtcggtacggaaagcttccacgctcgcgccagccttgccggcaaccagctggaagcggtgctcaatggccttcgcgtcaaggccgtcatcgtccgccacggcgcgcggcgcgcgctgttcgaaggcggagagcggctgagcgtcgacttcgtcgatccctacgcctacaccgagctgggcgtgcacggcgaaacccacctcaaggcgccgatgccgggccgggtggtggcgctgctggcggaaatcggcaaaaaggtggccaaaggctcgccgctgctgatcctggaggcgatgaaaatggagcacaccatcaccgcgccgggcgacggcgtggtgcaggacttttacttcgcggcaggcgaacaggttaacgatggtgacgagctggtcgattttgccgcagaatga

SEQ ID NO: 4777 - protein, 651 aa, Chromobacterium violaceum
MFNKILIANRGEIACRVIKTAKALGIATVAVYSDADANARFVKLADEAYRLGPAPAAESYLRADLILAIARQSGAQAVHPGYGFLSENEDFAAACEAAGIAFIGPPASAIAAMGSKSAAKALMEKAGVPLVPGYHGDEQDPALLQQQADAIGYPVLIKASAGGGGKGMRIVEQAGDFSAALASCQREARASFGDDKVLVEKYLTRPRHVEIQVFADKLGGCVYLFERDCSVQRRHQKVLEEAPAPHLPQATREAMGQAAVAAARAVGYVGAGTVEFIMDVDTGKFYFMEMNTRLQVEHPVTEMITGQDLVAWQLAVAAGGALPLAQEQLAMRGHAIEARIYAEDPDKGFLPSTGTLAHLATPAESAHVRIDTGVEQGDAISPFYDPMIAKLIVWGETREAALRQMDAALAQYRIVGLSSNVSFLRRIVNHPSFASGQVDTGLIARHHDALLPPPAAPTARQLALLALAEALAHPAAYPAPAGWRLNGRLTRRFAFQRDDEDYGVELQYQDDGCVVRVGTESFHARASLAGNQLEAVLNGLRVKAVIVRHGARRALFEGGERLSVDFVDPYAYTELGVHGETHLKAPMPGRVVALLAEIGKKVAKGSPLLILEAMKMEHTITAPGDGVVQDFYFAAGEQVNDGDELVDFAAE

SEQ ID NO: 4778 - DNA, 1779 bp, Photorhabdus luminescens
  CDS (1)..(1779)
atgaccatgaatattaaaaactatcccataaaaaaagttttgattgctaaccgcggtgaaatcgccgtccgtatcatccgtgcctgccgggattatggtttacaatctatcgccgtctacgctgattcggacatcaatgcacaacatgtacgattggctgatgaggcttatagtttaggcggaaaccgccccgctgatacctatctcaatattccccaattattggatattgcgaaacgttcaggtgccgacatggtacatcccggatacggatttctggctgaacgagcagaatttgcccgtgcagttattcatgcagggttgatctgggttggtcctgaaccagagacaattgatactttgggtgacaaagttaaagcacgcaaaattgcccaacaggtaggtgccccacaggtttcaggtacagaagaaccggtgaaaaacgcagaggaagctctggcgtttgccgaacaatatggcctgccaatcgcaattaaagcggcatatggcggtggtggacgtggcatgaaagtggcatggcggcttgatgaagtcaccgaactctacaattcggctgttcgtgaagcaacagcggcctttggtcgtggagaatgtttcattgaacagttcctggataaacctcgtcatatcgaagcgcaaattctggctgataaacatggcaatgtggtggtacttggtacacgtgattgttcactgcaacgacgtaaccaaaaattggtagaagaagcaccggccccatttttggctgaacatcagcgccagcgtattcatcaagcagcacaagatatttgcaccgctgctggttatattggagccggaacagtggaatttctcctcagtgcagacggcacgatctcctttctggaagtcaatactcgcttgcaggtcgaacatccggtcaccgaagaaaccacagggatcgacattgtggtagaacaatttcgaattgccgaaggtaaacctttatcattgacctcaacgcctattcctttaggccattctttcgagttccgtattaacgcagaagatgcgggtaaaggatttttgccgacacccggaaccgtgacagtattttctcccccttccggcccaggcataagattggattccggtgttgcagcaggttccaccatccctgacacttttgattcgctgatggctaagttgattgtcaccggagcaacccgccaacaagctattgcccgtgcgcagcgggcattacaggaattcagcattaaaggcgttgcctcagtattgccttttcatcgagcagtgatggagcatcctgattttatttccgatgacacatttaacgttcatactcgttggatcgaaactgactttatcaatgatataaaaatatctccgcgtcaggaaaatcattatcaagaaaaggtaacacgtacttttattgaaattaatggccgtcggcatgaactagggctaccagccgaattattaaaagggctttcattgcctgattctgggcgaaattccatcattgaaaacaaaaatagtgaaatggagaggacaataacagcaccgaatcccgtctcagcaccaatatccggcgttttacaatcctggtatgtgcaggagggtgatgaagttaaacaaggtgatgtcattgctgtcatggaagcaatgaaaatggaaacgcaactcaccgcacatcgttctggaaaaatcgttatctatgtagaagaaggcggttatcaacaggcaggaaatgtactggcaagtattaacgatgattaa

SEQ ID NO: 4779 - protein, 592 aa, Photorhabdus luminescens
MTMNIKNYPIKKVLIANRGEIAVRIIRACRDYGLQSIAVYADSDINAQHVRLADEAYSLGGNRPADTYLNIPQLLDIAKRSGADMVHPGYGFLAERAEFARAVIHAGLIWVGPEPETIDTLGDKVKARKIAQQVGAPQVSGTEEPVKNAEEALAFAEQYGLPIAIKAAYGGGGRGMKVAWRLDEVTELYNSAVREATAAFGRGECFIEQFLDKPRHIEAQILADKHGNVVVLGTRDCSLQRRNQKLVEEAPAPFLAEHQRQRIHQAAQDICTAAGYIGAGTVEFLLSADGTISFLEVNTRLQVEHPVTEETTGIDIVVEQFRIAEGKPLSLTSTPIPLGHSFEFRINAEDAGKGFLPTPGTVTVFSPPSGPGIRLDSGVAAGSTIPDTFDSLMAKLIVTGATRQQAIARAQRALQEFSIKGVASVLPFHRAVMEHPDFISDDTFNVHTRWIETDFINDIKISPRQENHYQEKVTRTFIEINGRRHELGLPAELLKGLSLPDSGRNSIIENKNSEMERTITAPNPVSAPISGVLQSWYVQEGDEVKQGDVIAVMEAMKMETQLTAHRSGKIVIYVEEGGYQQAGNVLASINDD

SEQ ID NO: 4780 - DNA, 1350 bp, Photorhabdus luminescens
  CDS (1)..(1350)
atgcttgataaaattgtaattgctaaccgtggtgaaattgccctgcgtatcctacgagcttgtaaagagttggggatcaaaaccgttgcggtacattcctccgcggatcgtgacttaaaacacgtactgctggcagacgaaactatctgtattggcccggcagcttctgcaaaaagctacctgaatatcccggcaattatttctgcggcagaaatcacgggtgctgtggctattcaccctggctacggttttctatctgaaaatgcagattttgctgaacaggttgagcgttctggctttatttttatcggcccaaaagcagaaacgatccgcctgatgggtgataaagtttctgctatcaatgcgatgaaaaaagcaggcgttccttgtgtacctggctctgatggcccattgtctgatgacacggagaaaaacaaagccttcgctaaacgcattggctatcctgtcatcatcaaagcatccggcggcggcggcggtcgcggtatgcgcgtcgtccgcagtgataaagatctggaacaatcaatcaatatgacccgtgcggaagcaaaagctgctttcaataacgatatggtttacatggaaaaattccttgagaatccacgtcatattgagatccaagtattggctgacggccaaggtcaagcaatttatctggctgagcgtgattgctccatgcaacgccgtcaccagaaagttgtcgaagaagcccctgcaccaggaatcacgccagaaatgcgtcgcagtattggtgaacgctgtgctaacgcatgtatcgaaattggctatcgtggtgccggtactttcgaattcctgtatgaaaacggtgaattctatttcattgagatgaatacccgtattcaggttgaacatccagttacggaaatgattaccggtgttgatctgattaaagagcagttgcggattgccgcaggtatgccactttcaattaagcagaaagatgttgttattcgtggtcacgctattgaatgtcgtatcaatgccgaagatccgaacacattcctgccaagcccaggtaaaattacccgcttccactcgccgggtggatttggtgtgcgttgggaatcgcatatttatgctggctacaccgttcccccttactatgattcaatgattggtaagctgattacttacggtgaaaatcgtgacaatgccattgcccgcatgaaaaatgcattggcagaattgatcattgatggcatcaagacaaatatcgagcttcaacaggcgataatgaatgatgaaaactttcagaatggcggtactaatatccactatctggagaaaaaactggggttacaggaaacttaa

SEQ ID NO: 4781 - protein, 449 aa, Photorhabdus luminescens
MLDKIVIANRGEIALRILRACKELGIKTVAVHSSADRDLKHVLLADETICIGPAASAKSYLNIPAIISAAEITGAVAIHPGYGFLSENADFAEQVERSGFIFIGPKAETIRLMGDKVSAINAMKKAGVPCVPGSDGPLSDDTEKNKAFAKRIGYPVIIKASGGGGGRGMRVVRSDKDLEQSINMTRAEAKAAFNNDMVYMEKFLENPRHIEIQVLADGQGQAIYLAERDCSMQRRHQKVVEEAPAPGITPEMRRSIGERCANACIEIGYRGAGTFEFLYENGEFYFIEMNTRIQVEHPVTEMITGVDLIKEQLRIAAGMPLSIKQKDVVIRGHAIECRINAEDPNTFLPSPGKITRFHSPGGFGVRWESHIYAGYTVPPYYDSMIGKLITYGENRDNAIARMKNALAELIIDGIKTNIELQQAIMNDENFQNGGTNIHYLEKKLGLQET

SEQ ID NO: 4782 - DNA, 1350 bp, Gloeobacter violaceus
  CDS (1)..(1350)
atggtctattttcgcaagattttgattgccaaccggggcgaagtggcgctgcgcatcctgcgcacctgcagcgaactcggtatcggcaccgtggcggtacactcgacggccgacgccctctcgctgcacgtgcaactggccgaccaggcggtgtgcatcggcgaaccgatggccagcaagagctatttgagcattccgaatttgatctcggcggccctgacgcgcgactgcgacgccgtccacccgggctacggttttttgtcggaaaacgagcgcttcgctgaaatctgcgccgatcacggcctcacttttattggcccttcgccccgggcgatggtgctgatgggcgacaaatccaccgcccgcgacacgatgaaggcggcgggggtgcccaccgtacccggctccgaggggctcatcgacagtgaacaagaagcctacgaggcggccaaagcgattggctacccggtgatgatcaaggcgacggccgggggcggcgggcgcggcatgcgcattgcgggcaacgagcgcgacctcatcaaaatggtccagaccgcccagcgcgaggcggaggcggccttcggcaaccggggggtctacatcgagaagtacctcgaagaaccccggcacatcgaatttcagattctcgccgaccagcacggcaacgtcgtgcacctgggcgagcgcgactgctcgatccaaaggcgccaccagaaattgctcgaagaatcccccagcccctttctcacccccgcgatgcgcgagcgcatgggggaggcggccctacaggcggcgaggtcgatcaactacgtgggggcgggcaccatcgagtttctggtcgacaaaaagggcgacttttacttcatggagatgaacacccgcatccaggtggagcacccggtcaccgagatgcgcacgggtatcgatctgatcgccgagcagatccggatcgccgccggggagccgttgggctacacccagtccgacatccgcatggaaggccacgccatcgagtgccggatcaactgcgaggatcccaataatgactttcggcccaccccgggcacgatcagcgcctatctggcgccgggtggtccgggggtgcgcatggattctcacctgtacccgggctataaggtgccgtcccactacgattcgctcttgggcaagctgatcgtctggggccgcaaccgcgacgaggccatccgccgcatgcgccgggcgctcgccgagtgtgcgatcaccggggtaccgaccaccattccctttcacctgcgggtgctcgacaacgcctggttcctgcgcggcgacgtctacaccaactttgtccagcgacggatgagcgagtga

SEQ ID NO: 4783 - protein, 449 aa, Gloeobacter violaceus
MVYFRKILIANRGEVALRILRTCSELGIGTVAVHSTADALSLHVQLADQAVCIGEPMASKSYLSIPNLISAALTRDCDAVHPGYGFLSENERFAEICADHGLTFIGPSPRAMVLMGDKSTARDTMKAAGVPTVPGSEGLIDSEQEAYEAAKAIGYPVMIKATAGGGGRGMRIAGNERDLIKMVQTAQREAEAAFGNRGVYIEKYLEEPRHIEFQILADQHGNVVHLGERDCSIQRRHQKLLEESPSPFLTPAMRERMGEAALQAARSINYVGAGTIEFLVDKKGDFYFMEMNTRIQVEHPVTEMRTGIDLIAEQIRIAAGEPLGYTQSDIRMEGHAIECRINCEDPNNDFRPTPGTISAYLAPGGPGVRMDSHLYPGYKVPSHYDSLLGKLIVWGRNRDEAIRRMRRALAECAITGVPTTIPFHLRVLDNAWFLRGDVYTNFVQRRMSE

SEQ ID NO: 4784 - DNA, 3609 bp, Gloeobacter violaceus
  CDS (1)..(3609)
atgttcgacaaagtcttgattgccaaccggggcgaaatcgcctgccgcatcctgcgcaccctcgaccggctggggatcgcctcggtggcggtgtactccgaggcggacgcctacgccccccacgtccggggagcgggtgaagcggtcctgattggccccgccccggcggcccagagctatttgcgctacgagcggattttagaagcggccgtcgccaccggtgcccaggcgatccacccgggctacggttttttgagcgagaacgccgaatttgccgaggcgtgcgaacgcgagaatattgtctttattggacctacccccttgcagatgggtcgcttcgggcgcaagcacaccgcccgcgctctggcggccgaaaacggtgtgcccctgttgccggggacgggcttgctcatcgatcttgccgaagcgcaccggcaggcggcggcgattggctacccggtgatgctcaagagcacggcgggtgggggcgggatcggcctggcactctgtcggggagaagcgaaactcaccgaatcgttccaggccgtgcagcggctcagcgaaaacaatttccgcgacggcggcgtgtacctcgaaaaatacgtcgagcgcgcccggcacctggaggtgcagatcttcggcgacggcgagggtagggtgatcgccctgggcgagcgcgactgctcgatccagcggcgcaaccagaagctgcttgaggagaccccggcccccggtatttgcgagacgctgcgcgaacggctttgtgaagcggcggtgtgcctggggcgggcggtcggctatcgctcggcggggacggtggaatttatctacgacgccgaggcggcggatttttattttctggaggtgaacacccgtctgcaggtggagcacggcgtcaccgaggcggtggcggggatcgacctggtcgaatggatggtgcgcctggcggccggggagcgcgactttctcgagcagtaccgccaccggccccgggggcatgccgtcgaggtgcggctctacgccgaggatgcgggccgcaattttcagcccagcaccggcacgctcaccgaagcggtctttgcggcggtgcgctgcgacggctgggtggagcggggcacggaggtgacgccctactacgaccccttgctcgccaagctcatcgtccggggtgaatcgcgacccgaggcgatcgcccgtctgcaggccgcgcttgcggacacccgcatcgccggggtggagaccaacctggactacctgcgccagatccttgcggacgccgattttttggcgggcaacctgagtacccgcttctcgcaaacttttcactacgcgccgctgaccgtcgaggtgctggagcccggtacctacagcaccatccaggactacccggggcgcaccggctactgggatatcggcgtgccgccctccggcccgatggacccgctcgccttccgccttgccaaccgcctggtgggcaacccccccgagacggccgggctcgaatgcactgccctcggcccgaccttgcgtttccacaccgacgcggtgatctgcctgtgcggtgccgcgatggacgcccggatcgacagcaaacccgtttcctactggtgcgccgtgccggtggcggcaggcagcaccctgcgcctgggggccgtcaccggccccggctaccgcacctacctggcggtccggggtggtttcgacgtgcccgagtatctggacagcaaggcgacttttaccctgggacaattcggcggccactgcggtcggacgctgcgcaccggcgatgtgctccggctggtgcggcatgatcttgcagacctcccgctgccgctcgctcccgctctcatccccgaataccgctccgattgggaaattggtgtactctacggtccccacggagcgccggacttttttaccgaccgggacatcgagacattttttgccaccgcttgggaagttcactacaactcagcgcgcaccggcgtgcggctcatcggtcccaaaccgctatgggcgcgctccgacggcggcgaagcgggattgcacccgtcgaatattcatgacaatgcctatgcggtgggcacggtcgatttcaccggcgacatgccagtcatcctcggtcccgacggcccgagcctgggaggcttcgtctgcccggctactgtcgcccgggcggaactgtggaaaatcggccaactcaaaccgggagacaccgtccgcttccggcggctgggttttgccgaagccctgcgccgcgaacaagcacaagatttcacaatcgatcgactctcccttccgaaaccggctgcgccctcgcttgccgaagccggcgacccggcggtgctgcacaccatcgcggccactgcggagcaaatcgccgtcgtctaccgccagtcgggggacaagtacctgcttatcgagtacggcccgccggtgctcgatctcaatttgcgcttccgggtgcacgcgctgatggagtggctgcaggccaacgccttgccgggcatgctcgaactcacccccggcatccgctcgctgcaggtgcacttcgacggccgcatcctgccgcgcgaaaggttgctggaggttctgaccgccgcagagtcgcaactgcccccgatcgaggcgatggaggtgcccacccgtatcctgcacctgcctttgtcctgggaagacgaatcgacgctgctcgccatccgcaagtacatgcagtcggtgcgcaaggacgctccctggtgtccgagcaacatcgaatttatccgccgcatcaacgggcttgaaagtattgacgaggtgaagcgcatcgtcttcgaggcgagctacctggtattgggcctgggcgatgtctaccttggagcgcccgtcgctaccccaatcgatccgcgccaccggctggtcaccaccaagtacaacccggcgcgcacctggacacccgaaaacgccgtgggcatcggcggcgcgtatctctgcatctacggcatggagggaccggggggctaccagttcgtgggccgtaccgtccaggtctggaaccgctaccggcagaccgccgattttacccggccctggctgctgcgcttttttgatcagatccgcttctatccggtttccgggccggaactgttgcgcctgcgcgaggattttcgccacggccgcgcgaagctcgaggtgagcgaagcgatcttcagcctgaaacaatacaacgactttttagccgagatcgccccggaggccgcagcctttaaagcgcagcagcagacggcctttgccgaggagcgcgagcggtggcgcgaggcgggcgaatttgccgccgtcgccgaagatccggctattgcgccgtctgcggccgaggagtacgcactgcccgccggagcctgcgcggtgagcgcccagctctcggcgaatgtctggcagattgccgtccaaccgggagagccggtcgccgccggtgatcccctggtgatcttggagtcgatgaagatggaggttgtcctgaccgctcccatctccggtacagtcctcgcggtgctgtgcgccgaagggtgtctggtcgccgccggccagacgcttgtggtcgtgcaaccttccgagtccgcgccgccatag

SEQ ID NO: 4785 - protein, 1202 aa, Gloeobacter violaceus
MFDKVLIANRGEIACRILRTLDRLGIASVAVYSEADAYAPHVRGAGEAVLIGPAPAAQSYLRYERILEAAVATGAQAIHPGYGFLSENAEFAEACERENIVFIGPTPLQMGRFGRKHTARALAAENGVPLLPGTGLLIDLAEAHRQAAAIGYPVMLKSTAGGGGIGLALCRGEAKLTESFQAVQRLSENNFRDGGVYLEKYVERARHLEVQIFGDGEGRVIALGERDCSIQRRNQKLLEETPAPGICETLRERLCEAAVCLGRAVGYRSAGTVEFIYDAEAADFYFLEVNTRLQVEHGVTEAVAGIDLVEWMVRLAAGERDFLEQYRHRPRGHAVEVRLYAEDAGRNFQPSTGTLTEAVFAAVRCDGWVERGTEVTPYYDPLLAKLIVRGESRPEAIARLQAALADTRIAGVETNLDYLRQILADADFLAGNLSTRFSQTFHYAPLTVEVLEPGTYSTIQDYPGRTGYWDIGVPPSGPMDPLAFRLANRLVGNPPETAGLECTALGPTLRFHTDAVICLCGAAMDARIDSKPVSYWCAVPVAAGSTLRLGAVTGPGYRTYLAVRGGFDVPEYLDSKATFTLGQFGGHCGRTLRTGDVLRLVRHDLADLPLPLAPALIPEYRSDWEIGVLYGPHGAPDFFTDRDIETFFATAWEVHYNSARTGVRLIGPKPLWARSDGGEAGLHPSNIHDNAYAVGTVDFTGDMPVILGPDGPSLGGFVCPATVARAELWKIGQLKPGDTVRFRRLGFAEALRREQAQDFTIDRLSLPKPAAPSLAEAGDPAVLHTIAATAEQIAVVYRQSGDKYLLIEYGPPVLDLNLRFRVHALMEWLQANALPGMLELTPGIRSLQVHFDGRILPRERLLEVLTAAESQLPPIEAMEVPTRILHLPLSWEDESTLLAIRKYMQSVRKDAPWCPSNIEFIRRINGLESIDEVKRIVFEASYLVLGLGDVYLGAPVATPIDPRHRLVTTKYNPARTWTPENAVGIGGAYLCIYGMEGPGGYQFVGRTVQVWNRYRQTADFTRPWLLRFFDQIRFYPVSGPELLRLREDFRHGRAKLEVSEAIFSLKQYNDFLAEIAPEAAAFKAQQQTAFAEERERWREAGEFAAVAEDPAIAPSAAEEYALPAGACAVSAQLSANVWQIAVQPGEPVAAGDPLVILESMKMEVVLTAPISGTVLAVLCAEGCLVAAGQTLVVVQPSESAPP

SEQ ID NO: 4786 - DNA, 1491 bp, Chromobacterium violaceum
  CDS (1)..(1491)
atgatacggcggctgctgctctgttgccgcggcgagatcgcgctgcgcttcatccgcacttgccgcttgatgggtgtggaaaccgtggcggcttatccggcggaggatgacggccacccctacgttctggccgccgatcagcgctttcccatcgaggcggccagcgccggcagcgcgatggctgaagtgctgcaagtcgcccgcttggcgcgggtggacgcgatcgcgccgggctatggccctctggcggaaaacgccgaattcgccgcggcttgcgccgaggccggtttcatcttcgtcggtcccaggccggaggccatccggcagtccggcgacaagctgcgcgcccgcgaggccgcctgcctggccggcgtgccggtgatccccggcggccatcctggggacgggctggagcaatcgctggatctggcgcgggaaatcggctttccggtgctgatcaaggcggtgatgggaggcggcggccgcggcatacgggtggtggaggcgccggaggccttcgccggcgcgctcgatgaagtgaggagtgaggcgctttccgcattcggctgcggcgatgtctatctcgagcggttcctcggcaccgccatccgccatatcgaggtgcaggtgctgggcgacaagcacggcaatgtgctgcatctgggcgaccgcggctgcagcgtccagcgtcggcggcaaaaactggtggaggaagcgccggtgccgggactggacgcggcgctgaggaacgaattgcggctggcggcgctggcgatcgcgcggcagctgggctacgacagcgccggcaccgtcgaattcctggttgccggcgacgggcgtttctacttcatcgaaatgaacgcgcgcatccaggtggagcatccggtgacggaggcgatcaccgggatcgatctggtcgagcagatgattcatgtcgccggcggcggacgtttgtcgctgcgccaggatgacatcgaattccgcggccatgcggtcgaattcaggctctgcgccgaagacccgcgcaatcagttctttccggctgccggacgggtcgccagctatgccgtgccggagggcgagggcgtgcggctggattcgggcgtggccagcggcgtcgcgcagtcgccgcgattcgacagcttgtgcgccaagctcatcgtccatcagtccagccgtgaacgcgcgctggcgcgcgcctcgcatgcgctgggagagttccgcctgttcggctttccgaccaatgtcccgttccatcactggttgctggagcagccgcagttccgcgacggcagctacgacttgtcgttgctggaggatttcgagctgccgccggagcgactgcatgccgtcgaccgaagggcggtgtttgccgcggcgctggcgacggcgctggctggcgtggccgggcgcaggccggagggctcggccgcggtgtcgggctggaaactgcgcaacgatccgctgctggcggccggcgcgcgaggctag

SEQ ID NO: 4787 - protein, 496 aa, Chromobacterium violaceum
MIRRLLLCCRGEIALRFIRTCRLMGVETVAAYPAEDDGHPYVLAADQRFPIEAASAGSAMAEVLQVARLARVDAIAPGYGPLAENAEFAAACAEAGFIFVGPRPEAIRQSGDKLRAREAACLAGVPVIPGGHPGDGLEQSLDLAREIGFPVLIKAVMGGGGRGIRVVEAPEAFAGALDEVRSEALSAFGCGDVYLERFLGTAIRHIEVQVLGDKHGNVLHLGDRGCSVQRRRQKLVEEAPVPGLDAALRNELRLAALAIARQLGYDSAGTVEFLVAGDGRFYFIEMNARIQVEHPVTEAITGIDLVEQMIHVAGGGRLSLRQDDIEFRGHAVEFRLCAEDPRNQFFPAAGRVASYAVPEGEGVRLDSGVASGVAQSPRFDSLCAKLIVHQSSRERALARASHALGEFRLFGFPTNVPFHHWLLEQPQFRDGSYDLSLLEDFELPPERLHAVDRRAVFAAALATALAGVAGRRPEGSAAVSGWKLRNDPLLAAGARG

SEQ ID NO: 4788 - DNA, 1965 bp, Chromobacterium violaceum
  CDS (1)..(1965)
atgttcaaacgaattttgatcgccaaccgcggcgagatcgcccgccgcatcgcccgcagctgccagcggctgggcatagagtttgtcgccgtccactcctgcgccgacgccggagccgagcatctgcggggcgccgtcgcgcgcgaatggataggcgaggccccggccagcgccagctatctgaacggccaggccatcatagacgccgcgctgcgcagcggctgcgaggccatccaccccggctacggcttcctgtcggaaaaccccggcttcgccagcgcggtggccgaggccggcctggtcttcatcggcccggacgcggacaccatcgtccagatgggcgacaaggcccgcgcgcggcaattgatggaggccgccggcgtgccggtgctgcccggctcgcccgaggccaccgaatcctacggcttgatcctggagacctgcgccgagatcggctatccggtgatactcaagccgtctgccggcggcggcggcaagggtatgcaggtggtgtggagcgaggcggaactgcgcgaggcggtggacgccgccgtgcgcatcggccgctccagcttcggcgatggccggctgctggtggagcgctacgtctcccagccgcgccacctggaagtgcagatcttcggcgacgggcgcggcgcggccgtgcacctgttcgaacgcgagtgctcgctgcagcgccgccatcagaaaatcgtcgaggaagcgcccgcctgcggcctgccggccgacacccgcgaggccctgctggcggccgccgtgcgcggcgcccaggcgataggctaccgcaacgccggcaccttcgagttcatcctggcgccggacggccgcttctacttcctggaagtgaacacccggctgcaggtggagcatccggtgaccgaggccatcaccggccaggacctggtggaatggcagctgcgcatcgccgccggcgagggcctgccgctggcccaggccgacatctgcgccgacggccacgccatcgaatgccgcgtgtacgccgaagacccgctgcgcgaattcgcgcccatgcccggtaccgcgctgcacgcgcgctggccggcgcagctgcgcgtggatgccgctttcgaccacggcggcgcggtgcctgccttctacgaccccatgctggccaagctgatcgcgcacggcgccggccgcgccgcggcgctggcgcagttgcagaccggcctgcgcgacaccgagctcctgggcctgaccagcaatctgggctttctgcagcggctgctgcgcgagccgcgggtgcaggccggccagctgcacacccatctggtggacgagctggcggcggcgccggaggccaatcgcctcacgtgcgccgtggcctgcgccgccgccatccgcctggcgctggcctgcgccgaatccgcctcgccctggcagggcggcgtcggcgcctacgaccgcgccgcactggacccggacgcgccgttgggccggatggcctatcgcggcggcgccgagcgctgccaggcctggctgctggagcgcgacgcggagcggaccctggtgcaagtggacgggcggcgccatgccgtcagcctgtccggcgccggcgagcattggcagggcgaggtggacggctggcgctggtacgcgctgctgcgcggcgacgatgtcgagctgagcgtcggcggccagcgcgtcgccctgcgcgccgagctggcggaacaggccgagcaggaggctggcggcggcctgcaggtgcgcacgccgatgcccggcaccgtggtggccttgccgctggcggcgggcagccgggtggaagcccagcaggtggtggccatcgtggaggcgatgaagatggaaaaccgcctgtacgccccctgcgccggcatcgtggccgagctgcactgccaggtcggcgacatcgtcaatgccgatgcgctgctggtcagcctgggccaggcggaggccgagtag

SEQ ID NO: 4789 - protein, 654 aa, Chromobacterium violaceum
MFKRILIANRGEIARRIARSCQRLGIEFVAVHSCADAGAEHLRGAVAREWIGEAPASASYLNGQAIIDAALRSGCEAIHPGYGFLSENPGFASAVAEAGLVFIGPDADTIVQMGDKARARQLMEAAGVPVLPGSPEATESYGLILETCAEIGYPVILKPSAGGGGKGMQVVWSEAELREAVDAAVRIGRSSFGDGRLLVERYVSQPRHLEVQIFGDGRGAAVHLFERECSLQRRHQKIVEEAPACGLPADTREALLAAAVRGAQAIGYRNAGTFEFILAPDGRFYFLEVNTRLQVEHPVTEAITGQDLVEWQLRIAAGEGLPLAQADICADGHAIECRVYAEDPLREFAPMPGTALHARWPAQLRVDAAFDHGGAVPAFYDPMLAKLIAHGAGRAAALAQLQTGLRDTELLGLTSNLGFLQRLLREPRVQAGQLHTHLVDELAAAPEANRLTCAVACAAAIRLALACAESASPWQGGVGAYDRAALDPDAPLGRMAYRGGAERCQAWLLERDAERTLVQVDGRRHAVSLSGAGEHWQGEVDGWRWYALLRGDDVELSVGGQRVALRAELAEQAEQEAGGGLQVRTPMPGTVVALPLAAGSRVEAQQVVAIVEAMKMENRLYAPCAGIVAELHCQVGDIVNADALLVSLGQAEAE

SEQ ID NO: 4790 - DNA, 1998 bp, Rickettsia sibirica
  CDS (1)..(1998)
atgaataaaccattatttgataaaattttaattgctaatcgtagcgagatcgccgttaggataatacgtaccttaaaaaagatggggataaagtcggttgcagtatattctgaagcagatacaaactcaatgtatgtgcagcatgcagatgaggcttattatataggtgattcccctgcaacggaaagttatttatctattaaaaatattatttcggcgattcgtgaaagtggcgcaagtgcagtacatccaggttacggttttttatcagaaaatccaaattttgccaatattcttaaaagagaaggtgttgttttaataggaccgagtgccggaactattaaaaaaatgggcgataaaatcgaagcaaaaaagatagcgatagaagccggagttagcaccgtgccaggttatatgggaactataaacgatgttaaacaagctatagatattgctaaagagattggttttccggtaatagtaaaagcggctgccggcggcggtggacgtggtatgagagtagtgaataatcccgctgaaatggccaatgcttttgagtcggcaaagcttgaagcagccaatagttttagtgacgatagattatttattgagaagttaattcaaactccccgtcatatcgaaattcagctaattgccgatcaatacggcaatagtgtatgtctcggagagcgggaatgttcaatacagcgtcaccatcaaaaagtaatcgaagaagcaccaagttcttttattactgaagatataaggcaagaaatgtatcggcaggtaatatccttatctcaaaaagtgggatattattcggccggtaccgttgagtttatagtagatagcaataaaaatttctattttttagagatgaatactaggttgcaagtcgagcatcctgttactgagctaattaccggtatagatatcgttgaagagatgatacaaatcgcagccggcgagaaattatcatttacacaagatgacgtaaaattaaaaggttgggcatttgaatcacgaatttgtgccgaaaacccaagccgaggtttcttaccttctagcggtagaattatagcttattccgaacctgcaaagagtcctaatatccgtatagatacagggattgggcttggcggcgaagtaagtatgttttatgactcaatgattgcaaaattatgtacttacggtgaaacaagagagcaggcaattgagctaatgcattctgctttgagttcttatataattaacggtattgctcataatatcagtttcttagaagcggtaatgctacatccacgctttgttagcggcgatatttctactgcctttattcaagaagaatatcctgacggtttttccggagctagtctaacttcagaagtaactaccgtatttttagcaacggctatttttatttatatatcggagcaaagacgtgcttctttaatttccggcaatattaacaatcaggctaacaaaataggtacaaggtgggtagtaactatcgatgataagctatttcctgtattaattacacctgttgaaaacggctataatatacgtcacgaaagcgatagaatatatattcgtagtaactggaatttaggtaatgaactttttacggctataattaacggtaaaaagacaaatgtgaaaattgagaatatcaaaaccggttatttattatcgcatgccggtattagcgtaaaagcctttgtacgctctcctcgtatctcagaacttgaagcgttgatggtctcaaaagtagtggtggaagaaagctccgaactacaagctcctctaagcggtcagattgctgcgataaaggtgaaagaagggcaggaagtgacggtaggacaagaaattatgattttaactgctatgaaaatggaaaacctgattcttgccgaaagagatggaaaaatagctaaaatttttgttaatgaaaaggataatgttataagagggcaggtattattagaatttgcttga

SEQ ID NO: 4791 - protein, 665 aa, Rickettsia sibirica
MNKPLFDKILIANRSEIAVRIIRTLKKMGIKSVAVYSEADTNSMYVQHADEAYYIGDSPATESYLSIKNIISAIRESGASAVHPGYGFLSENPNFANILKREGVVLIGPSAGTIKKMGDKIEAKKIAIEAGVSTVPGYMGTINDVKQAIDIAKEIGFPVIVKAAAGGGGRGMRVVNNPAEMANAFESAKLEAANSFSDDRLFIEKLIQTPRHIEIQLIADQYGNSVCLGERECSIQRHHQKVIEEAPSSFITEDIRQEMYRQVISLSQKVGYYSAGTVEFIVDSNKNFYFLEMNTRLQVEHPVTELITGIDIVEEMIQIAAGEKLSFTQDDVKLKGWAFESRICAENPSRGFLPSSGRIIAYSEPAKSPNIRIDTGIGLGGEVSMFYDSMIAKLCTYGETREQAIELMHSALSSYIINGIAHNISFLEAVMLHPRFVSGDISTAFIQEEYPDGFSGASLTSEVTTVFLATAIFIYISEQRRASLISGNINNQANKIGTRWVVTIDDKLFPVLITPVENGYNIRHESDRIYIRSNWNLGNELFTAIINGKKTNVKIENIKTGYLLSHAGISVKAFVRSPRISELEALMVSKVVVEESSELQAPLSGQIAAIKVKEGQEVTVGQEIMILTAMKMENLILAERDGKIAKIFVNEKDNVIRGQVLLEFA

SEQ ID NO: 4792 - DNA, 1164 bp, Anopheles gambiae str
  CDS (1)..(1164)
atgttcaaaaagatattaattgccaatagagatgctattcaccctggttacggattcctttccgagaatgctaatttctccagaatctgccagaagaacggtattaaatttatcggagctactccggaacaaattgagaaaatgggagacaaagctacagctaaagctacaatgaaagctgcaggcatcccatgtgttccaggatccgacggacttatcgattcttatgagcatgctgtaaagattgctaaagaaattggttatccggtaatgatcaaagctactgcaggtggtggtggtaaagggatgcgtgctgtatggaaagaagaagaccttaaagatcattgggattctgcaattcaggaagctgttgctgctttcggaaacggaggtatgtatatggaaaagcttattgaagagcctcgccatattgaaattcaggttgctggagatcaaaacggaagagcatgtcacctttctgaaagagactgttctatccagagaagaaaccagaaactgattgaggagactccatctccattcatgactcctgagcttcgtgaagaaatgggtaatgcggctgttaaagcagcagaatacatcggatatgaaggtgttggtactattgaattccttgtagataagcacagaaatttctactttatggaaatgaatacccgtattcaggtagagcaccctattacggagcaggtaattgattacgatcttatcagagagcaaatcttactagctgcaggaactccaatttctggtattaatcactatcctaagcttcatgctatagagtgtagaattaatgcagaggatccatatgcggatttccgtccttctccaggtgttataaaaggattaaatattcctggcggacacggtgtaagagtagatacccatgtttattccggatatgcaattccacctaactatgactctatgattgccaagcttattacaactgcacaaacgcgtgaagaagctattgcaaaaatgaaaagagcattagaagagttttacattgaaggagtaaaaacgactattccattccacagacaacttctggacaatgaagacttcattgccggaaattatacaacaaagttcatggagagctttgtaatggataaaaattatgaaaatcacttctaa

SEQ ID NO: 4793 - protein, 387 aa, Anopheles gambiae str
MFKKILIANRDAIHPGYGFLSENANFSRICQKNGIKFIGATPEQIEKMGDKATAKATMKAAGIPCVPGSDGLIDSYEHAVKIAKEIGYPVMIKATAGGGGKGMRAVWKEEDLKDHWDSAIQEAVAAFGNGGMYMEKLIEEPRHIEIQVAGDQNGRACHLSERDCSIQRRNQKLIEETPSPFMTPELREEMGNAAVKAAEYIGYEGVGTIEFLVDKHRNFYFMEMNTRIQVEHPITEQVIDYDLIREQILLAAGTPISGINHYPKLHAIECRINAEDPYADFRPSPGVIKGLNIPGGHGVRVDTHVYSGYAIPPNYDSMIAKLITTAQTREEAIAKMKRALEEFYIEGVKTTIPFHRQLLDNEDFIAGNYTTKFMESFVMDKNYENHF

SEQ ID NO: 4794 - DNA, 8736 bp, Plasmodium yoelii yoelii
  CDS (1)..(8736): m means a or c
atgattagtatctttttatcaatattactatttgttctcatatttgaaaatccaacaaaatctataaaaattagaaacacttattatatgcacatgtataataatgttaatatcaataattttgcagaaaaagaaacgagaggccaatatccaaatagaaaagggacaaatgatgttttatctgaaaattatcgaaataagtttatgcctttatttgtgtctaaaggaacaaatatattaaattccattttaaaaaataaaacgtttagatatatatataatgatccagaaagaaatacaaaaaaaaattcaaagaataattctaagaatttggcatttctttacacccttcataaacattcgaatacattaagtagaatttcaaaaagcaagagcttccagggagatgatatagaaaaattggaaaataataatgatgaagataacgacagcacaaacaatataagtagtagaagtaatagcaatgatattgataaaacgtattcatttgaccatataggaaataatttaaatgaagatcccgagaaaaaaattttcagctttacatcaaatagaaaagatgctcaaagtggctttagggatgattccaattccagctacataactaaggacaatttaaagaaaaaaagcgatagtgtaaataatagagaaaaaaaagttttagaaaatttgatagacaatttttcaaatttaaactggtctaataatataattgatgatgcaaatttaaatcaaccacaatattcaaaagaatttggctcttatataaaatcggaaaacgataaatcattacactactattcagatggtatactagaccatctttattcgtataaaaaatttagtacaaaaaataagaaaaaaaaaaatttgaataaattattttacagctttaagccattggaaaatgttcatacgataaaaaaaggaactataactgcgcagcctattcaaaataatgcggaaatagggacacctttatcccacagtgacaaaaatggaatatctatgagcaatataaacaaaagacaaataaaattcggagataaacgaatatacatgaaaaaaggggatacttgtgaaagagatgaaaatgaacatattgatgataccgaatttttaacatacgaagaaacaaataatataaaaaaaaaagcatataaagattatattaattatataaatgaaagacgatatccatatataaattatttaaaaatgaaaaatgaaaaaataataaaaaaattattaattgctaataatggtatggctgcattaaaatgtatattgtcattaaaagaatggttatttaaaacatttaatgatgaaaatttgatacaaataatagtgttagctactgaagatgatataaaaagtaattccaaatacatatctttatcagataaagttattaaagttccaccgggaaaaaacagttataattatgcaaatgtttctttaattgttgacattgcaaaaaaagaaaatgttgatgcagtttggccaggttggggacattgctcagaaaatccattattgtcatctatgctagaaaaggaaaatataatttttgttggaccgactgataatgttatggaagcattaggtgataaaatatcagccaacattttagctcaaagtgttaatgtacctgttgttaaatggagtggcgataatttaaaaattaaagattttgaaaataattcaattagtcaagatatatataataaatctactattcattcgttagaagaatgtatcagagaatgcaaaaggattggctatcctgttatgataaaagcgtcacaaggtggtggtggtaaaggtattcgaaaggtagaaaacgaaaatgaaataaaaaaatattatgaacaagttcaaaatgaattaccaaattcaccaatatttttaatgaaagtatgtagcaatgttagacatattgaaatacaagttgttggtgatatgtatggaaatgtttgttcattaagtggtagagattgtactacacaaagacgatttcaaaaaatatttgaagagggaccaccttctattgttcctccacatacttttagagaaatggaaaaagcatctatacgtttaacaaaaatgatcaaatatagaggtgcaggaaccattgaatatttatatgatcaagttaataacaaatattattttttagaattaaatacccgtttacaagtagagcatcctgtttcagaaggaataacagataccaatattgtcgctattcaacttcaagttgctatgggcatacctcttcaaaatatagatgatataaaaaaattatataaaatagaagagaaaacaaaaaaaaacacatcgtcaagcagtgttagtattgtaaatgataagttaaaacttccaataagcgaaaaagataataataaaacagtgaaaactaatttgagtgaacaacttggcatgtttgatttttacaacaacatgccccacactaaaaatcatgttattgctgctcgaataacagccgaaaacagtaatgatagttttaaaccaacgtcaggcttagtaaaaaatgttaattttcaaaattcgaaagatgtatggggttatttctctatcaataatgggtttgttcatgaattttcagattcacaaattggccatatatttgcaaaaggggaaacaagagaaattgctagaaaaaatttaattctagcgttaaggaaattaagcatagatggagaaattaagacagttacaaaatatttagcaaaaatattagaatctaaagcatttatagataacaatataacaacaaattggttagatgttgtaatagaacgaaaaaaaaacatttattataatgcttttcatataattattttgtgtgctgccatatttaaactgttgatttattttatgaaagaaatggaaaatacggaagatagcctaaatagggaagacattgctataaaatcagaaaataatatcaatgacataagtttaaatggaaaaatgaaaagagcacacatttttgatataatttttcaaaatgtaaaatataagtttaaaggatataatactggtgaagatttatacaaattgaatataaatgatcaagaaatagaaatattagcaaaatatgataaagaaaataataaaatatttgcatcattccataatcaaacatatatatatacatgtatagaagattccttaggaacacatatgaatttagggaaagataatgtatttattcctgttattactaatccatatcatttaatatcaaatacaaatggaaaaattgtaaaatatttaataaaagatggtgaaaaaattaacaaatttgatgattacatagaagtagaagcgatgaaaatgattatgacttttaaatctactgaaactggtatattaaagcataagatgtcagaaggtgctatgataaaaattggtgatttattaggagttatagaaaaggaaaaggataatcaaaattaccaaaatgatgataataataacaaaattattgattttattgggcatctaaatttgtcaaacaaaaatgcatatgaattaaacggaacatttgttccagacttagcagaagagtcacataataacgaagtatgctgtaaaaacattgaaaaagaaaaaatggaaaacctcagaaaaattgaagatccgaaaaataataaaatttatcccacaaaacacaccaatagaaattcacaggttaatacaacaaatgaatcagtgtctgttcaagatataaaaacggaaaatatgaaaaaagatgaaagccaattttgcacagaagataaacaaatacaaaataaccaagtaaatagacggaataaattgtttttgaaaaaaaataatggaaaaaataacaaaaataatatgtttcgtttattttcccagaaaaatgataatgacagtaaaataatagattcgaatatagaaagtaactccagagatgatactttaagttatgataagataaataaaaaaaatactaacaatgaatcattaaaagccaccaaaaaagaaccaaaagatgctacaaatatgctcgaaacaactaaagaaacgtctataggatcaaaaaattatttaaatgaaaaattaaattctgttaaaaaatatttaacgaatttaaatttatcgataacaaataccataaataaaatgagtacaacacctaatgaagaattaataaatgatatttctgaaaataatttatctactacaaatacaatgcataatgattcaatcgttaattctggtagcaatgattcacttgttagtcaaagaacgaataatatatcagaagaaaagatagataataataaaaaattgatatcttatgacaattataagaatcaatcatataaagacaaaatagtttctagtgaaattgattttccggtaaataataccaaagataaaaaattggataaaatgaaaataattagtgacaccgaaatgagcagaagcaatgatgacaattcacaaagtagtagaaatagaaccaatacaaattacaatgaaaagattgaattaaattttgataacaagaaagataaagaaaatgaatttttccttgaattatcaaacatgaaaagaattgaatatttattaaaaggatatgamcaagactatgaaaaatgctttgaagatttcttaaaagacaaaaataattttgataaaaatctaaattatatattagataaatttatagaatataatcatttattttctaaaaaggaaattattagcgaagtagaaatttattatattttatataaaagcattagtgataagaaaaaacaatatgaaattatacatgcatatacatacaactatttaagtataaaacttctagaaaaaatattaaacaatttaataaatagtaaacaaactaatttgtctttgcaaattttaaataaaataaaaatattaaaagaattcaaaggaaagatttttggatctataattttgctatcaagatacattatatacttatatgaacagaatgaaaaaattcattatttagaatcttcttttcaatataataaaaatatggaagatatgaagaagcaaagtttacaaaattatatccgttttcttactaagtcgagcaatatggataattataaaatagatcaaatcttaaataatacaaattatgaagaaaagataaaattatttttaaaatcaccatctgatatccattattctttaccatttttatttaaaactgaaaatgttaattatcaagaaatgttcaatacatatttacataatttatacaaatattctactataaaagctaagccacattcacctaattgtttagtattttctataaataatcatgaatataacaacgtcatgttaaatttaaatgaagacatcactattgaacaatttaaaagtatgctggatgatatattatatgaaatgaaatctgacaagataaatacattccatataataaataaaaatgaaaccttctttaattcactgcaaaactatttagataatgctttcaaaaaagttaatactttatatatatataactattttggaaataaatatggagaaattcataaaattaatatgaacgcatataaagaacgagaaaaaatacaagacaacctcgaaaaaagtccaatagaaactaataaaaatgattctactataaataataaaatatatctccttccttttgaagaagaaattcttacttcagagaatattgcatcaaattttgaattaaaaaatgtaggacaggaagtatttaataagactaaaatattactaggaacatacaaacaaaacaataaatacacttcgttatttgctcaaagaataattgatataaatgatttacaaaaacaagttgattcagacaatataaaggtatatgatgaacaagagaatgttggaatgaccaaaaatggaaaaaataatatactattgtcaaaaaatatagaaaatggtcaaatgaacaatcaaatttatgatatatttatgtctgaattaaaagaatctatagaagatataagcatttatagattaaacccatcaattcgggatattaaaattagtagcaatataatatatcatatagtattacctaataactcaaatatagaagatcaaataaatggaattaaagaaatttataaaaatttcctcaataaatataatgaacttttcatagaaaactatgttaataatgtatatattaaagtatataaagaaattgaagaagaaaaaaataatgaaacaaaattagagcttaaccaattgttgaaattgcatgttctttttgataatgaaaaagaggttattgaaaaagtggataaaataaatccagttattatcgatgcattgtacttaaaacgaaagagagcaagggatgtagatactatatatgcttatgattttgttaagcttataaacatagcattaaataggataaataatactttgaatgataattttaattatattaatagtgtgaaagaattcaagatagattatagtagggaaaactccgaagaaataaatgatacagtaagtgtgggaaagaaagaaaaatctcaacctaacaaaaatgataaacaatctaaatggctttttgaaaattttgacaatttaagtagtgatgaaattcgaataaaaaaatcactttatttatcaaactctttggaaataggacaaaataaaatgagcgtaatcggattgttaatgaatgtaaagacagatgaatataaagaaggaagagatattgcttttataataaatgatattacaacaaatggaggtgcatttagtgttttagaagacgaactattttatggagtatcatgttatgcgagagaaaaaaaaataccacgtatatgtatatcttgcaattccggagcaaaaattggattatataattatcttatggataaaattaaagtatgctggaatgatgaaaacaaaaaagaacttggatataaatatatatatataacagaagaagtaaaagaaacaattcctaaaaaagatattatttatttaagagaaatttatgaaaatggagaaaaaagatatataattgatgctatagtaggaaatttaaataatcatataggagtagaaaatttaagaggtagtggattaatagcaggagaaacctcaaaggcttatgatgagatttttactctttcatatgtcactggaagaagtgttggaattggtgcttatttagttagattaggtaaacgaactattcaaaaaaaaggatcgtctcttttactaactggttttaatgctttaaataaaatattaggtgaaaaggtatatataagtaatgaacaattaggaggtgtaaatattatgatgaaaaatggaatatctcaattagaagctgaaaatgaccaggatggagtaaataaaattttcaaatggttatcatatgttcctaaaactagtgacaattattttgatgttcttggggaatcaacaaaatcatttcacaataaattacaagaagataacaaatgtgatattaccaaatctagaaacttaaacaattcaattgattctgaccaacaatccaataattatccaaatggatacattaatgatcaagacatacaagagtatgcaaaaaagaacagtttgcacagcagttcagatagtactactgttgaaccagaaagtatcaaagaatgtgatacttcacttatacacatcaatggaaataatggtgatgaagaatcagggaacgaaattagtgatacgatttcagataactggaacaaaataaatgatgtagatatggacaatgtaaatgaagcagatattatcgaattactaaaagggtcagataaaaaacaaggatttttagacaaaaatagttactttgaatatatgaatgaatggggaaaaggtattataactggaagaggaaaattaggatcaataccaattggttttattgctgtaaataaaaatttagttacccaaactgttccatgtgatccagcattgaaaactaaggctataaaaacaacaaatgccccatgtgtttttgtgcctgataattcgtacaaaactgcccaatctattgaagattttaataaagaaaatttacctttatttgtctttgcaaattggagaggtttttcaggaggtactatggatatgtttaacagtatcttaaaatttggatcaatgatagttaatcaattagttaattataagcatcccgtttttgtatacatacctattttgggagaacttagaggtgggtcttgggtagtagtagatgaaacattgaacagccaaataatagaaatgtatgcagatactaatagtaaaggtggaatattagaacctccaggattagtagaagtcaaatttaagttcgcagaaattaagaaattaatgaataacagtgatccatatataatagaactaaatcagaaactcgcgactcttcagaatgaagaagaaattttaagtgtaaaaaaggaaatagaaaagaaggaaaaggaaatgcttccattttatttacaagtgtgtcataaatatgcagatctacatgatgtatcatcatgtatgaaggagaaaggtgttattagaaaaattgttccatgggaaaaatctagatcctttttctattatcgcttattaaggagattgatattacatacattaaagtaa

SEQ ID NO: 4795 - protein, 2911 aa, Plasmodium yoelii yoelii
  misc_feature (1554)..(1554): Xaa can be Asp or Glu
MISIFLSILLFVLIFENPTKSIKIRNTYYMHMYNNVNINNFAEKETRGQYPNRKGTNDVLSENYRNKFMPLFVSKGTNILNSILKNKTFRYIYNDPERNTKKNSKNNSKNLAFLYTLHKHSNTLSRISKSKSFQGDDIEKLENNNDEDNDSTNNISSRSNSNDIDKTYSFDHIGNNLNEDPEKKIFSFTSNRKDAQSGFRDDSNSSYITKDNLKKKSDSVNNREKKVLENLIDNFSNLNWSNNIIDDANLNQPQYSKEFGSYIKSENDKSLHYYSDGILDHLYSYKKFSTKNKKKKNLNKLFYSFKPLENVHTIKKGTITAQPIQNNAEIGTPLSHSDKNGISMSNINKRQIKFGDKRIYMKKGDTCERDENEHIDDTEFLTYEETNNIKKKAYKDYINYINERRYPYINYLKMKNEKIIKKLLIANNGMAALKCILSLKEWLFKTFNDENLIQIIVLATEDDIKSNSKYISLSDKVIKVPPGKNSYNYANVSLIVDIAKKENVDAVWPGWGHCSENPLLSSMLEKENIIFVGPTDNVMEALGDKISANILAQSVNVPVVKWSGDNLKIKDFENNSISQDIYNKSTIHSLEECIRECKRIGYPVMIKASQGGGGKGIRKVENENEIKKYYEQVQNELPNSPIFLMKVCSNVRHIEIQVVGDMYGNVCSLSGRDCTTQRRFQKIFEEGPPSIVPPHTFREMEKASIRLTKMIKYRGAGTIEYLYDQVNNKYYFLELNTRLQVEHPVSEGITDTNIVAIQLQVAMGIPLQNIDDIKKLYKIEEKTKKNTSSSSVSIVNDKLKLPISEKDNNKTVKTNLSEQLGMFDFYNNMPHTKNHVIAARITAENSNDSFKPTSGLVKNVNFQNSKDVWGYFSINNGFVHEFSDSQIGHIFAKGETREIARKNLILALRKLSIDGEIKTVTKYLAKILESKAFIDNNITTNWLDVVIERKKNIYYNAFHIIILCAAIFKLLIYFMKEMENTEDSLNREDIAIKSENNINDISLNGKMKRAHIFDIIFQNVKYKFKGYNTGEDLYKLNINDQEIEILAKYDKENNKIFASFHNQTYIYTCIEDSLGTHMNLGKDNVFIPVITNPYHLISNTNGKIVKYLIKDGEKINKFDDYIEVEAMKMIMTFKSTETGILKHKMSEGAMIKIGDLLGVIEKEKDNQNYQNDDNNNKIIDFIGHLNLSNKNAYELNGTFVPDLAEESHNNEVCCKNIEKEKMENLRKIEDPKNNKIYPTKHTNRNSQVNTTNESVSVQDIKTENMKKDESQFCTEDKQIQNNQVNRRNKLFLKKNNGKNNKNNMFRLFSQKNDNDSKIIDSNIESNSRDDTLSYDKINKKNTNNESLKATKKEPKDATNMLETTKETSIGSKNYLNEKLNSVKKYLTNLNLSITNTINKMSTTPNEELINDISENNLSTTNTMHNDSIVNSGSNDSLVSQRTNNISEEKIDNNKKLISYDNYKNQSYKDKIVSSEIDFPVNNTKDKKLDKMKIISDTEMSRSNDDNSQSSRNRTNTNYNEKIELNFDNKKDKENEFFLELSNMKRIEYLLKGYXQDYEKCFEDFLKDKNNFDKNLNYILDKFIEYNHLFSKKEIISEVEIYYILYKSISDKKKQYEIIHAYTYNYLSIKLLEKILNNLINSKQTNLSLQILNKIKILKEFKGKIFGSIILLSRYIIYLYEQNEKIHYLESSFQYNKNMEDMKKQSLQNYIRFLTKSSNMDNYKIDQILNNTNYEEKIKLFLKSPSDIHYSLPFLFKTENVNYQEMFNTYLHNLYKYSTIKAKPHSPNCLVFSINNHEYNNVMLNLNEDITIEQFKSMLDDILYEMKSDKINTFHIINKNETFFNSLQNYLDNAFKKVNTLYIYNYFGNKYGEIHKINMNAYKEREKIQDNLEKSPIETNKNDSTINNKIYLLPFEEEILTSENIASNFELKNVGQEVFNKTKILLGTYKQNNKYTSLFAQRIIDINDLQKQVDSDNIKVYDEQENVGMTKNGKNNILLSKNIENGQMNNQIYDIFMSELKESIEDISIYRLNPSIRDIKISSNIIYHIVLPNNSNIEDQINGIKEIYKNFLNKYNELFIENYVNNVYIKVYKEIEEEKNNETKLELNQLLKLHVLFDNEKEVIEKVDKINPVIIDALYLKRKRARDVDTIYAYDFVKLINIALNRINNTLNDNFNYINSVKEFKIDYSRENSEEINDTVSVGKKEKSQPNKNDKQSKWLFENFDNLSSDEIRIKKSLYLSNSLEIGQNKMSVIGLLMNVKTDEYKEGRDIAFIINDITTNGGAFSVLEDELFYGVSCYAREKKIPRICISCNSGAKIGLYNYLMDKIKVCWNDENKKELGYKYIYITEEVKETIPKKDIIYLREIYENGEKRYIIDAIVGNLNNHIGVENLRGSGLIAGETSKAYDEIFTLSYVTGRSVGIGAYLVRLGKRTIQKKGSSLLLTGFNALNKILGEKVYISNEQLGGVNIMMKNGISQLEAENDQDGVNKIFKWLSYVPKTSDNYFDVLGESTKSFHNKLQEDNKCDITKSRNLNNSIDSDQQSNNYPNGYINDQDIQEYAKKNSLHSSSDSTTVEPESIKECDTSLIHINGNNGDEESGNEISDTISDNWNKINDVDMDNVNEADIIELLKGSDKKQGFLDKNSYFEYMNEWGKGIITGRGKLGSIPIGFIAVNKNLVTQTVPCDPALKTKAIKTTNAPCVFVPDNSYKTAQSIEDFNKENLPLFVFANWRGFSGGTMDMFNSILKFGSMIVNQLVNYKHPVFVYIPILGELRGGSWVVVDETLNSQIIEMYADTNSKGGILEPPGLVEVKFKFAEIKKLMNNSDPYIIELNQKLATLQNEEEILSVKKEIEKKEKEMLPFYLQVCHKYADLHDVSSCMKEKGVIRKIVPWEKSRSFFYYRLLRRLILHTLK

SEQ ID NO: 4796 - DNA, 6828 bp, Neurospora crassa
  CDS (1)..(6828)
atggcggacacaacagcgagcgacgccgtcgtccaggcttcgtatgccgccaagcacaacctggccccccatttcattggcggcaacaggcttgagaatgcccctccctccaaggtcaaggactttgtggcctcccacgatggtcacactgtcatcaccaacgtccttattgccaacaacggtattgctgccgtcaaggagattcgctcagtaaggaaatgggcttacgaaacattcggcgacgagcgcgccatcaagttcaccgttatggccacccccgaagatctgcaggccaacgccgactacatcaggatggccgatcactatgttgaagtccccggcggcacaaataaccacaactatgccaacgtcgagctgatcgtggatattgccgagcgtatggatgtccacgccgtgtgggctggttggggtcacgcctccgaaaaccccaagctccccgagtcccttgcggcttcccccaagaagattgtcttcattggtcctccgggttctgccatgcgctcccttggtgacaagatttcctcgacaattgttgcccagcacgccgacgttccctgtatcccttggtctggtaccggtgttagcgaggtcaaggtcgacgacaatggcattgttacggttcccgatgacgtttacctcaagggctgcgtcagctcgtggcaggagggtctggaaaaggccagggaaattggtttcccagtaatgatcaaggcctccgaaggtggtggtggcaagggtatccgcaaggtcctcaacgaggacaacttcgagtcgctctacaacgctgccgctagcgaaattcccggctcacccatttttatcatgaagctcgccgacagcgccaggcatttggaggttcagcttcttgctgatcagtacggcaacaacatctcccttttcggcagagattgctcggtccagcgcagacatcaaaagattatcgaagaggcccccgtcaccatcgccaagcccatgaccttcaaggccatggaggaggctgctgtccgtcttggtcgtctcgtcggttacgtctcggccggtaccgtcgagtacctctactcccacgccgatgacaagttctacttcctcgagttgaacccccgtctgcaggtcgagcatcctaccactgaaatggtcagtggtgtcaaccttccggctgctcagctccaggttgccatgggtattcccctccaccgcatccgcgacatcagactgctctacggcgtcgaccccaggactgccagcgagatcgacttcgagttcaagaaccccgagtccgagaagacccagcgcaggcctacccccaagggccacaccactgcctgccgtatcacctccgaggatcccggtgagggtttcaagccatccaacggtgtgttgcacgatctcaacttccgttcgagctccaacgtctggggttacttctccgtcggttctgccggtggtattcacagtttctccgactcgcagttcggtcacatctttgcctatggcgagaaccgtgccgcctcccgaaagcacatggtcgttgccctcaaggaattgagcatccgcggtgacttccgtaccaccgtcgagtacctcatcaagcttttggagactgaggccttcgaggagaacaccatcactaccggctggctcgatgagcttatttccaagaagctcactgctgagcgtcccgaccccattctggccgttgtttgcggtgccgtcaccaaggcccacattgcgagcgaaggctgcatgaccgagtaccgtgctggccttgagaagggtcaggtcccctccaaggacatcctcaagactgtcttccccgtcgactttatctacgagggttaccgctacaagttcaccgtcaccaggtcgagcgccgatagctaccatctcttcatcaacggctccaagtgcactgtcggcgttcgtgctctgagcgatggtggactcctcatccttctcaacggccgcagtcacaacgtttactggaaggaagaggtcgctgctacccgcatgtcggtcgatagcaagacctgtctgctggagcaggagaacgatcccacccagttgcgcaccccctctcccggtaagctcgtcaagtacaccgtcgagaacggcgaacacgtcagcgccggccagaccttcgctgaggtcgaggtcatgaagatgtacatgcctctcattgcccaggaggatggtatcgtccagcttatcaagcagcccggcgctactctcgaggccggtgacattcttggtatcctcgctctcgatgatcccagccgtgtcaagcaggcccagcctttcctcggccagcttcccgagtttggtgcccctgttgttgtcggcagcaagcccgctcagagattccgccttctctatgacactcttcagaacatcctcatgggctacgacaaccagatcatcatgcagcagaccctgaaggatctgattgaagttcttcgtgaccccaagctcccttacagcgagttcaccgctcaattctcagcccttcatgcccgtatgcctcagaagctcgacgcccaacttactcaggtcctcgaaaaggcctcttcgcgttcggccgagttccctgcccgcaatctcggcaaggtcttccagaagttcctggacgagaacgttgcctccaaggttgacgctgagctgctgaagaccaccttggcccctctcaccaccgtcatcgaccagtactctgagggccagaaggtccatgagctcaatgtcattcgcgatcttcttacttcttacgtcgaggtcgagcgtctcttttctggccgtcgtctgcaggacgaggaggttattctcaagctgcgtgatgagaacaaggaggacatcaagaaggtcacccagactgttctctctcacagcagggttgcggccaagaactcgctcattctcgcgattctggacgagtaccgccccaacaagcccaacgttggcaacgtcagcaagtaccttcgtcccgtccttcgcaagcttgccgagctcgagtctcgtcagactgccaaggtttccctcaaggctcgtgagatcttgatccagtgcgctttgccctctctcgaggagagaaccgctcagatggagcacattcttcgctcctctgtcgtcgagtctcgctacggtgagactggctgggatcaccgtgagcctagcttggacatcatcaaggaggttgtggactccaagtacactgtctttgatgtcctgacccttttctttgcccacgaggatccttgggtgtccctcgctgcccttgaggtctatgtgcgccgcgcctaccgcgcttacgttttgaagaagattgagtaccacaccgatgagaccgagactccttccttcttgtcctgggatttctctctgcgcaagcttggccactccgagttcggcctgcccatccagtccgctgccccctccaccccgggtacacctgtggacagcaccttcaagcgcatcagctctatcagcgatatgtcctacctttcccacaagactcaggatgagcctacccgcaagggtgtgatcattccctgcaagttcttggatgatgcggatgagctcctcagtagggctcttgagaagctccccgtgctcggagcccgcaagagaaacagcgtgattcccgatctcaacgagaagcgcagacctcctcttcagcgcctggagaccttcgacgagctctccgctgtcgtcaacgttgccgtccgtgatgccgagggtcgcagcgacgaggagattcttaaggagattcttcctcttgtgcaccaacacagggaggacctgtttgcccgccgggtccgccgcatcacattcgtctgtggtcgcaacgatggctcctaccctggctacttcactttccgtggccctgagtacgttgaggacgatagcatccgtcacagcgagcctgctcttgcgttccagctcgagctcggacgtctgtccaagttcaagatcaagcctgtcttcaccgagaacaagaacattcatgtgtacgaggcgattggcaagggtgtcgagaccgacaagcgctacttcactcgcgctgtcattcgtcctggccgtctgagggacgagattcctactgccgaatacctcatctcggaggccgatcgcgtcatcaacgacattttcgatgctcttgagattatcggcaataacaattccgatctcaaccacatgttcctgaacttcactccggtcttccagcttcagcccgaggaagttgagcactccctccagggcttccttgaccgcttcggccctcgtggctggcgcctccgtgttgcccaggttgagattcgcatcatctgcactgaccctgctactggcatgccctacccgttgcgtgttatcatcaccaacacctccggctatgtcatccaggtcgagctctacgccgagcgcaagtcggagaagggcgagtgggtgttccactccatcggtggcaccaccaagatcggctccatgcacttgctgccggtcaacacgccgtaccccaccaagaactggctccagcctaagcgttacaaggctcacctcatgggcacccagtacgtctatgacttccctgagctcttccgccaggctatccagaacagctgggtcaaggctgtccggatggactcgtctcttgccgacaagcagccccctgttggcgagtgcattgagttcagcgagctcgtgcttgatgaccacgacaacttgatcgaggtctcgcgtgagcctggcaccaacacttgcggcatggttggatggctcatccgtgcgagaacccccgagtaccccaacggtcgcaagttcgttgtcgtcgccaacgacatcaccttcaacatcggctcgttcggtcccaaggaggacaacttcttcttcaagtgcactgagcttgcccgtaagctgggtattcctcgcatctacctgtccgccaactcgggtgcccgcttgggtctcgctaccgagcttatgcctcacttcagcgttgcctggaacgaccccagcaagcccgaggctggcttcaagtacctctacctcgacgatgcgggcaagaagcgctttgagaacactgtcatcaccgaggagattaccgaaggagacgagaagcgccacaagattgtcacgatcgttggtgctgaggatggtctcggtgttgagtgcttgcgtggctctggtctcattgccggtgccaccagcagggcctacaacgatatctttacctgcacgctcgtcacctgccgctccgttggtattggtgcttaccttgtccgtcttggtcagcgtgctgttcagattgagggccagcccatcattctcactggtgcccctgccctcaacaacgtcttgggtcgccaggtctacacctccaacctgcagcttggtggtacccagatcatgtaccgcaacggtgtctcccatttgaccgccaacgatgactttgctggtgtctccaagatcgtcgagtggatgtcgtttgttcctgacaagcgcaataaccctgtgcctatcagcgtcagtgtcgacacttgggatcgtgacgttgtctacaccccgcctcagaagcagccttacgacgtcaggtggatgatcggtggcaaggaggacgagaacggctaccagcctggtctcttcgacaaggactccttcgtcgagactcttggtggatgggccaggactgtcgtcgttggtcgcgctcgccttggcggtatccccatgggtgtcatcgctgtcgagacccgctctgttgagaacatcactcctgccgatcccgccaaccctgactcgatcgagcaggtggccaacgaggctggtggtgtctggtaccccaactccgccttcaagaccgcccaggccattaacgacttcaacaatggcgagcagcttccgctcatgatccttgccaactggcgtggtttctctggtggtcagcgcgacatgtacaacgaggttctcaagtacggttctttcatcgtcgacgccctcgtcaagttcgagcagcctgtcttcatctacattcctcccttcggcgagcttcgtggtggctcgtgggtcgtcgtcgatcccaccatcaaccctgtcgccatggagatgtatgctgatgtggatgctcgcggtggtgttttggagcctgagggtatcattggtatcaagtaccgcaaggacaagcagcttgagactatggcccgccttgaccccgtctatgccgacctcaagaggcagagcgccgatgccagcctccccaaggaggagtctgatgcgatcaagcagaagatgactgagcgcgagcagcagcttctgcccgtttatgctcagatcagcgtgcagttcgctgatctccacgatcgcgctggtcgcatgaaggccaagggtgtcattcgcgaggttcttgagtggcagaacgcccgccgcttcttctactggcgtgtgcgcagaagactcaacgaggagtacattctccgtcgcatcatctcggctactactcctggcggtgccccaagcaaggctctcactgccagctcgaccaaggagcgcgctcgccacctccagcttctccaggcctggagcggcattgagaagttcgacaccgccgaccgcgaggttgccgtctggtacgaggagaaccgccacctggtccagactaagatcgatgccctcaaggccgaggcgatcaccacggagatgcgcgacctcatccgcgctgcctccaagggctctgatgacgctgcctggaagggtgtccgtgatatcctgagcgttatgccggttgaggagagagagaaggtcgtcaagtaccttactactctctaa

SEQ ID NO: 4797 - protein, 2275 aa, Neurospora crassa
MADTTASDAVVQASYAAKHNLAPHFIGGNRLENAPPSKVKDFVASHDGHTVITNVLIANNGIAAVKEIRSVRKWAYETFGDERAIKFTVMATPEDLQANADYIRMADHYVEVPGGTNNHNYANVELIVDIAERMDVHAVWAGWGHASENPKLPESLAASPKKIVFIGPPGSAMRSLGDKISSTIVAQHADVPCIPWSGTGVSEVKVDDNGIVTVPDDVYLKGCVSSWQEGLEKAREIGFPVMIKASEGGGGKGIRKVLNEDNFESLYNAAASEIPGSPIFIMKLADSARHLEVQLLADQYGNNISLFGRDCSVQRRHQKIIEEAPVTIAKPMTFKAMEEAAVRLGRLVGYVSAGTVEYLYSHADDKFYFLELNPRLQVEHPTTEMVSGVNLPAAQLQVAMGIPLHRIRDIRLLYGVDPRTASEIDFEFKNPESEKTQRRPTPKGHTTACRITSEDPGEGFKPSNGVLHDLNFRSSSNVWGYFSVGSAGGIHSFSDSQFGHIFAYGENRAASRKHMVVALKELSIRGDFRTTVEYLIKLLETEAFEENTITTGWLDELISKKLTAERPDPILAVVCGAVTKAHIASEGCMTEYRAGLEKGQVPSKDILKTVFPVDFIYEGYRYKFTVTRSSADSYHLFINGSKCTVGVRALSDGGLLILLNGRSHNVYWKEEVAATRMSVDSKTCLLEQENDPTQLRTPSPGKLVKYTVENGEHVSAGQTFAEVEVMKMYMPLIAQEDGIVQLIKQPGATLEAGDILGILALDDPSRVKQAQPFLGQLPEFGAPVVVGSKPAQRFRLLYDTLQNILMGYDNQIIMQQTLKDLIEVLRDPKLPYSEFTAQFSALHARMPQKLDAQLTQVLEKASSRSAEFPARNLGKVFQKFLDENVASKVDAELLKTTLAPLTTVIDQYSEGQKVHELNVIRDLLTSYVEVERLFSGRRLQDEEVILKLRDENKEDIKKVTQTVLSHSRVAAKNSLILAILDEYRPNKPNVGNVSKYLRPVLRKLAELESRQTAKVSLKAREILIQCALPSLEERTAQMEHILRSSVVESRYGETGWDHREPSLDIIKEVVDSKYTVFDVLTLFFAHEDPWVSLAALEVYVRRAYRAYVLKKIEYHTDETETPSFLSWDFSLRKLGHSEFGLPIQSAAPSTPGTPVDSTFKRISSISDMSYLSHKTQDEPTRKGVIIPCKFLDDADELLSRALEKLPVLGARKRNSVIPDLNEKRRPPLQRLETFDELSAVVNVAVRDAEGRSDEEILKEILPLVHQHREDLFARRVRRITFVCGRNDGSYPGYFTFRGPEYVEDDSIRHSEPALAFQLELGRLSKFKIKPVFTENKNIHVYEAIGKGVETDKRYFTRAVIRPGRLRDEIPTAEYLISEADRVINDIFDALEIIGNNNSDLNHMFLNFTPVFQLQPEEVEHSLQGFLDRFGPRGWRLRVAQVEIRIICTDPATGMPYPLRVIITNTSGYVIQVELYAERKSEKGEWVFHSIGGTTKIGSMHLLPVNTPYPTKNWLQPKRYKAHLMGTQYVYDFPELFRQAIQNSWVKAVRMDSSLADKQPPVGECIEFSELVLDDHDNLIEVSREPGTNTCGMVGWLIRARTPEYPNGRKFVVVANDITFNIGSFGPKEDNFFFKCTELARKLGIPRIYLSANSGARLGLATELMPHFSVAWNDPSKPEAGFKYLYLDDAGKKRFENTVITEEITEGDEKRHKIVTIVGAEDGLGVECLRGSGLIAGATSRAYNDIFTCTLVTCRSVGIGAYLVRLGQRAVQIEGQPIILTGAPALNNVLGRQVYTSNLQLGGTQIMYRNGVSHLTANDDFAGVSKIVEWMSFVPDKRNNPVPISVSVDTWDRDVVYTPPQKQPYDVRWMIGGKEDENGYQPGLFDKDSFVETLGGWARTVVVGRARLGGIPMGVIAVETRSVENITPADPANPDSIEQVANEAGGVWYPNSAFKTAQAINDFNNGEQLPLMILANWRGFSGGQRDMYNEVLKYGSFIVDALVKFEQPVFIYIPPFGELRGGSWVVVDPTINPVAMEMYADVDARGGVLEPEGIIGIKYRKDKQLETMARLDPVYADLKRQSADASLPKEESDAIKQKMTEREQQLLPVYAQISVQFADLHDRAGRMKAKGVIREVLEWQNARRFFYWRVRRRLNEEYILRRIISATTPGGAPSKALTASSTKERARHLQLLQAWSGIEKFDTADREVAVWYEENRHLVQTKIDALKAEAITTEMRDLIRAASKGSDDAAWKGVRDILSVMPVEEREKVVKYLTTL

SEQ ID NO: 4798 - DNA, 2232 bp, Neurospora crassa
  CDS (1)..(2232)
atgcgatccatcaaacggacttcacgccgtctcccggcctctttgcgcgccgttcccacctctgtacctggcttgggagcccgcttcctctcgacaaccgcccctacctcgtcgacagtcacgatcaatggcagcacagatacgtcggtaactcccatttcatccgttctcattgcgaaccgtggtgagatagctctccgcgttgctcgaacggcggcgtctatgggcatccgcaccacgaccctctacactgatatcgatgccgcttcccaacatgccaagtgcaccccctatgccctctccctcggcgctccctcggcctacctcgatgggccacgcattgttgagctcgcaaagcaacatggcatccaggctctccacccgggttacggtttcctgagcgagaaccctgcctttgccaaggcctgcgaggaggccggtattgtctttgtcggtcctcccgccaaggccatgaccgacatgggcgacaaggcccgcagcaaggagatcatgaacgcctccggcgtgccatgcgtccctggctaccatggctccgagcagtctgtcgagcagctcaaggccaaggccgccgacatcaaataccccgtcttgctcaagagcgtcaagggaggtggcggtaagggtatgcgtattgtgcgcaacgcggacgagttcgaggcccagctgaagagcgcaagggctgaggcacgcgctagctttggtgaaggtggtgaggtgatgctcgtggagaagtacattgtgcggcccaggcacgtcgaggtccagatcttcgctgatcgtcatggtaactgcgtggcccttggcgagcgcgattgtagtgtccaaaggagacatcagaagatcctcgaggagagccctgcacccttgttggacgatgtaacacggaaagatctatgggacaaggcaaggaaggctgcccttgctgtggactacgtgggcgccggcaccgtcgagttcatcttggacaaggacaccaacgagttctactttatggaaatgaacactcgcctccaggtagagcatcccgtcagtgagatggtcacgggtaccgaccttgtcgagtggcagtttagggttgctgccggcgagaagcttcccttgacccagggcgaaatcgaagccaggattctggaaagaggtgccgccatcgaggccaggatatacgctgagaacccggagaagggcttcttccctgactcaggcactctggtacatctctcaaaacctcaaacaaacgaagacgtccgcattgacgccggcttcgtggaaggtgacaccgtttctgaggcctacgacgggatgatcgccaagcttatcgtccggggcaaggatagagagacggccatccgcaagctcgaactggccttgcgcgaatacgaagttgtcgggctgagcacaaacattgagttcctcaagagactctgtaacagccaagcctttatcgaaggtgatgtcgagaccgggttcatcgacaagtggaagacagaactgtttgaagccaagcctacctccaatgatgtgttcgcccaagcggcccttggtctcctaggcacccagacacaaaatgtccctgctgcacatggtcaggccctcggcttcggcgaagccactacccagaactcgcgcaagttcgcgttccgtgtccaagacgatgccagtaccgaggaaggcaagatcgtcgaggttgaagttgcgcagctgaacaacaagctgttcaccgtgtccgtccgcaaggagggcgatgacaagccgcaagtgtttgagaatattgtgtccaagtcaacttctacaacggccccgacctcatcagcgaagaagaccaagctgactacgtacttccctcttgcgagggtcgacacaacattggtccaggaccctgcggataacgagaagttgacggtcttccagcttggtcacaagactcagctcagactcgtcagcccagtgtggtttgataaggcgctgggcttgaaggaagttgcggctagcgtggtggcgccgatgccttgcaagattttgaggaatgaagttgaagagggtcagccggtggagaagggtgccccgttggttgttatcgagtcgatgaagatggagacggttattcggtcgccccagagcggcgtaatcaagaagctggcacacaaggaaggagatatctgcaaggctggaacggtgttggtcacgttcgaagagactgaggagagcgcttag

SEQ ID NO: 4799 - protein, 743 aa, Neurospora crassa
MRSIKRTSRRLPASLRAVPTSVPGLGARFLSTTAPTSSTVTINGSTDTSVTPISSVLIANRGEIALRVARTAASMGIRTTTLYTDIDAASQHAKCTPYALSLGAPSAYLDGPRIVELAKQHGIQALHPGYGFLSENPAFAKACEEAGIVFVGPPAKAMTDMGDKARSKEIMNASGVPCVPGYHGSEQSVEQLKAKAADIKYPVLLKSVKGGGGKGMRIVRNADEFEAQLKSARAEARASFGEGGEVMLVEKYIVRPRHVEVQIFADRHGNCVALGERDCSVQRRHQKILEESPAPLLDDVTRKDLWDKARKAALAVDYVGAGTVEFILDKDTNEFYFMEMNTRLQVEHPVSEMVTGTDLVEWQFRVAAGEKLPLTQGEIEARILERGAAIEARIYAENPEKGFFPDSGTLVHLSKPQTNEDVRIDAGFVEGDTVSEAYDGMIAKLIVRGKDRETAIRKLELALREYEVVGLSTNIEFLKRLCNSQAFIEGDVETGFIDKWKTELFEAKPTSNDVFAQAALGLLGTQTQNVPAAHGQALGFGEATTQNSRKFAFRVQDDASTEEGKIVEVEVAQLNNKLFTVSVRKEGDDKPQVFENIVSKSTSTTAPTSSAKKTKLTTYFPLARVDTTLVQDPADNEKLTVFQLGHKTQLRLVSPVWFDKALGLKEVAASVVAPMPCKILRNEVEEGQPVEKGAPLVVIESMKMETVIRSPQSGVIKKLAHKEGDICKAGTVLVTFEETEESA

SEQ ID NO: 4800 - DNA, 1347 bp, Synechococcus sp
  CDS (1)..(1347)
atgcccatcggcaaagtgctgatcgccaaccgcggcgaaattgccctccggatcttgcgcagctgccgcgaactcggcatcgccaccgtggccgtttacagcacggttgataaagacgcgctccatgttcagctggccgatgaagcggtctgcgtcggcgacgccctgagcagcaagagctatctcaatgttcccaacatcctggccgccgccacctcccgcggggtcgacgcgatccatcccggttacggcttcctggctgaaaacgacaaattcgccgagatgtgcggcgaccacggcctgaccttcatcggtccctccccccacgcgatccgctccatgggggacaaatccaccgccaaggccaccatgcaggccgtgggcgttccaaccgttcccggcagcgagggattgctggcgggaccacaggatgccgccgtgctggcggagcagatggggtatcccgtgatgatcaaagccaccgccggaggcggcggccgtggcatgcgtctggtgcagagcccggaccagctgaacaatctgttcaaggccgcccagggagaggcggaggccgccttcggtaatcccgggctgtacatggagaaattcatcgatcgcccccggcacgtggaagtgcaggtgctggcggaccgccacggcaatgtcgttcacctcggcgaacgggactgctcgattcagcgacgccatcagaaactgctggaggaagcccccagcccggccctggatcctgatctacgccgtcgcatgggtgaagcggccgtggccgcagcccgcagcattaactacgagggcgctggcactgtcgagttcctgctcgaccgcagcggtgggttctatttcatggagatgaacacccgcatccaggtggagcatccggtgacggagatggtgaccgggatcgacctgatcgccgagcaactgcgcattgccggtggagagcccatcagcgttcagcagggggagatcaacctctccggccatgcgatcgaatgccggatcaacgccgaagacgccacccacaatttccgaccagcacctgggcgcatcaccggctggcttccaccgggcggtcctggtgtccgtgtcgatagccatgtgtacaccggctacgacatcccgccgttctacgactctctgatcggaaaggtgatcgtctggggtcgcaaccgcgacgtggcgttatcgcggatgaaacgcgccctgaatgaatgcgccgtcactgggattcccaccacggtggaatttcatctagccctgctggatcgcccggagttcatcaacggcgacgttcacaccaagttcgtcgagcaggacatgctcaactga

SEQ ID NO: 4801 - protein, 448 aa, Synechococcus sp
MPIGKVLIANRGEIALRILRSCRELGIATVAVYSTVDKDALHVQLADEAVCVGDALSSKSYLNVPNILAAATSRGVDAIHPGYGFLAENDKFAEMCGDHGLTFIGPSPHAIRSMGDKSTAKATMQAVGVPTVPGSEGLLAGPQDAAVLAEQMGYPVMIKATAGGGGRGMRLVQSPDQLNNLFKAAQGEAEAAFGNPGLYMEKFIDRPRHVEVQVLADRHGNVVHLGERDCSIQRRHQKLLEEAPSPALDPDLRRRMGEAAVAAARSINYEGAGTVEFLLDRSGGFYFMEMNTRIQVEHPVTEMVTGIDLIAEQLRIAGGEPISVQQGEINLSGHAIECRINAEDATHNFRPAPGRITGWLPPGGPGVRVDSHVYTGYDIPPFYDSLIGKVIVWGRNRDVALSRMKRALNECAVTGIPTTVEFHLALLDRPEFINGDVHTKFVEQDMLN

SEQ ID NO: 4802 - DNA, 3501 bp, Rhodopirellula baltica
  CDS (1)..(3501)
atggatgccctgatgaccgtcgctgatactgactccgccaatattcgcccgattcgaaaattgctggctgccaaccgcagcgaaatcgccacccgagtgtttcggtcagcacatgaattaggcattcgcacggtcgcaatctattctcacgaagaccgctacgcactgcaccgattcaaagccgacgaggcgtaccaaatcggaacgcccggcgagcccattcgttcttacctcaacatcgacgcgatcgtcgggttgtgtctcaagcatcacatcgatgcagtccacccgggttacggtttcttgtcggagaaccctgagttcgccaaagcgctcacggacgcgggcattttgtttgtcggtcccagcgaacaaagcttgcgagatttgggcgacaaaaccagcgcccgtcgcttggccgaaatcgcaggcgtgccagtactcggcggaaccgcacaagccgtctcgtcgctgaaagaagccaccgatgcggcggaaaaactcggctacccgatcatgctcaaagcggccaaaggcggtggcggtcgcggcatgcgagtcgtcatggaaccgagcgaattggccagctcactcgattccgctcagcgcgaagccaaaacagcattcggaagcgatgaagtgttcctggaacgttttgtccaacgagcccggcacttggaagtccaattgctcggcgaccgccatggcaacttggtccacttgtatgaacgcgactgcagcgttcaacgacggcaccagaaagttgtcgaacttgcccccgcaccgaacctttccaccgaaatgcgagacgcgatttgcgatgcggcgttgcgaatcggacgcgcggtcggcaaagaaagtggcggctacgagaacgcgggaacggttgagttcctgctcgacgtcgacaaagacgaattctacttcatcgaagtcaatccacgaatccaagtcgagcacaccgtgaccgaagaggtcactggcatcgacattgtccgcaaccaaatcctggtcgcgcaaggccatcctcttcacagcgaagaagtcggcctgccatcgcaggacgttatccgaaccatgggattcgcgatgcagtgccggatcacgacggaagatcccgccgccgagttccgtcccgactatggccgcatcagccactaccgaagtgcggcaggtttgggcgtccgtctcgatgcgggcacggcattcagcggagcggtcgtcaatcccttctacgattccatgttggtgaaggtcaccgcgagagctcccaccctggccgctgccgctcgccggatggatcggtgtctgcacgaatttcgaattcgcggcgtgaagacgaacattccgtttctgacgcggctggtcaatcatcccacattcttggccggcgaagccacgacgcgtttgatcgacacaaccccggaactgttccgtttgccacgccggcgtgaccgagccaccaagctgctgactttcttgggcgaaacgatcgtcaacggaaacccgcttgtcacgggacgcccgcctgccgtccgccgcgaaccggctcccgttcctgagatcccaaccgcagccaaacctcctcgcggaaccgccgacattttccgagaagaaggtgtcgatggtttggtgcgctggattcgtgatcagaaaggcctgctgctgaccgacacgaccatgcgcgacgcacatcaatcgctgttggccactcgagttcgcaccgatgacatgctccgcattgcgccggcttacgctcatctggctccgcaattgttctcgcttgagatgtggggaggggcgacgtttgacacatccatgcgattcctcaaggaatcaccgtggcaacgtttggctgacctgcgagaggcagttcccaacatcctgacgcaaatgttgctgcgtgccagcaacgcggttggctacaccaattatcccgacaacgtcgtgcgactgttcgttcgcgaagcggtccaagccggcatggacgtgttccgtgtcttcgacgcgttgaactgggaagagaacatgcgtgtcgcgatggatgccgtgatcgaagaaggcggcatctgcgaagcctcgatctgctacaccggcgatctgcaagacccacggcggaccaagtacgacttgaagtactacgtcgatctggcaaaaaaactgcaagccggtggcgctcacatgatcgcgatcaaggacatggctgggctgctcaaacccgccgcggcggtgaaactgctgcgtgccttgcgtgacgaagtcgacttgccaatccacctgcacacccatgacacggcgggcatccaagcgtccacattgatggccgccgccggggaaggcctgcagatcgcggacgcggcactcgcaccaatgtcaggtggaaccagccaagtgaacttgaacacgctggtcgaagcccttcgtttcaccgatcgtgaatctccactggacagcgagtcgctgactcagttggcgacctactggcaagccgctcgcgagttctacaagccgtttgaaagcgatgttctgccagccacgggtgacttgtacgatcacgagatgcctggtggccaatacaccaacttgtttcaacaggcccgtgctttgggtttggccgaccaatgggccggagtttgccgcgcttacgcggatgtgaaccgattgttcggcgacatcgtgaaggtgactcccaccagcaaagccgtcggcgacatggcgttgttcttggttgccaatgagatgtcagcggaagaggtcctgacaaccaacaaggctctcgcgtttcccgccagcgttttggacttgatcggcggtcgcatgggccaaccaccgggtggcttccccgagaaagtcatgcggaaaatcctcggtgaccaggctcctgtgctggaacgccctggtgcatcgatgccaccggcagacctgggggccgccaaagcgaaagcagcggaactcacccatgaagcccccagcgatcgcgatgcggtgacgtacttgctgtaccccaaggtgtttgaggagtactcgcagcatcgcaacacctacggcgatgtggcagccttgccgacgcccaactttttctatgggcaagaaccaggtgacgaaatcgcggtcgacatcgaacccggcaaacgactgatcgtcaaatacttggcggttgggcaaccgtatcccgatgggacgcggaccgtgttctttgaactcaatggacaacctcgagaagtgtccgtcatcgaccgatcattggaagtcgacatcaaagccgcggtgaaagccgatccgtcggatgccactcacgtcgccgcgtcgatgcccgggatggtgatcacggtggcggccgccgaaggcgaaaaggtgaaggccgggcaaaagctattggtgctggaagcgatgaaaatggaaaccaccatcaacgcacctgccgatggcgtcgtcaccaaaatccatacacctccggggacccaggttgaagcaggggatctgctggcggtggtggagtga

SEQ ID NO: 4803 - protein, 1166 aa, Rhodopirellula baltica
MDALMTVADTDSANIRPIRKLLAANRSEIATRVFRSAHELGIRTVAIYSHEDRYALHRFKADEAYQIGTPGEPIRSYLNIDAIVGLCLKHHIDAVHPGYGFLSENPEFAKALTDAGILFVGPSEQSLRDLGDKTSARRLAEIAGVPVLGGTAQAVSSLKEATDAAEKLGYPIMLKAAKGGGGRGMRVVMEPSELASSLDSAQREAKTAFGSDEVFLERFVQRARHLEVQLLGDRHGNLVHLYERDCSVQRRHQKVVELAPAPNLSTEMRDAICDAALRIGRAVGKESGGYENAGTVEFLLDVDKDEFYFIEVNPRIQVEHTVTEEVTGIDIVRNQILVAQGHPLHSEEVGLPSQDVIRTMGFAMQCRITTEDPAAEFRPDYGRISHYRSAAGLGVRLDAGTAFSGAVVNPFYDSMLVKVTARAPTLAAAARRMDRCLHEFRIRGVKTNIPFLTRLVNHPTFLAGEATTRLIDTTPELFRLPRRRDRATKLLTFLGETIVNGNPLVTGRPPAVRREPAPVPEIPTAAKPPRGTADIFREEGVDGLVRWIRDQKGLLLTDTTMRDAHQSLLATRVRTDDMLRIAPAYAHLAPQLFSLEMWGGATFDTSMRFLKESPWQRLADLREAVPNILTQMLLRASNAVGYTNYPDNVVRLFVREAVQAGMDVFRVFDALNWEENMRVAMDAVIEEGGICEASICYTGDLQDPRRTKYDLKYYVDLAKKLQAGGAHMIAIKDMAGLLKPAAAVKLLRALRDEVDLPIHLHTHDTAGIQASTLMAAAGEGLQIADAALAPMSGGTSQVNLNTLVEALRFTDRESPLDSESLTQLATYWQAAREFYKPFESDVLPATGDLYDHEMPGGQYTNLFQQARALGLADQWAGVCRAYADVNRLFGDIVKVTPTSKAVGDMALFLVANEMSAEEVLTTNKALAFPASVLDLIGGRMGQPPGGFPEKVMRKILGDQAPVLERPGASMPPADLGAAKAKAAELTHEAPSDRDAVTYLLYPKVFEEYSQHRNTYGDVAALPTPNFFYGQEPGDEIAVDIEPGKRLIVKYLAVGQPYPDGTRTVFFELNGQPREVSVIDRSLEVDIKAAVKADPSDATHVAASMPGMVITVAAAEGEKVKAGQKLLVLEAMKMETTINAPADGVVTKIHTPPGTQVEAGDLLAVVE

SEQ ID NO: 4804 - DNA, 1353 bp, Rhodopirellula baltica
  CDS (1)..(1353)
atgttcgaacgtattttgatcgccaaccgaggcgagattgcgctgcgtgtgattcgcgcctgccgtgaaatgggcatcgagtcggtcgccgtctacagcgaagccgacaaagattccatgcacgtcaaactggcggaccatgcctactgcgtcggaaccaatcgcagtgcggacagctatctgaaaatcgatcgcatcatcgccacggcagaagttgccggcgtcgatgccatccaccccggatacggcttcctggcggaaaacgctcaattcaacgagcaatgccgaagcagcgggtttgagttcatcgggccgtcgccaacagcgatggacaaattgggcgacaaaaacaccgctcgttccatggccatcgctcaaaacgtcccggtcgttcccggcagtgacggattgattgcggacttcgatcgagccatcgacacagccaaagaaattggctttcccgttttgatcaaagccaccgccggtggtggcggcaaaggcatgcgggtcgccgagaccgaggatgtcctcaagagccaactcgaagcagctcgcaacgaagccatcgcggccttcggcaacggcggcgtgtacctggaaaaattcatccagcaacctcgtcacatcgaagtgcaagtcattgcggacacgcacggcaatgtctgccacctttttgaacgcgattgcagcgtccaacgacgtcaccaaaaactcgtcgaagaagcccccagcccggacttgcccgccgatcgtcgtgaagcaatctgcgacgccgccgtgcgaatgatcgccggtgccgactactccggtgcgggcacggtcgagttcatcgtcgacaaggactacaacttctacttcatcgaagtcaacgctcggatccaagtcgaacatccagtctccgaaatggtggccggagtcgacttgatccaagaacaaattcgagttgccgcgggattgccactgtcgttccgtcaagacgaattgacatgcaccggtcacgcgatcgaatgtcgactcaacgccgaagatcccaccaagaacttccaaccgtgtcccggcaaaattgaatcgatgtttgtgcccggcggcatgggcgttcgctttgattcacacgtgaagtccggctacgtggttcctccgtactacgattcgatgatcggcaaactgatcgtccatcgtcccacgcgagaacaagccatcgcgacgatgctacgagccttgaaagaactgcagatcgaagggatcaccacaacggtcggattccataactggatcctgcagaacgaagcgtttgtgaacggcaccgtcgacaccaagttcgtcgaccggaactacaaaggccaaacgtcttag

SEQ ID NO: 4805 - protein, 450 aa, Rhodopirellula baltica
MFERILIANRGEIALRVIRACREMGIESVAVYSEADKDSMHVKLADHAYCVGTNRSADSYLKIDRIIATAEVAGVDAIHPGYGFLAENAQFNEQCRSSGFEFIGPSPTAMDKLGDKNTARSMAIAQNVPVVPGSDGLIADFDRAIDTAKEIGFPVLIKATAGGGGKGMRVAETEDVLKSQLEAARNEAIAAFGNGGVYLEKFIQQPRHIEVQVIADTHGNVCHLFERDCSVQRRHQKLVEEAPSPDLPADRREAICDAAVRMIAGADYSGAGTVEFIVDKDYNFYFIEVNARIQVEHPVSEMVAGVDLIQEQIRVAAGLPLSFRQDELTCTGHAIECRLNAEDPTKNFQPCPGKIESMFVPGGMGVRFDSHVKSGYVVPPYYDSMIGKLIVHRPTREQAIATMLRALKELQIEGITTTVGFHNWILQNEAFVNGTVDTKFVDRNYKGQTS

SEQ ID NO: 4806 - DNA, 1350 bp, Prochlorococcus marinus subsp
  CDS (1)..(1350)
atggttgaaaaagttttaattgctaatcgtggagaaatagctttacgaattatcagaagttgtagagagcttgatattgcaactgttgctgtttatagcaccgtagataaaaaggcattgcatgtgcaattagcagatgaagcagtttgcgttggagactcactaagtaacaagagttatttaaatattcctaatatcttagctgctgctacatcaagaggagttgatgctattcatccaggttatggttttcttgcggagaacgataaatttgcagaaatgtgtaacgatcatggtataactttcattggtccatctcccaatgctattagatcaatgggagacaaatctactgctaaagagacaatggagagagtcggagtaccaactgttcctggaagcaaaggtttattatcgagtgtcgaggaggcctacgaaatggcccaagagattggatatcccgtcataataaaagccacagctggaggaggaggtagaggaatgagattggttgaaaataaggctaatttagaaaaaatgtttaaagcagcccaaggagaagcagaagcggcatttggaaatgatggtttatatatggagaaatttataaaaaagccaagacatgtagaaattcaaatccttgctgacaggtcaggtaatgtggttcatttaggagagagagattgttctgtacaaaggaggcaccaaaaattattagaggagtctcccagtccagctataaactattctcttagaaaaaaaatgggtaatgcagccattgctgctgcaaaaagtattagttatgaaggggcgggaactgttgaatttttagtagatgatgataataatttttactttatggagatgaataccaggattcaagtggaacaccccgtaactgaaatggttactggtgttgatctaattgctgaacaaatcaaaatagctggaggtgacaatttaggatttactcaagatgatattcaattaaatggacatgctattgaatgcagaattaatgcggaagatccttcacataattttcgcccatctcccggtaaaataactggatggctgcctccagggggccctggagtgagggttgatagtcatgtttatactggttatgaaataccgccattttatgattcacttataggtaaattaatagtctggggtaaagatcgtaatactgctattaaaagaatgaatagagctttaaatgaatgcgctgtaacaggaattccaacaacaattaactttcatttatctcttctcaataaaaggaaatttatggaaggcaaaattcatactaaatacgttgaggaagaattattacctaactattaa

SEQ ID NO: 4807 - protein, 449 aa, Prochlorococcus marinus subsp
MVEKVLIANRGEIALRIIRSCRELDIATVAVYSTVDKKALHVQLADEAVCVGDSLSNKSYLNIPNILAAATSRGVDAIHPGYGFLAENDKFAEMCNDHGITFIGPSPNAIRSMGDKSTAKETMERVGVPTVPGSKGLLSSVEEAYEMAQEIGYPVIIKATAGGGGRGMRLVENKANLEKMFKAAQGEAEAAFGNDGLYMEKFIKKPRHVEIQILADRSGNVVHLGERDCSVQRRHQKLLEESPSPAINYSLRKKMGNAAIAAAKSISYEGAGTVEFLVDDDNNFYFMEMNTRIQVEHPVTEMVTGVDLIAEQIKIAGGDNLGFTQDDIQLNGHAIECRINAEDPSHNFRPSPGKITGWLPPGGPGVRVDSHVYTGYEIPPFYDSLIGKLIVWGKDRNTAIKRMNRALNECAVTGIPTTINFHLSLLNKRKFMEGKIHTKYVEEELLPNY

SEQ ID NO: 4808 - DNA, 1347 bp, Prochlorococcus marinus
  CDS (1)..(1347)
atgaccatcggcaaagtgctgatcgccaaccgcggcgaaattgccctcagaattctgcgtagctgcagagagctgaatatccccacagtggctgtttacagcaccgtggatcgcaatgcgctgcatgttcaacttgctgatgaagccgtctgcgttggcgaggcccctagcagcaagagctatctcaatgtccccaatatcctcgcggctgcaacctcccgcggggtcgatgcaattcatcctggctatggatttctagccgaaaacgatcgattcgccgaaatctgtcgtgaccatggcatcacctttgtcggtccttcaccccatgcaatccgctccatgggagacaagtcgaccgctaaggcgaccatgcaacaagtcggtgttccgactgtgccaggtagcgagggcttgctcgccagtccagaagcagcagctgagctggcgaagggaatgggctacccagtgatgatcaaagccaccgcaggtgggggtggccgcggcatgcgcctggtcaccacgccagaccaactggaaaacctcttcaaggccgcccaaggagaggccgaagcggccttcggcaatcctgggctctacatggagaaattcattgaccggccccgacacgtcgaagtgcagatcctctcggatcgacacggcaacgtcatccacctcggcgagcgtgactgctccattcagcgacgtcatcaaaaactgttggaagaatcccccagcccagccctcacccccgaattacgcctgcgaatgggtgaggctgcggtggccgccgcaaggagcatcaactacgaaggcgctggaaccgtggaattcctccttgatcgcaagggtgacttttacttcatggaaatgaacacccgtattcaggttgagcatcccgtcacagaaatggtgacaggcatcgatttgatcgcagaacaactgcacatcgccggaggcgatcccatcagcatcaaacaagaggacatccaactaagaggccatgccatcgagtgtcgaatcaatgctgaagactccacccacaacttccgcccctcaccagggcaaatcacaggctggttaccaccaggaggaccaggggtacgcatcgacagccacgtctataccggctacgacataccgcctttctatgattcattgattggcaaggtgatcgcctgggggcataaccgagacgcggcacttaaacgcatgaaaagagcactcaatgaatgtgctgtcacaggcatccccaccacagttgaattccatctcgaactgctcaatcgggaagaatttctgagaggagatgttcacaccaaatttgtcgaacaggacatgctcgactga

SEQ ID NO: 4809 - protein, 448 aa, Prochlorococcus marinus
MTIGKVLIANRGEIALRILRSCRELNIPTVAVYSTVDRNALHVQLADEAVCVGEAPSSKSYLNVPNILAAATSRGVDAIHPGYGFLAENDRFAEICRDHGITFVGPSPHAIRSMGDKSTAKATMQQVGVPTVPGSEGLLASPEAAAELAKGMGYPVMIKATAGGGGRGMRLVTTPDQLENLFKAAQGEAEAAFGNPGLYMEKFIDRPRHVEVQILSDRHGNVIHLGERDCSIQRRHQKLLEESPSPALTPELRLRMGEAAVAAARSINYEGAGTVEFLLDRKGDFYFMEMNTRIQVEHPVTEMVTGIDLIAEQLHIAGGDPISIKQEDIQLRGHAIECRINAEDSTHNFRPSPGQITGWLPPGGPGVRIDSHVYTGYDIPPFYDSLIGKVIAWGHNRDAALKRMKRALNECAVTGIPTTVEFHLELLNREEFLRGDVHTKFVEQDMLD

SEQ ID NO: 4810 - DNA, 1350 bp, Prochlorococcus marinus
  CDS (1)..(1350)
atgtctttaggcaaagttttaatagcgaaccgaggcgaaatcgctttaagaattctccgtagttgtagggagttaggtattgcaacggttgctgtgtatagcactactgatagagaggctttacatgtccaacttgccgatgaagcagtttgtgttggagattcgcctagtagcaaaagttacctaaatgttccaaatattattgctgctgcaacatctagaggagtcgatgctattcatcctggttatggttttctggctgaaaatgatcgctttgctgagatttgcaaagaccatggcattgtctttataggtccctcgccagattccattagatctatgggcgataaatctactgccaaatcaacaatgatgggagtaggagtgcctactgtgcctgggagcaaaggattattggctaattgggaagaggcttcattgcttgcgaaagatatgggctatccagtaatgattaaagctactgctgggggaggaggaagagggatgcgattagttaatgatcaagaatctattgaagagctttttaaggcagctcagggtgaatcagaagctgcatttgggaatgctggtctatatatggagaaatttatagataaacctagacatgtagaagttcaaattttggcagatagtcttggaaatgttgttcatttaggagaaagagattgttctattcaaagaaggcatcagaaattattagaagaatcccctagtcctgctttagatgagcaattaagaatgcgaatgggggaagcagcagtttcagcagcgaaaagtatcaattatgagggtgctggcactgttgaatttcttttggatagatcaggtaatttttattttatggaaatgaatacgcgaattcaggttgagcatccagtcactgagatggttacaggtattgatttagtggccgaacaattgcggatagcaggaggtgagccaatttctcttacgcaagatcaaatagagctgcgaggtcactctattgaatgcagaattaatgctgaggatgcatctcacaacttccgtccttctccagggagaattacagggtggctgcctccagggggccccggtgtaagagttgatagtcatgtttataccggttatgacataccgcctttctatgattctttaataggtaaattgattgtttggggtaatgatagagagtcagcattgaaacgtatgaaaagagctttaaatgaatgtgctgttacaggtattccaacaacaattgactttcatttgaaattgcttgaacgtgatgaatttcttaaaggcgacgtgcatacaaaatttgttgagcaggaaatgctcaacaaataa

SEQ ID NO: 4811 - protein, 449 aa, Prochlorococcus marinus
MSLGKVLIANRGEIALRILRSCRELGIATVAVYSTTDREALHVQLADEAVCVGDSPSSKSYLNVPNIIAAATSRGVDAIHPGYGFLAENDRFAEICKDHGIVFIGPSPDSIRSMGDKSTAKSTMMGVGVPTVPGSKGLLANWEEASLLAKDMGYPVMIKATAGGGGRGMRLVNDQESIEELFKAAQGESEAAFGNAGLYMEKFIDKPRHVEVQILADSLGNVVHLGERDCSIQRRHQKLLEESPSPALDEQLRMRMGEAAVSAAKSINYEGAGTVEFLLDRSGNFYFMEMNTRIQVEHPVTEMVTGIDLVAEQLRIAGGEPISLTQDQIELRGHSIECRINAEDASHNFRPSPGRITGWLPPGGPGVRVDSHVYTGYDIPPFYDSLIGKLIVWGNDRESALKRMKRALNECAVTGIPTTIDFHLKLLERDEFLKGDVHTKFVEQEMLNK

SEQ ID NO: 4812 - DNA, 1425 bp, Helicobacter hepaticus
  CDS (1)..(1425)
atgtttcagaagattctcattgctaatcgtggcgaaattgcagtgcgtattatccgcgcttgtagggatttacatattaaaagtatagccatatatgcaagagctgatagagattgtttgcacgtaaaaatggctgatgaatcttatgaaatcagtgatgacccattgcaaggctatcttgatgcggatttgattattgaggtagcattacgcgctgaagctgatgcaattcaccccggctatggttttttaagtgagaatgccacatttgctaaaaaagtgcaagaagcgggaattacttggataggacctgatgctctaacaattgcaaaaatgggcgataaaaatgcagcaagagctattatggaaaaaaatggaatccccattgtgccaggcactcaaccacttaataagcactctataagtgatattgctaaatatgcgcaaaaaattggctatcctgtgatacttaaagcaagtagtggtggaggtgggcgtggcatacgcgtagtagaaaaagaagaggatttaatagaatcttttgaggcgtgtaaacgcgaagctatggcatttttcaaaaatgatgatgtttttatggaaaaatatatcgttaatcctagacatatagagtttcaaatcttagcggataattatggtaatgtgattcatctgcttgagcgtgattgttccatacaaagacgacatcaaaagcttgttgaaatcgctcctagtccccttattagcgatgatttacgccgaagaatgggagctgctgccgtggctgccgctaaagctgcacaatacacaaatgcaggcacggttgaatttttgcttgatgagaacaatactttttattttatggaaatgaatacacgcatacaggttgagcacggcgttacagaggaaattactggttatgaccttatagggagacaaatccgcattgcgcaaggagaaattttagaccttacacaacacgatatacgcgcacaaggctttgctattgaagtgagaattaatgctgaagatgtggctaatgattttgtgccaaatccgggcaaaattaccacttattaccctgctttaggaccttttgtgcgagtagatagttgtatttataaagattatgtgattccacccttttatgattctatggtagcaaagctcattgtgaaagcttcaagctataatcttgcggtaaataaactctcgcgagctttgaatgaatttaccattaaaggcgtgaaaacaacaattccttttttgataaacatttgcaatgataaagactttaggcgaggatattttgatacttcttatattgaaagtaaaattaaagagcttatgccccccccacaatctaagcctgaagatgatatggtaagcgtcattgtcgcggccttaagcgcacgctatggagcataa

SEQ ID NO: 4813 - protein, 474 aa, Helicobacter hepaticus
MFQKILIANRGEIAVRIIRACRDLHIKSIAIYARADRDCLHVKMADESYEISDDPLQGYLDADLIIEVALRAEADAIHPGYGFLSENATFAKKVQEAGITWIGPDALTIAKMGDKNAARAIMEKNGIPIVPGTQPLNKHSISDIAKYAQKIGYPVILKASSGGGGRGIRVVEKEEDLIESFEACKREAMAFFKNDDVFMEKYIVNPRHIEFQILADNYGNVIHLLERDCSIQRRHQKLVEIAPSPLISDDLRRRMGAAAVAAAKAAQYTNAGTVEFLLDENNTFYFMEMNTRIQVEHGVTEEITGYDLIGRQIRIAQGEILDLTQHDIRAQGFAIEVRINAEDVANDFVPNPGKITTYYPALGPFVRVDSCIYKDYVIPPFYDSMVAKLIVKASSYNLAVNKLSRALNEFTIKGVKTTIPFLINICNDKDFRRGYFDTSYIESKIKELMPPPQSKPEDDMVSVIVAALSARYGA

SEQ ID NO: 4814 - DNA, 1353 bp, Candidatus Blochmannia floridanus
  CDS (1)..(1353)
atgttaagtaaaattgttattgcaaatagaggagaaatagcattacgaattttacgtgcttgtaaagaattgggaattaaaacagtagctatacactctactatagatcgcgatctaaaacatgttcttttatctgatgaaactatttgcataggattaccgccaatcataaatagttatctgaatattccatctatcatttcttctgcagaaattactggagcttcaggaattcatcctggatatggatttttatctgaaaatgctgattttgcagaacaagttgaacgttctggttttatatttatcggtccaagtcctgaaactattcgtctcatgggtaataaaatttctgctatttccgtaatgaaaaaatcaggagtaaaacctattcctggatggaattatgaaaataataaaaaaataaataacattgatttttgcaataatcacaacataaatattaactatccagttattattaaatcagcttatggaggaggtggtcatggaatgcgtattgtaacaaacaaatcagatctaaaaaatgctatacaaacaactcaaatagaatcaaaaaaaatatttaataatgataccatttatatagaacaatatttaacacaatcaagacatatagaaatacaaattttatctgatggaaaaggcaatgccatttatttaacagaacgagattgttctatacaaagaagacatcaaaaaataatcgaagaaacacctgcatggggaattacaccagaaatgcgaacttttataggagaatgttgtgttaaagtttgtcaagaaataaattacagaggagtaggtacatttgaatttttgtatgaaaatggaaattttttctttattgaaatgaatacacgtatccaagtagaacatccaatcactgaaatgattactggaatcgatttggtacgaaaacaattaaaaattgcttcaggatatccattaaacattaaacaacatgaaatttccacactaggacattctatagaatgtcgtatcaatgcagaagatccgtacacttttatacccaatgcaggtcgtattactcgttttcattctcccggtggatttggagtacgctgggaatctcatatttattctggttatacggtacctgcatattatgactcaatgatagggaaattaatttctttcggaaaaacacgtaaaattgctatagcacgtatgaaaaatgcattatcagaattaattattcaaggaattaaaactaacatcgaattacatctaaaaattatgaatgatatagaatttatacaaggaaataatatcaatactcattatttaaaaaacagatttaacatataa

SEQ ID NO: 4815 - protein, 450 aa, Candidatus Blochmannia floridanus
MLSKIVIANRGEIALRILRACKELGIKTVAIHSTIDRDLKHVLLSDETICIGLPPIINSYLNIPSIISSAEITGASGIHPGYGFLSENADFAEQVERSGFIFIGPSPETIRLMGNKISAISVMKKSGVKPIPGWNYENNKKINNIDFCNNHNININYPVIIKSAYGGGGHGMRIVTNKSDLKNAIQTTQIESKKIFNNDTIYIEQYLTQSRHIEIQILSDGKGNAIYLTERDCSIQRRHQKIIEETPAWGITPEMRTFIGECCVKVCQEINYRGVGTFEFLYENGNFFFIEMNTRIQVEHPITEMITGIDLVRKQLKIASGYPLNIKQHEISTLGHSIECRINAEDPYTFIPNAGRITRFHSPGGFGVRWESHIYSGYTVPAYYDSMIGKLISFGKTRKIAIARMKNALSELIIQGIKTNIELHLKIMNDIEFIQGNNINTHYLKNRFNI

SEQ ID NO: 4816 - DNA, 2022 bp, Bordetella parapertussis
  CDS (1)..(2022)
atgttctccaccctgctgattgccaaccgcggcgaaatcgcctgccgcgtcgccgccaccgcccgccgcatgggccttcgcaccgtcgccgtctattcggatgccgacgccaacgcgcgccatgtggccgcctgcgatgtcgccgtgcatatcggcggcgccgagccgcgcgccagctacctgcgcgccgatgccatcctgcaggccgcgcgcgacaccggcgcgcaagccatccaccccggctacggcttcctgtccgaaaacgaaggctttgccgaagccgtggcgcaggccggcatggtgttcgtcggcccgccggccggcgcgatcgccgccatgggcagcaaatcggccgccaaggcgctgatggagcgcgccggcgtgccgctggtgcccggctaccatggcgaggaccaggatccgcagttcctccggcagcaggccgacgccatcggctacccggtactgatcaaggccagcgccggcggcggcggcaagggcatgcgcgtggtcgaggagagcgccgccttcgccgacgcgctggcctcgtgccagcgtgaagccagcgccagcttcggcgatgaccgcgtgctcatcgagcgctacctgcagaagcctcgccacatcgaaatccaggtgttcgccgacagccacggcaattgcgtctacctgttcgaacgcgactgttccgtgcagcggcgccaccagaaagtcatcgaggaagcgcccgcgccgggcatgacgccggaacgccgccgcgccatgggcgaggcggcggtggcggcggcgcgcgcggtgggctacgtaggcgcgggcaccgtcgagttcatcgccgaacccgacggccgcttctacttcatggaaatgaatacacggctgcaggtggagcacccggtcaccgaaatgatcaccggccatgacctggtcgaatggcaattgcgcgtggccgccggccagccgctgccggccgcccaggacgaactgcgcctggacggccacgccatcgaggcgcgcatctacgccgagaacccggaaaagggcttcctgccgtcgatcggcacgctggcctacctgggcctgcccgcgcacacggccttcgccaacggcgaggtgcgcgtcgacggcggcgtgcgcatgggcgacacgatcacgccctattacgaccccatgatcgccaagctgatcgtccatggcgccgaccgcgagcaggcgcgcgcgcgcatgatccaggcgctggcgcacacccaggccgtcggcgtgcagacaaacgccgccttcctgggccgcctgatgcgcgacgaggccttcgccacggccgacctcgataccggcctgatcgaacgccgccgcgccacgctgctgcccgaaccgcaaccggccggcgccgacgtgctggccctggccagcgccgccgtgctggtgcgccagggcctggcccagccgcaaggcgaggtcggcaaggcggccgacccctgggacgcgcgcgacggctggcggctgggcggccgctaccggcagaccctgtgctgggtcgacaacggcgaacggcgcgacatcgagatcacgcgcgagggcgggcaatggcgcatcggcgccgcgcccgcggccggccaggccttctcctggcgtgcccagcccagcgccaacccccagctcagctacggcctgcgcatcacgctggatggccgggaaagcgccggcaccgtggtcctgcatgccggcaaggcctatgtgttccacgacggcgccacccatatcctggacctgtacgatgccctggcgcatgcccaggacgatgccgagggccatggcggcggcctgaccgcacccatgcccggcaagatcatctcgatcgcggtcgccgtgggcgataaggtcgagaagggccaggcgctgctggtgatggaggccatgaaaatggagcacaccatcacggcgccggccgccggcgaagtcgccggcctgttctatgccgtgggcgaccaggtcggcgaaggcgccgcgctgatcgaagtgaagtga

SEQ ID NO: 4817 - protein, 673 aa, Bordetella parapertussis
MFSTLLIANRGEIACRVAATARRMGLRTVAVYSDADANARHVAACDVAVHIGGAEPRASYLRADAILQAARDTGAQAIHPGYGFLSENEGFAEAVAQAGMVFVGPPAGAIAAMGSKSAAKALMERAGVPLVPGYHGEDQDPQFLRQQADAIGYPVLIKASAGGGGKGMRVVEESAAFADALASCQREASASFGDDRVLIERYLQKPRHIEIQVFADSHGNCVYLFERDCSVQRRHQKVIEEAPAPGMTPERRRAMGEAAVAAARAVGYVGAGTVEFIAEPDGRFYFMEMNTRLQVEHPVTEMITGHDLVEWQLRVAAGQPLPAAQDELRLDGHAIEARIYAENPEKGFLPSIGTLAYLGLPAHTAFANGEVRVDGGVRMGDTITPYYDPMIAKLIVHGADREQARARMIQALAHTQAVGVQTNAAFLGRLMRDEAFATADLDTGLIERRRATLLPEPQPAGADVLALASAAVLVRQGLAQPQGEVGKAADPWDARDGWRLGGRYRQTLCWVDNGERRDIEITREGGQWRIGAAPAAGQAFSWRAQPSANPQLSYGLRITLDGRESAGTVVLHAGKAYVFHDGATHILDLYDALAHAQDDAEGHGGGLTAPMPGKIISIAVAVGDKVEKGQALLVMEAMKMEHTITAPAAGEVAGLFYAVGDQVGEGAALIEVK

SEQ ID NO: 4818 - DNA, 1371 bp, Bordetella parapertussis
  CDS (1)..(1371)
atgagactgaaaaaggtattgattgcgaacaggggagagatcgccctgcgtatcgtccgcgcgtgccgggagatggacatacggaccgtccaggtctactccagcgcggatgaggattcattgcctgtcaggttggccgatgaagcggtccccatcggcggccccgagccgtcggcaagctacctgaacatcgcggcgctgatcgccgccgcgcgcgagcatggctgcgacgccatccatcccggctacggcttcctgtccgagaacgaagacttcgcccaggcctgcatcgacgccggcatcgtcttcatcggcccggaccccggcgcgatccgcatgatgggcgacaaggcgcaggcccgcaagatcgccaaggaggcgggcgtgcccattgtgccgggcgcgcccgagccggtcagcgacgtcgaggaggccatcaaggtggcccgcgaggtcggctatcccttgctggtcaaggcggcggcgggcggcgacgggcgcggcatgcgcgtgatccagggcgaggcgcagctgcgcgaggggctggagcgcgcgtcgatggaggccaagtcggccttcggcgacggctccgtctatatcgaacgctatatctcgcccgtgcgtcacgtcgagatccaggtgttcggcgatggcgaggacgtcatccacctgggcgagcgggaatgctcgatccagcgccgccaccagaagctgctggaggaaagcccgtcgccggtgctgtccgaagaaacgcggcagcgcatgggcgaggcggcctgcgcgctggcgcgcgcggtcaagtatcgcggcgcgggcacgctggaattcgtcatggacggcaagagcggcgaattcttcttcatcgaaatgaatacgcgcatccaggtcgagcatccggtcacggaagccgtcaccggcgtggacctggtcaggctccagctggcggtggccgctggcggcaggctgggcctgcgccagcaggacatcgtcatgaaggggcacgcgatcgaatgccgcatcaacgcggaggacccgcagaaggcgttcatgcccagcccgggcacggtcaacgatatccggctgccttcggggccgggcgtgcgcatggattcgcacgtgtaccgcggctacaagctgccgccgtactacgactcgctgctgggcaagctgatcgtctgggacgagtcgcgcgagaaagccatcgcccgcatgctgcgcgcgctgggcgagctggagatcgtcggcgtgaagacgaccaaggaattccacgaacggctcatgcgagacgaggatttcatcgccgccaatgtcagcacccagttcgtcaaggaaaagctgtacgccgaccaccccatgcgccatttgctctga

SEQ ID NO: 4819 - protein, 456 aa, Bordetella parapertussis
MRLKKVLIANRGEIALRIVRACREMDIRTVQVYSSADEDSLPVRLADEAVPIGGPEPSASYLNIAALIAAAREHGCDAIHPGYGFLSENEDFAQACIDAGIVFIGPDPGAIRMMGDKAQARKIAKEAGVPIVPGAPEPVSDVEEAIKVAREVGYPLLVKAAAGGDGRGMRVIQGEAQLREGLERASMEAKSAFGDGSVYIERYISPVRHVEIQVFGDGEDVIHLGERECSIQRRHQKLLEESPSPVLSEETRQRMGEAACALARAVKYRGAGTLEFVMDGKSGEFFFIEMNTRIQVEHPVTEAVTGVDLVRLQLAVAAGGRLGLRQQDIVMKGHAIECRINAEDPQKAFMPSPGTVNDIRLPSGPGVRMDSHVYRGYKLPPYYDSLLGKLIVWDESREKAIARMLRALGELEIVGVKTTKEFHERLMRDEDFIAANVSTQFVKEKLYADHPMRHLL

SEQ ID NO: 4820 - DNA, 1365 bp, Bordetella bronchiseptica
  CDS (1)..(1365)
atgttccgtaaagtcctgatcagcaaccgcggcgagatcgcccagcgcatccagcgcgcctgccatcagctcggcatccagaccgtggtggtgtactccgaggccgaccgcgatgccgcctatgtgcgccacgccgacgacgcgctgtgcatcgggccggcgccgtcggcgcgcagctacctgcaggcgccggccatcatcggcgccgcgcgcctgaccggcgccgacgccatccatcccggctacggcttcctgagcgagaacgccggcttcgccgaggcggtgcaggccgccgggctggccttcatcggcccgacgccggccgccatccgcaccatgggcgacaaggtccaggccaagcgggccatgcagcagtccggcgtgccctgcgtgccgggctcgcaaggcgtgctgcccgacgaccccggcgccatcgccgaacaggcgcgcgccatcggctttccgttgatcgtgaaggcggccggcggcggcggcggacgcggcatgcgggtggtcgagcacgaagccgcgctgcacggcgcggtgcagaccacgcgcgccgaggcgctggccgccttcggcaatcccgatctctacatggagcgctttctgcagcgtccgcgccacatcgagatccaggtgctggccgaccatcacggcaacgccgtctggctgggcgagcgcgattgctcgatgcagcgccgccaccagaagatcctcgaagaatcgcccgcgccggggctggaccccgccgccgtcgaggcgatcggacagcgctgcgcccacgcctgccgcgcaatcggctatcgtggtgcgggcactttcgaattcctctacgaggacggccagttctatttcatcgagatgaatacgcggctgcaagtggaacaccccatcaccgagctgaccaccggcatcgacatcgtgcaggcgcagatccgcatcgccgccggcgagccgctgccctggacccaggagcaggtgcgccgccgcggccacgccatcgaatgccgcatcaatgccgagaaccccgccaccttcatgccgtcgccgggccgcatcgcccaatggctgccgcccggcggaccgggcgtgcgcgtcgactcgcacgcctacgccggctacgtggtgcccgcgcactacgactcgatgataggcaagttcatcgccttcggcgacgatcgcgaacaggccctggcgcgcatgcgcgtggcgctgcgcgaggcggtcgtcgaaggcatagacaccaatattcccctgcaccgggacttgctggccgacccggtgttctgcgagggcggcgccggcatccactaccttgaagactggatcgccggccggcaacggcaatgcgacacggtctga

SEQ ID NO: 4821 - protein, 454 aa, Bordetella bronchiseptica
MFRKVLISNRGEIAQRIQRACHQLGIQTVVVYSEADRDAAYVRHADDALCIGPAPSARSYLQAPAIIGAARLTGADAIHPGYGFLSENAGFAEAVQAAGLAFIGPTPAAIRTMGDKVQAKRAMQQSGVPCVPGSQGVLPDDPGAIAEQARAIGFPLIVKAAGGGGGRGMRVVEHEAALHGAVQTTRAEALAAFGNPDLYMERFLQRPRHIEIQVLADHHGNAVWLGERDCSMQRRHQKILEESPAPGLDPAAVEAIGQRCAHACRAIGYRGAGTFEFLYEDGQFYFIEMNTRLQVEHPITELTTGIDIVQAQIRIAAGEPLPWTQEQVRRRGHAIECRINAENPATFMPSPGRIAQWLPPGGPGVRVDSHAYAGYVVPAHYDSMIGKFIAFGDDREQALARMRVALREAVVEGIDTNIPLHRDLLADPVFCEGGAGIHYLEDWIAGRQRQCDTV

SEQ ID NO: 4822 - DNA, 1347 bp, Bordetella bronchiseptica
  CDS (1)..(1347)
atgtttgaaaagatcctgatcgccaatcgcggcgagatcgccctgcgcatccagcgcgcctgccgcgagctgggcatcaaaaccgtcgtcgtgcactccgaggccgaccgcaccgccaagtatgtgcgcctggccgacgagtcggtctgcatcggcccggcgccgtcgcgcgagagctacctcaacatgccggccctgatctcggcggccgaggtgaccgacgccgaggcgatccacccgggctacggctttctggccgagaacgccgattttgccgagcgcgtcgaaaagagcggcttcgtcttcatcggcccgcgtccggaaaccatccgccagatgggcgacaaggtcagcgccaagcgcgccatgatcgaagccggcgtgccggtcgtgccggggtcggagggcgccttgccggacgatccgcaggagatcctgcgcatcgcgcgcgaagtgggctatccggtcatcatcaaggcttccggcggcggcggcgggcgcggcatgcgcgtggtgtacaccgaagctgcgctgctgaacgcggtcaacatgacgcgctcggaagccggcgcggcgttcaacaatcccgaagtctatctggagaagttcctggagaatccgcgccacgtggagatccaggtgctggccgacggcggccgcaacgccgtgtggctgggcgagcgcgactgctcgatgcagcgccgccaccagaaagtcatcgaagaggcgccggcgcccggcattccgcgccggctgatcgaacgcatcggcgatcgctgcgccgacgcgtgccgcaagatgggctaccgcggcgcgggcacgttcgagttcctgtacgagaacggcgagttctatttcatcgaaatgaacacccgtatccaggtcgagcacccggtcaccgaactgatcaccggcgtggacgtggtccagcagcagatcctgatcgccgccggcgagaagttcacgctgcgccagcgcgacatccagttcaagggccatgccctggaatgccggatcaacgccgaggatccgttccgtttcgtgcccagcccgggccgcatcaccaactggcatgtgccgggcggccccggcgtgcgcatcgattcgcacgccttcaacggctacttcgttccgcccaactacgattcgatgatcgccaaggtcatcacctatggcgacacgcgcgaacaggcgctggcgcgcatgcgcatcgccctgtccgagatggtggtcgagggcatttccaccaacatcccgctgcatcgcgaactgctgcaggatgcgcgcttcatcgagggcggcaccagcatccattatctggagcacaaactggcgcagcggccctga

SEQ ID NO: 4823 - protein, 448 aa, Bordetella bronchiseptica
MFEKILIANRGEIALRIQRACRELGIKTVVVHSEADRTAKYVRLADESVCIGPAPSRESYLNMPALISAAEVTDAEAIHPGYGFLAENADFAERVEKSGFVFIGPRPETIRQMGDKVSAKRAMIEAGVPVVPGSEGALPDDPQEILRIAREVGYPVIIKASGGGGGRGMRVVYTEAALLNAVNMTRSEAGAAFNNPEVYLEKFLENPRHVEIQVLADGGRNAVWLGERDCSMQRRHQKVIEEAPAPGIPRRLIERIGDRCADACRKMGYRGAGTFEFLYENGEFYFIEMNTRIQVEHPVTELITGVDVVQQQILIAAGEKFTLRQRDIQFKGHALECRINAEDPFRFVPSPGRITNWHVPGGPGVRIDSHAFNGYFVPPNYDSMIAKVITYGDTREQALARMRIALSEMVVEGISTNIPLHRELLQDARFIEGGTSIHYLEHKLAQRP

SEQ ID NO: 4824 - DNA, 1365 bp, Bordetella bronchiseptica
  CDS (1)..(1365)
atgaacaagatcctgatcgccaatcgcggcgcggtcgccgcgcgggtggcgcgcgccgtgcacgagatgggcctgcgctcggtcgtggtctactccgaggccgaccgcgacctgccctatgtgcagatggccgacgaagcctattgcatcgggcccgcgccggccgcgcagagctacctcgaccaggccgccctgctcgacgtgctggcgcgcaccggcgccgacgcggtgcatccgggctatggcttcctgtccgagaacgccgggttcgcccgcgccgtggacgcggccggcgccgtcttcatcggtccggcggcgcgctggatcgaagccatgggccacaagacccgcgcccgcgaactgatggcgcgccacggcatgcccatgtgcaagtcgtcggcggtgctgggcgaggacgaggccggcgtgctggcggcggcgcgcgaagtcggctatccggtgatggtcaagccggccggcggcggcggcggcatcggcatgatcgccgccgcgggcgaagccgagctgctggccgcggtggcgcgcgcgcgctcgctggccgcgcgcagcttcggcaacggcgatatctacctggagcagctgttcgagcagccgcgccacatcgaattccagatcctggccgaccgccacggcaacgcgcgccacctgtacgagcgcgactgctcggtgcagcgccgccaccagaaggtcatcgaagaggcgcgcgcgccgcgcgtgcccacggccgagacgcaggcgctgggcgagcgcatcgccgcgctgctggccgagctgggctacgacgtgatcggcacggtggaaatgctgcgcgaccagcagggccgctacagcttcctcgaaatgaacacccggctgcaggtcgagcacgccgtcaccgaggccattaccggcctggacctggtgcaggcgcagatccgcctggccgccggcgagcggctggaccgcgtggtgccggcagacctgcagccctcgggccacgccatcgagctgcgcgtgtacgccgaagacccggtgcgcttcatcccgtcgccgggcacgctggccgtgttcgagctgccgcaagggcccggggtgcgcaccgagactggctaccgcgccggcaacgcggtaagcccgcactacgaccccatgatcgccaagatcatcgtgcacggcgccgatcgcgcccaggccatcgcgcgcgccgagcaggccctggccgacaccgagatcgccggcgtcaagaccaacctgcccttcctggcgcgcgcgctggccttcgaaccctggcgccagggccgcctgcacaccggcatcgtggcccggaccctggccgagcccgcgccggccgcgctcactgcttga

SEQ ID NO: 4825 - protein, 454 aa, Bordetella bronchiseptica
MNKILIANRGAVAARVARAVHEMGLRSVVVYSEADRDLPYVQMADEAYCIGPAPAAQSYLDQAALLDVLARTGADAVHPGYGFLSENAGFARAVDAAGAVFIGPAARWIEAMGHKTRARELMARHGMPMCKSSAVLGEDEAGVLAAAREVGYPVMVKPAGGGGGIGMIAAAGEAELLAAVARARSLAARSFGNGDIYLEQLFEQPRHIEFQILADRHGNARHLYERDCSVQRRHQKVIEEARAPRVPTAETQALGERIAALLAELGYDVIGTVEMLRDQQGRYSFLEMNTRLQVEHAVTEAITGLDLVQAQIRLAAGERLDRVVPADLQPSGHAIELRVYAEDPVRFIPSPGTLAVFELPQGPGVRTETGYRAGNAVSPHYDPMIAKIIVHGADRAQAIARAEQALADTEIAGVKTNLPFLARALAFEPWRQGRLHTGIVARTLAEPAPAALTA

SEQ ID NO: 4826 - DNA, 3504 bp, Bordetella bronchiseptica
  CDS (1)..(3504)
atgactaccgctatcaagagcatcctcgtcgcgaatcgcggcgaaatcgcgatccgggcgatgcgcgccgctgccgaacttggcatccgcaccgtcgccatctatgcgaacgaagaccgcttttccctgcaccgcttcaaggccgacgaaagctacccgatcggccaggggcggcggcccatcgaggcctacctggacattcccggcattctcgacatcgcccgccgggccggcgtcgacgcgatccaccccggctacggtttcctgtcggagaaccccgacttcgcccaggcctgcgccgacgccggcatcgccttcatcggccccagccccgcggtactgcgcagcctgggcaataaagtcgccgcgcgcaacctggccatcagcctgggcgtgcccgtggtccccgccaccgacgccctgccccacgacgacgccgcatgcctgcgcctggcgcgggaagtcggctatccgctgatgctcaaggccagctggggcggcggcggccgcgggatgcgcgccatccacgacgaggccgaactgctgcccgccatcgcctcggcgcggcgcgaagccggcgcggccttcggcaacgacgaggtgtacctggagaagctggtccagcgcgcccaccatgtcgaggtgcaggtgctgggcgaccagcacggcaacctggtgcatgtgttcgagcgcgattgctcggtgcagcggcgcaaccagaaagtcatcgaacgcgcgcccgccccctatctcggcgacgccgggcgccaggccttgttccaggccgcgctcaccctgacccggggggtcggatacacccatgccggcacggtcgagttcctgatggacgccgacaccgggaacttctatttcatcgaggtgaacccgcgcatccaggtcgaacacacggtcaccgaggaagtgaccggcctggacatcgtcaaggcccagatccgcgtgaccgagggcgtgcgcataggcgaagacgactatctgcccgcgcaggagcacatccgcctgtcgggccatgcgctgcaatgccgcatcacgaccgaggatccgcgcaaggacttcgcgcccgactacgggcgcatcaccgcctaccgcagcgccgcgggcccggggatacggctggacgccggcacggcctataccggcgcggtgatcacgccctactacgattcgctgctggtgaaagtgaccgcgcgcggccatacgcccgaggaaaccagccagcgcatggaccgtgcattgcgggaattccgcatccggggggtcgccaccaacctggcgttcctggagaacgtgatcgcgcacccccagttctcgcagggcaaatgcaccacgcgcttcctggacaccacgccggagctgttcgagatcgccccgcgcaaggatcgcgccagccgcctgctgcggttcatcggcgaggtggtggtcaacggccaccccgagatgcagggacgcacgccccccgccgcgccgctggcgcgcccggcgctgcccaaggcggatctcgccgcgcccctgccggccggcacccgcgaccggctgctcgagctcggccccgcggcgttctcggcgtggatgcggacgcagccgcgcacgctgctgaccgacacgaccatgcgcgacgcccatcaatcgctgttcgccacgcgcatgcgcacgacggacatgctggccatcgccccccactacgcccggctgctgcccgagctgttctcgctcgaatgctggggcggcgccaccttcgacgtggcgatgcggtttctcaaggaagacccgtgggaccgcctgcgcaagctgcgcgcggccgcgcccaacatcctgttccagatgctgctgcgcggctccaacgcggtcggctacaccaactacgccgacaacgtcgtgcgctacttcgtccagcaggcagcccgggaaggcatcgacctgttccgcgtcttcgactcgctcaactgggtcgagaacatgcgcgtggccatggacgccgtcatcgaaagcggcgcgctgtgcgagggcacgatctgctacaccagcgatatcttcgacgccagccgccccaagtaccagctgaagtactacgtggacatggcgcgccagctcgaacgggccggcgcccacatcatcggcatcaaggacatggccggcgtgtgccgcccgccggccgcccgcgcgctggtccaggcgctgcgcgaagaggtcggcctgccgctgcatttccacacccacgacaccagcggcggctcggtggccagcgtactggcggccgccgaggccggcgccgatgccgtcgacggcgccatggacgccatgagcgggctgacgtcgcagcccagcctgggcgccatcatcgccggcctgcagcatactggccacgagaccggcatgcggcacgaaagcatcgcgccgttctcgcgctactgggaaaatgtgcgccgctactacgcccccttcgaagccgacatgcgcagcggcacctcggacgtctaccgccacgagatgcccggcggccagtacaccaacctgcgcgaacaggcgcgcgccatggggctggacgcccggtgggacgacatcgcccggtgctacgcggacgccaaccagctgttcggcgacatcgtcaaggtcacgccgtcgtccaaggtagtcggcgacatggccttgttcatggtcgccggcggcatcacggccgccgatgtgctcgaccccgaacgcgagctgtccctgccggaatccgtggtgtcgatgatgcgcggcgagctgggctatcccgccgacggctttcccccggccctgcagcaacgcatcctgaagggcgaggcgccgctcgagggccgcgccggcgcccatatccccgacgtggacctggaggccgagcgcggccgggccgaaaaggccaccgacggtccggtcagcgacgccgacctggcgagctggctcatgtatcccaaggtctacgccgactatgccgcgcaccagcgcagctatggcgacgtctgcgccatccccacgcccgtcttcttctacggcctggccgagggcgaggagatggccatcgatatcgaccagggcaagacgctgctgatacgcttgctgggccgggccgaagaaaagggcggcagcgagcaccgcctgttcttcgagctcaatggccagtcgcgttccgtgcgggtcgcgcgcgccggcctggcgggcgcgcaggaccaggcgcgccccaaggcgcaggacggcaatgccggacaattgggcgctcccatgcccggcatggtgtcggcggtctcggtccgggcggggcaggcggtgcggcgcggcgcgcccctggtgacgatcgaggccatgaaaatggagaacactctgtgcgccgagcgcgacggcgtggtgtcgcgcatcgtcgtcgcggtgggcgaccgtatcgaggcgaaagacctgctgctggagttcgcgccgcaagccgcccagcccgcggacgtcccgcgccagcgcccccgagccggcgcgtga

SEQ ID NO: 4827 - protein, 1167 aa, Bordetella bronchiseptica
MTTAIKSILVANRGEIAIRAMRAAAELGIRTVAIYANEDRFSLHRFKADESYPIGQGRRPIEAYLDIPGILDIARRAGVDAIHPGYGFLSENPDFAQACADAGIAFIGPSPAVLRSLGNKVAARNLAISLGVPVVPATDALPHDDAACLRLAREVGYPLMLKASWGGGGRGMRAIHDEAELLPAIASARREAGAAFGNDEVYLEKLVQRAHHVEVQVLGDQHGNLVHVFERDCSVQRRNQKVIERAPAPYLGDAGRQALFQAALTLTRGVGYTHAGTVEFLMDADTGNFYFIEVNPRIQVEHTVTEEVTGLDIVKAQIRVTEGVRIGEDDYLPAQEHIRLSGHALQCRITTEDPRKDFAPDYGRITAYRSAAGPGIRLDAGTAYTGAVITPYYDSLLVKVTARGHTPEETSQRMDRALREFRIRGVATNLAFLENVIAHPQFSQGKCTTRFLDTTPELFEIAPRKDRASRLLRFIGEVVVNGHPEMQGRTPPAAPLARPALPKADLAAPLPAGTRDRLLELGPAAFSAWMRTQPRTLLTDTTMRDAHQSLFATRMRTTDMLAIAPHYARLLPELFSLECWGGATFDVAMRFLKEDPWDRLRKLRAAAPNILFQMLLRGSNAVGYTNYADNVVRYFVQQAAREGIDLFRVFDSLNWVENMRVAMDAVIESGALCEGTICYTSDIFDASRPKYQLKYYVDMARQLERAGAHIIGIKDMAGVCRPPAARALVQALREEVGLPLHFHTHDTSGGSVASVLAAAEAGADAVDGAMDAMSGLTSQPSLGAIIAGLQHTGHETGMRHESIAPFSRYWENVRRYYAPFEADMRSGTSDVYRHEMPGGQYTNLREQARAMGLDARWDDIARCYADANQLFGDIVKVTPSSKVVGDMALFMVAGGITAADVLDPERELSLPESVVSMMRGELGYPADGFPPALQQRILKGEAPLEGRAGAHIPDVDLEAERGRAEKATDGPVSDADLASWLMYPKVYADYAAHQRSYGDVCAIPTPVFFYGLAEGEEMAIDIDQGKTLLIRLLGRAEEKGGSEHRLFFELNGQSRSVRVARAGLAGAQDQARPKAQDGNAGQLGAPMPGMVSAVSVRAGQAVRRGAPLVTIEAMKMENTLCAERDGVVSRIVVAVGDRIEAKDLLLEFAPQAAQPADVPRQRPRAGA

SEQ ID NO: 4828 - DNA, 7327 bp, Zea mays
  CDS (8)..(6985)
aacgacaatgtcacagcttggattagccgcagctgcctcaaaggccttgccactactccctaatcgccagagaagttcagctgggactacattctcatcatcttcattatcgaggcccttaaacagaaggaaaagccgtactcgttcactccgtgatggcggagatggggtatcagatgccaaaaagcacagccagtctgttcgtcaaggtcttgctggcattatcgacctcccaagtgaggcaccttccgaagtggatatttcacatggatctgaggatcctagggggccaacagattcttatcaaatgaatgggattatcaatgaaacacataatggaagacatgcctcagtgtccaaggttgttgaattttgtgcggcactaggtggcaaaacaccaattcacagtatattagtggccaacaatggaatggcagcagcaaaatttatgaggagtgtccggacatgggctaatgatacttttggatctgagaaggcaattcaactcatagctatggcaactccggaagacatgaggataaatgcagaacacattagaattgctgaccaattcgtagaggtgcctggtggaacaaacaataataactacgccaatgttcaactcatagtggagatggcacaaaaactaggtgtttctgctgtttggcctggttggggtcatgcttctgagaatcctgaactgccagatgcattgaccgcaaaagggatcgtttttcttggcccacctgcatcatcaatgaatgctttgggagataaggtcggctcagctctcattgctcaagcagccggggtcccaactcttgctcggagtggatcacatgttgaagttccattagagtgctgcttagacgcgatacctgaggagatgtatagaaaagcttgcgttactaccacagaggaagcagttgcaagttgtcaagtggttggttatcctgccatgattaaggcatcctggggaggtggtggtaaaggaataagaaaggttcataatgatgatgaggttagagcgctgtttaagcaagtacaaggtgaagtccctggctccccaatatttgtcatgaggcttgcatcccagagtcggcatcttgaagttcagttgctttgtgatcaatatggtaatgtagcagcacttcacagtcgtgattgcagtgtgcaacggcgacaccagaagattattgaagaaggtccagttactgttgctcctcgtgagacagttaaagcacttgagcaggcagcaaggaggcttgctaaggctgtgggttatgttggtgctgctactgttgagtatctttacagcatggaaactggagactactattttctggaacttaatccccgactacaggttgagcatccagtcaccgagtggatagctgaagtaaatctgcctgcagctcaagttgctgttggaatgggcatacctctttggcagattccagaaatcagacgtttctatggaatggactatggaggagggtatgacatttggaggaaaacagcagctcttgctacaccatttaattttgatgaagtagattctcaatggccaaagggccattgtgtagcagttagaattactagtgaggacccagatgatggtttcaaacctactggtgggaaagtgaaggagataagttttaaaagcaagcctaatgtttgggcctacttctcagtaaagtctggtggaggcattcatgaatttgctgattctcagttcggacatgtttttgcatatgggctctctagatcagcagcaataacaaacatgactcttgcattaaaagagattcaaattcgtggagaaattcattcaaatgttgattacacagttgacctcttaaatgcttcagactttagagaaaacaagattcatactggttggctcgacaccagaatagctatgcgtgttcaagctgagaggcccccatggtatatttcagtggttggaggtgctttatataaaacagtaaccaccaatgcagccactgtttctgaatatgttagttatctcaccaagggccagattccaccaaagcatatatcccttgtcaattctacagttaatttgaatatagaagggagcaaatacacaattgaaactgtaaggactggacatggtagctacaggttgagaatgaatgattcaacagttgaagcgaatgtacaatctttatgtgatggtggcctcttaatgcagttggatggaaacagccatgtaatttatgcagaagaagaagctggtggtacacggcttcagattgatggaaagacatgtttattgcagaatgaccatgatccatcaaagttattagctgagacaccctgcaaacttcttcgtttcttggttgctgatggtgctcatgttgatgcggatgtaccatacgcggaagttgaggttatgaagatgtgcatgcctctcttgtcacctgcttctggtgtcattcattgtatgatgtctgagggccaggcattgcaggctggtgatcttatagcaaggttggatcttgatgacccttctgctgtgaaaagagctgagccatttgatggaatatttccacaaatggagctccctgttgctgtctctagtcaagtacacaaaagatatgctgcaagtttgaatgctgctcgaatggtccttgcaggatatgagcacaatattaatgaagtcgttcaagatttggtatgctgcctggacaaccctgagcttcctttcctacagtgggatgaacttatgtctgttctagcaacgaggcttccaagaaatctcaagagtgagttagaggataaatacaaggaatacaagttgaatttttaccatggaaaaaacgaggactttccatccaagttgctaagagacatcattgaggaaaatctttcttatggttcagagaaggaaaaggctacaaatgagaggcttgttgagcctcttatgaacctactgaagtcatatgagggtgggagagagagccatgcacattttgttgtcaagtctcttttcgaggagtatcttacagtggaagaactttttagtgatggcattcagtctgacgtgattgaaacattgcggcatcagcacagtaaagacctgcagaaggttgtagacattgtgttgtctcaccagggtgtgaggaacaaagctaagcttgtaacggcacttatggaaaagctggtttatccaaatcctggtggttacagggatctgttagttcgcttttcttccctcaatcataaaagatattataagttggcccttaaagcaagtgaacttcttgaacaaaccaaactaagtgaactccgtgcaagcgttgcaagaagcctttcggatctggggatgcataagggagaaatgagtattaaggataacatggaagatttagtctctgccccattacctgttgaagatgctctgatttctttgtttgattacagtgatcgaactgttcagcagaaagtgattgagacatacatatcacgattgtaccagcctcatcttgtaaaggatagcatccaaatgaaattcaaggaatctggtgctattactttttgggaattttatgaagggcatgttgatactagaaatggacatggggctattattggtgggaagcgatggggtgccatggtcgttctcaaatcacttgaatctgcgtcaacagccattgtggctgcattaaaggattcggcacagttcaacagctctgagggcaacatgatgcacattgcattattgagtgctgaaaatgaaagtaatataagtggaataagcagtgatgatcaagctcaacataagatggaaaagcttagcaagatactgaaggatactagcgttgcaagtgatctccaagctgctggtttgaaggttataagttgcattgttcaaagagatgaagctcgcatgccaatgcgccacacattcctctggttggatgacaagagttgttatgaagaagagcagattctccggcatgtggagcctcccctctctacacttcttgaattggataagttgaaggtgaaaggatacaatgaaatgaagtatactccttcgcgtgaccgccaatggcatatctacacactaagaaatactgaaaaccccaaaatgttgcatagggtgtttttccgaactattgtcaggcaacccaatgcaggcaacaagtttacatcggctcagatcagcgacgctgaagtaggatgtcccgaagaatctctttcatttacatcaaatagcatcttaagatcattgatgactgctattgaagaattagagcttcatgcaattaggacaggtcattctcacatgtatttgtgcatactgaaagagcaaaagcttcttgacctcattccattttcagggagtacaattgttgatgttggccaagatgaagctaccgcttgttcacttttaaaatcaatggctttgaagatacatgagcttgttggtgcaaggatgcatcatctgtctgtatgccagtgggaggtgaaactcaagttggactgtgatggccctgcaagtggtacctggagagttgtaactacaaatgttactggtcacacctgcaccattgatatataccgagaagtggaggaaatagaatcgcagaagttagtgtaccattcagccacttcgtcagctggaccattgcatggtgttgcactgaataatccatatcaacctttgagtgtgattgatctaaagcgctgctctgctaggaacaacagaacaacatattgctatgattttccgctggcctttgaaactgcactgcagaagtcatggcagtccaatggctctactgtttctgaaggcaatgaaaatagtaaatcctacgtgaaggcaactgagctagtgtttgctgaaaaacatgggtcctggggcactcctataattccgatggaacgccctgctgggctcaacgacattggtatggtcgcttggatcatggagatgtcaacacctgaatttcccaatggcaggcagattattgttgtagcaaatgatatcactttcagagctggatcatttggcccaagggaagatgcattttttgaaactgtcactaacctggcttgcgaaaggaaacttcctcttatatacttggcagcaaactctggtgctaggattggcatagctgatgaagtaaaatcttgcttccgtgttggatggtctgacgaaggcagtcctgaacgagggtttcagtacatctatctgactgaagaagactatgctcgcattagctcttctgttatagcacataagctggagctagatagtggtgaaattaggtggattattgactctgttgtgggcaaggaggatgggcttggtgtcgagaacatacatggaagtgctgctattgccagtgcttattctagggcatatgaggagacatttacacttacatttgtgactgggcggactgtaggaataggagcttatcttgctcgacttggtatacggtgcatacagcgtcttgaccagcctattattttaacagggttttctgccctgaacaagctccttgggcgggaagtgtacagctcccacatgcagcttggtggtcctaagatcatggcgactaatggtgttgtccacctcactgttccagatgaccttgaaggtgtttccaatatattgaggtggctcagctatgttcctgcaaacattggtggacctcttcctattaccaaacctctggaccctccagacagacctgttgcttacatccctgagaacacatgcgatccacgtgcagctatctgtggtgtagatgacagccaagggaaatggttgggtggtatgtttgacaaagacagctttgtggagacatttgaaggatgggcaaaaacagtggttactggcagagcaaagcttggaggaattcctgtgggcgtcatagctgtggagacacagaccatgatgcagatcatccctgctgatccaggtcagcttgattcccatgagcgatctgtccctcgtgctggacaagtgtggttcccagattctgcaaccaagaccgctcaggcattattagacttcaaccgtgaaggattgcctctgttcatcctggctaattggagaggcttctctggtggacaaagagatctctttgaaggaattcttcaggctgggtcaacaattgtcgagaaccttaggacatctaatcagcctgcttttgtgtacattcctatggctggagagcttcgtggaggagcttgggttgtggtcgatagcaaaataaatccagaccgcattgagtgttatgctgaaaggactgccaaaggtaatgttctcgaacctcaagggttaattgaaatcaagttcaggtcagaggaactccaagactgtatgggtaggcttgacccagagttgataaatctgaaagcaaaactccaagatgtaaatcatggaaatggaagtctaccagacatagaagggattcggaagagtatagaagcacgtacgaaacagttgctgcctttatatacccagattgcaatacggtttgctgaattgcatgatacttccctaagaatggcagctaaaggtgtgattaagaaagttgtagactgggaagaatcacgctcgttcttctataaaaggctacggaggaggatcgcagaagatgttcttgcaaaagaaataaggcagatagtcggtgataaatttacgcaccaattagcaatggagctcatcaaggaatggtaccttgcttctcaggccacaacaggaagcactggatgggatgacgatgatgcttttgttgcctggaaggacagtcctgaaaactacaaggggcatatccaaaagcttagggctcaaaaagtgtctcattcgctctctgatcttgctgactccagttcagatctgcaagcattctcgcagggtctttctacgctattagataagatggatccctctcagagagcgaagtttgttcaggaagtcaagaaggtccttgattgatgataccaacacatccaacacaatgtgtgcatgtcacatctttttgttctagtacatacatagaaggatattgcttggtcttgattgatcatgtctgatttaagtcgactattatttcttggatttttcttttggacctggtgctatggttgatggatgtatattggatatgtgcgttctgccaggtgtaagcacaaaggtttagacagaccgagagcaagagcgagtgaacctgttctggttttgcagtggttcagtaaggcagaaagttgttaaaccgtagttctgagatgtattaccagtggcgccatgctgtacttttagggtgtataatgcggatac

SEQ ID NO: 4829 - protein, 2325 aa, Zea mays
MSQLGLAAAASKALPLLPNRQRSSAGTTFSSSSLSRPLNRRKSRTRSLRDGGDGVSDAKKHSQSVRQGLAGIIDLPSEAPSEVDISHGSEDPRGPTDSYQMNGIINETHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVEMAQKLGVSAVWPGWGHASENPELPDALTAKGIVFLGPPASSMNALGDKVGSALIAQAAGVPTLARSGSHVEVPLECCLDAIPEEMYRKACVTTTEEAVASCQVVGYPAMIKASWGGGGKGIRKVHNDDEVRALFKQVQGEVPGSPIFVMRLASQSRHLEVQLLCDQYGNVAALHSRDCSVQRRHQKIIEEGPVTVAPRETVKALEQAARRLAKAVGYVGAATVEYLYSMETGDYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEISFKSKPNVWAYFSVKSGGGIHEFADSQFGHVFAYGLSRSAAITNMTLALKEIQIRGEIHSNVDYTVDLLNASDFRENKIHTGWLDTRIAMRVQAERPPWYISVVGGALYKTVTTNAATVSEYVSYLTKGQIPPKHISLVNSTVNLNIEGSKYTIETVRTGHGSYRLRMNDSTVEANVQSLCDGGLLMQLDGNSHVIYAEEEAGGTRLQIDGKTCLLQNDHDPSKLLAETPCKLLRFLVADGAHVDADVPYAEVEVMKMCMPLLSPASGVIHCMMSEGQALQAGDLIARLDLDDPSAVKRAEPFDGIFPQMELPVAVSSQVHKRYAASLNAARMVLAGYEHNINEVVQDLVCCLDNPELPFLQWDELMSVLATRLPRNLKSELEDKYKEYKLNFYHGKNEDFPSKLLRDIIEENLSYGSEKEKATNERLVEPLMNLLKSYEGGRESHAHFVVKSLFEEYLTVEELFSDGIQSDVIETLRHQHSKDLQKVVDIVLSHQGVRNKAKLVTALMEKLVYPNPGGYRDLLVRFSSLNHKRYYKLALKASELLEQTKLSELRASVARSLSDLGMHKGEMSIKDNMEDLVSAPLPVEDALISLFDYSDRTVQQKVIETYISRLYQPHLVKDSIQMKFKESGAITFWEFYEGHVDTRNGHGAIIGGKRWGAMVVLKSLESASTAIVAALKDSAQFNSSEGNMMHIALLSAENESNISGISSDDQAQHKMEKLSKILKDTSVASDLQAAGLKVISCIVQRDEARMPMRHTFLWLDDKSCYEEEQILRHVEPPLSTLLELDKLKVKGYNEMKYTPSRDRQWHIYTLRNTENPKMLHRVFFRTIVRQPNAGNKFTSAQISDAEVGCPEESLSFTSNSILRSLMTAIEELELHAIRTGHSHMYLCILKEQKLLDLIPFSGSTIVDVGQDEATACSLLKSMALKIHELVGARMHHLSVCQWEVKLKLDCDGPASGTWRVVTTNVTGHTCTIDIYREVEEIESQKLVYHSATSSAGPLHGVALNNPYQPLSVIDLKRCSARNNRTTYCYDFPLAFETALQKSWQSNGSTVSEGNENSKSYVKATELVFAEKHGSWGTPIIPMERPAGLNDIGMVAWIMEMSTPEFPNGRQIIVVANDITFRAGSFGPREDAFFETVTNLACERKLPLIYLAANSGARIGIADEVKSCFRVGWSDEGSPERGFQYIYLTEEDYARISSSVIAHKLELDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVPDDLEGVSNILRWLSYVPANIGGPLPITKPLDPPDRPVAYIPENTCDPRAAICGVDDSQGKWLGGMFDKDSFVETFEGWAKTVVTGRAKLGGIPVGVIAVETQTMMQIIPADPGQLDSHERSVPRAGQVWFPDSATKTAQALLDFNREGLPLFILANWRGFSGGQRDLFEGILQAGSTIVENLRTSNQPAFVYIPMAGELRGGAWVVVDSKINPDRIECYAERTAKGNVLEPQGLIEIKFRSEELQDCMGRLDPELINLKAKLQDVNHGNGSLPDIEGIRKSIEARTKQLLPLYTQIAIRFAELHDTSLRMAAKGVIKKVVDWEESRSFFYKRLRRRIAEDVLAKEIRQIVGDKFTHQLAMELIKEWYLASQATTGSTGWDDDDAFVAWKDSPENYKGHIQKLRAQKVSHSLSDLADSSSDLQAFSQGLSTLLDKMDPSQRAKFVQEVKKVLD

SEQ ID NO: 4830 - DNA, 7324 bp, Zea mays
  CDS (8)..(6982)
aacgacaatgtcacagcttggattagccgcagctgcctcaaaggccttgccactactccctaatcgccagagaagttcagctgggactacattctcatcatcttcattatcgaggcccttaaacagaaggaaaagccgtactcgttcactccgtgatggcggagatggggtatcagatgccaaaaagcacagccagtctgttcgtcaaggtcttgctggcattatcgacctcccaagtgaggcaccttccgaagtggatatttcacatggatctgaggatcctagggggccaacagattcttatcaaatgaatgggattatcaatgaaacacataatggaagacatgcctcagtgtccaaggttgttgaattttgtgcggcactaggtggcaaaacaccaattcacagtatattagtggccaacaatggaatggcagcagcaaaatttatgaggagtgtccggacatgggctaatgatacttttggatctgagaaggcaattcaactcatagctatggcaactccggaagacatgaggataaatgcagaacacattagaattgctgaccaattcgtagaggtgcctggtggaacaaacaataataactacgccaatgttcaactcatagtggagatggcacaaaaactaggtgtttctgctgtttggcctggttggggtcatgcttctgagaatcctgaactgccagatgcattgaccgcaaaagggatcgtttttcttggcccacctgcatcatcaatgaatgctttgggagataaggtcggctcagctctcattgctcaagcagccggggtcccaactcttgcttggagtggatcacatgttgaagttccattagagtgctgcttagacgcgatacctgaggagatgtatagaaaagcttgcgttactaccacagaggaagcagttgcaagttgtcaagtggttggttatcctgccatgattaaggcatcctggggaggtggtggtaaaggaataagaaaggttcataatgatgatgaggttagagcgctgtttaagcaagtacaaggtgaagtccctggctccccaatatttgtcatgaggcttgcatcccagagtcggcatcttgaagttcagttgctttgtgatcaatatggtaatgtagcagcacttcacagtcgtgattgcagtgtgcaacggcgacaccagaagattattgaagaaggtccagttactgttgctcctcgtgagacagttaaagcacttgagcaggcagcaaggaggcttgctaaggctgtgggttatgttggtgctgctactgttgagtatctttacagcatggaaactggagactactattttctggaacttaatccccgactacaggttgagcatccagtcaccgagtggatagctgaagtaaatctgcctgcagctcaagttgctgttggaatgggcatacctctttggcagattccagaaatcagacgtttctatggaatggactatggaggagggtatgacatttggaggaaaacagcagctcttgctacaccatttaattttgatgaagtagattctcaatggccaaagggccattgtgtagcagttagaattactagtgaggacccagatgatggtttcaaacctactggtgggaaagtgaaggagataagttttaaaagcaagcctaatgtttgggcctacttctcagtaaagtctggtggaggcattcatgaatttgctgattctcagttcggacatgtttttgcatatgggctctctagatcagcagcaataacaaacatgactcttgcattaaaagagattcaaattcgtggagaaattcattcaaatgttgattacacagttgacctcttaaatgcttcagactttagagaaaacaagattcatactggttggctcgacaccagaatagctatgcgtgttcaagctgagaggcccccatggtatatttcagtggttgggggtgctttatataaaacagtaaccaccaatgcagccactgtttctgaatatgttagttatctcaccaagggccagattccaccaaagcatatatcccttgtcaattctacagttaatttgaatatagaagggagcaaatacacaattgaaactgtaaggactggacatggtagctacaggttgagaatgaatgattcaacagttgaagcgaatgtacaatctttatgtgatggtggcctcttaatgcagttggatggaaacagccatgtaatttatgcagaagaagaagctggtggtacacggcttcagattgatggaaagacatgtttattgcagaatgaccatgatccatcaaagttattagctgagacaccctgcaaacttcttcgtttcttggttgctgatggtgctcatgttgatgcggatgtaccatacgcggaagttgaggttatgaagatgtgcatgcctctcttgtcgcctgcttctggtgtcattcattgtatgatgtctgagggccaggcattgcaggctggtgatcttatagcaaggttggatcttgatgacccttctgctgtgaaaagagctgagccatttgatggaatatttccacaaatggagctccctgttgctgtctctagtcaagtacacaaaagatatgctgcaagtttgaatgctgctcgaatggtccttgcaggatatgagcacaatattaatgaagtcgttcaagatttggtatgctgcctggacaaccctgagcttcctttcctacagtgggatgaacttatgtctgttctagcaacgaggcttccaagaaatctcaagagtgagttagaggataaatacaaggaatacaagttgaatttttaccatggaaaaaacgaggactttccatccaagttgctaagagacatcattgaggaaaatctttcttatggttcagagaaggaaaaggctacaaatgagaggcttgttgagcctcttatgaacctactgaagtcatatgagggtgggagagagagccatgcacattttgttgtcaagtctcttttcgaggagtatcttacagtggaagaactttttagtgatggcattcagtctgacgtgattgaaacattgcggcatcagcacagtaaagacctgcagaaggttgtagacattgtgttgtctcaccagggtgtgaggaacaaagctaagcttgtaacggcacttatggaaaagctggtttatccaaatcctggtggttacagggatctgttagttcgcttttcttccctcaatcataaaagatattataagttggcccttaaagcaagtgaacttcttgaacaaaccaaactaagtgaactccgtgcaagcgttgcaagaagcctttcggatctggggatgcataagggagaaatgagtattaaggataacatggaagatttagtctctgccccattacctgttgaagatgctctgatttctttgtttgattacagtgatcgaactgttcagcagaaagtgattgagacatacatatcacgattgtaccagcctcatcttgtaaaggatagcatccaaatgaaattcaaggaatctggtgctattactttttgggaattttatgaagggcatgttgatactagaaatggacatggggctattattggtgggaagcgatggggtgccatggtcgttctcaaatcacttgaatctgcgtcaacagccattgtggctgcattaaaggattcggcacagttcaacagctctgagggcaacatgatgcacattgcattattgagtgctgaaaatgaaagtaatataagtggaataagtgatgatcaagctcaacataagatggaaaagcttagcaagatactgaaggatactagcgttgcaagtgatctccaagctgctggtttgaaggttataagttgcattgttcaaagagatgaagctcgcatgccaatgcgccacacattcctctggttggatgacaagagttgttatgaagaagagcagattctccggcatgtggagcctcccctctctacacttcttgaattggataagttgaaggtgaaaggatacaatgaaatgaagtatactccttcgcgtgaccgccaatggcatatctacacactaagaaatactgaaaaccccaaaatgttgcatagggtgtttttccgaactattgtcaggcaacccaatgcaggcaacaagtttacatcggctcagatcagcgacgctgaagtaggatgtcccgaagaatctctttcatttacatcaaatagcatcttaagatcattgatgactgctattgaagaattagagcttcatgcaattaggacaggtcattctcacatgtatttgtgcatactgaaagagcaaaagcttcttgacctcattccattttcagggagtacaattgttgatgttggccaagatgaagctaccgcttgttcacttttaaaatcaatggctttgaagatacatgagcttgttggtgcaaggatgcatcatctgtctgtatgccagtgggaggtgaaactcaagttggactgtgatggccctgcaagtggtacctggagagttgtaactacaaatgttactggtcacacctgcaccattgatatataccgagaagtggaggaaatagaatcgcagaagttagtgtaccattcagccacttcgtcagctggaccattgcatggtgttgcactgaataatccatatcaacctttgagtgtgattgatctaaagcgctgctctgctaggaacaacagaacaacatattgctatgattttccgctggcctttgaaactgcactgcagaagtcatggcagaccaatggctctactgtttctgaaggcaatgaaaatagtaaatcctacgtgaaggcaactgagctagtgtttgctgaaaaacatgggtcctggggcactcctataattccgatggaacgccctgctgggctcaacgacattggtatggtcgcttggatcatggagatgtcaacacctgaatttcccaatggcaggcagattattgttgtagcaaatgatatcactttcagagctggatcatttggcccaagggaagatgcattttttgaaactgtcactaacctggcttgcgaaaggaaacttcctcttatatacttggcagcaaactctggtgctaggattggcatagctgatgaagtaaaatcttgcttccgtgttggatggtctgacgaaggcagtcctgaacgagggtttcagtacatctatctgactgaagaagactatgctcgcattagctcttctgttatagcacataagctggagctagatagtggtgaaattaggtggattattgactctgttgtgggcaaggaggatgggcttggtgtcgagaacatacatggaagtgctgctattgccagtgcttattctagggcatatgaggagacatttacacttacatttgtgactgggcggactgtaggaataggagcttatcttgctcgacttggtatacggtgcatacagcgtcttgaccagcctattattttaacagggttttctgccctgaacaagctccttgggcgggaagtgtacagctcccacatgcagcttggtggtcctaagatcatggcgactaatggtgttgtccacctcactgttccagatgaccttgaaggtgtttccaatatattgaggtggctcagctatgttcctgcaaacattggtggacctcttcctattaccaaacctctggaccctccagacagacctgttgcttacatccctgagaacacatgcgatccacgtgcagctatctgtggtgtagatgacagccaagggaaatggttgggtggtatgtttgacaaagacagctttgtggagacatttgaaggatgggcaaaaacagtggttactggcagagcaaagcttggaggaattcctgtgggcgtcatagctgtggagacacagaccatgatgcagatcatccctgctgatccaggtcagcttgattcccatgagcgatctgtccctcgtgctggacaagtgtggttcccagattctgcaaccaagaccgctcaggcattattagacttcaaccgtgaaggattgcctctgttcatcctggctaattggagaggcttctctggtggacaaagagatctctttgaaggaattcttcaggctgggtcaacaattgtcgagaaccttaggacatataatcagcctgcttttgtgtacattcctatggctggagagcttcgtggaggagcttgggttgtggtcgatagcaaaataaatccagaccgcattgagtgttatgctgaaaggactgccaaaggtaatgttctcgaacctcaagggttaattgaaatcaagttcaggtcagaggaactccaagactgtatgggtaggcttgacccagagttgataaatctgaaagcaaaactccaagatgtaaatcatggaaatggaagtctaccagacatagaagggattcggaagagtatagaagcacgtacgaaacagttgctgcctttatatacccagattgcaatacggtttgctgaattgcatgatacttccctaagaatggcagctaaaggtgtgattaagaaagttgtagactgggaagaatcacgctcgttcttctataaaaggctacggaggaggatcgcagaagatgttcttgcaaaagaaataaggcagatagtcggtgataaatttacgcaccaattagcaatggagctcatcaaggaatggtaccttgcttctcaggccacaacaggaagcactggatgggatgacgatgatgcttttgttgcctggaaggacagtcctgaaaactacaaggggcatatccaaaagcttagggctcaaaaagtgtctcattcgctctctgatcttgctgactccagttcagatctgcaagcattctcgcagggtctttctacgctattagataagatggatccctctcagagagcgaagtttgttcaggaagtcaagaaggtccttgattgatgataccaacacatccaacacaatgtgtgcatgtcacatctttttgttctagtacatacatagaaggatattgcttggtcttgattgatcatgtctgatttaagtcgactattatttcttggatttttcttttggacctggtgctatggttgatggatgtatattggatatgtgcgttctgccaggtgtaagcacaaaggtttagacagaccgagagcaagagcgagtgaacctgttctggttttgcagtggttcagtaaggcagaaagttgttaaaccgtagttctgagatgtattaccagtggcgccatgctgtacttttagggtgtataatgcggatac

SEQ ID NO: 4831 - protein, 2324 aa, Zea mays
MSQLGLAAAASKALPLLPNRQRSSAGTTFSSSSLSRPLNRRKSRTRSLRDGGDGVSDAKKHSQSVRQGLAGIIDLPSEAPSEVDISHGSEDPRGPTDSYQMNGIINETHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVEMAQKLGVSAVWPGWGHASENPELPDALTAKGIVFLGPPASSMNALGDKVGSALIAQAAGVPTLAWSGSHVEVPLECCLDAIPEEMYRKACVTTTEEAVASCQVVGYPAMIKASWGGGGKGIRKVHNDDEVRALFKQVQGEVPGSPIFVMRLASQSRHLEVQLLCDQYGNVAALHSRDCSVQRRHQKIIEEGPVTVAPRETVKALEQAARRLAKAVGYVGAATVEYLYSMETGDYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEISFKSKPNVWAYFSVKSGGGIHEFADSQFGHVFAYGLSRSAAITNMTLALKEIQIRGEIHSNVDYTVDLLNASDFRENKIHTGWLDTRIAMRVQAERPPWYISVVGGALYKTVTTNAATVSEYVSYLTKGQIPPKHISLVNSTVNLNIEGSKYTIETVRTGHGSYRLRMNDSTVEANVQSLCDGGLLMQLDGNSHVIYAEEEAGGTRLQIDGKTCLLQNDHDPSKLLAETPCKLLRFLVADGAHVDADVPYAEVEVMKMCMPLLSPASGVIHCMMSEGQALQAGDLIARLDLDDPSAVKRAEPFDGIFPQMELPVAVSSQVHKRYAASLNAARMVLAGYEHNINEVVQDLVCCLDNPELPFLQWDELMSVLATRLPRNLKSELEDKYKEYKLNFYHGKNEDFPSKLLRDIIEENLSYGSEKEKATNERLVEPLMNLLKSYEGGRESHAHFVVKSLFEEYLTVEELFSDGIQSDVIETLRHQHSKDLQKVVDIVLSHQGVRNKAKLVTALMEKLVYPNPGGYRDLLVRFSSLNHKRYYKLALKASELLEQTKLSELRASVARSLSDLGMHKGEMSIKDNMEDLVSAPLPVEDALISLFDYSDRTVQQKVIETYISRLYQPHLVKDSIQMKFKESGAITFWEFYEGHVDTRNGHGAIIGGKRWGAMVVLKSLESASTAIVAALKDSAQFNSSEGNMMHIALLSAENESNISGISDDQAQHKMEKLSKILKDTSVASDLQAAGLKVISCIVQRDEARMPMRHTFLWLDDKSCYEEEQILRHVEPPLSTLLELDKLKVKGYNEMKYTPSRDRQWHIYTLRNTENPKMLHRVFFRTIVRQPNAGNKFTSAQISDAEVGCPEESLSFTSNSILRSLMTAIEELELHAIRTGHSHMYLCILKEQKLLDLIPFSGSTIVDVGQDEATACSLLKSMALKIHELVGARMHHLSVCQWEVKLKLDCDGPASGTWRVVTTNVTGHTCTIDIYREVEEIESQKLVYHSATSSAGPLHGVALNNPYQPLSVIDLKRCSARNNRTTYCYDFPLAFETALQKSWQTNGSTVSEGNENSKSYVKATELVFAEKHGSWGTPIIPMERPAGLNDIGMVAWIMEMSTPEFPNGRQIIVVANDITFRAGSFGPREDAFFETVTNLACERKLPLIYLAANSGARIGIADEVKSCFRVGWSDEGSPERGFQYIYLTEEDYARISSSVIAHKLELDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVPDDLEGVSNILRWLSYVPANIGGPLPITKPLDPPDRPVAYIPENTCDPRAAICGVDDSQGKWLGGMFDKDSFVETFEGWAKTVVTGRAKLGGIPVGVIAVETQTMMQIIPADPGQLDSHERSVPRAGQVWFPDSATKTAQALLDFNREGLPLFILANWRGFSGGQRDLFEGILQAGSTIVENLRTYNQPAFVYIPMAGELRGGAWVVVDSKINPDRIECYAERTAKGNVLEPQGLIEIKFRSEELQDCMGRLDPELINLKAKLQDVNHGNGSLPDIEGIRKSIEARTKQLLPLYTQIAIRFAELHDTSLRMAAKGVIKKVVDWEESRSFFYKRLRRRIAEDVLAKEIRQIVGDKFTHQLAMELIKEWYLASQATTGSTGWDDDDAFVAWKDSPENYKGHIQKLRAQKVSHSLSDLADSSSDLQAFSQGLSTLLDKMDPSQRAKFVQEVKKVLD

SEQ ID NO: 4832 - DNA, 3537 bp, Sus scrofa
  CDS (1)..(3537)
atgctgaagttccgaacagtccgcgggggcctgaggctcctgggtatccgccgaacctctactgcccctgccgcctccccgaatgtccggcgcctggagtacaagcccatcaagaaggtcatggtggccaatagaggcgagatcgccatccgtgtgttccgggcctgcacggagctgggcatccgcacggtggccgtctactcagagcaggacaccggccagatgcaccggcagaaagccgatgaagcctatctcatcggccgcggcctcgccccggtgcaggcctacctgcacatcccagacatcatcaaggtggccaaggaaaacaacgtggacgccgtgcaccctggctacgggttcctgtccgagcgcgcggacttcgcccaggcctgccaggatgcgggcgtccggttcatcgggccgagccccgaggtggtccgcaagatgggagacaaggtggaggcccgggccatcgccatcgccgcaggtgtccccgtggtccccggcacagacgcccccatcacgtccctgcacgaggcccatgagttctccaacacctacggcttccccattatcttcaaggccgcctatgggggcggggggcgcggcatgagggttgtgcacagctatgaggagctggaggagaactacacccgggcctactcggaggctctggccgccttcgggaacggggcgctgtttgtggagaagttcatcgagaagccgcgccacatcgaggtgcagatcctgggggaccagtacgggaacgtcctgcacctgtacgagcgggactgctccatccagcggcggcaccagaaggtggtggagatcgcccctgccgcccacctggacccccagcttcggacccggctcaccagtgactccgtcaaacttgcaaagcaggtgggctacgagaacgcgggcacggtggagttcctggtggacaagcacggcaagcactacttcatcgaggtcaactcgcgcctgcaggtggagcacacagtcaccgaggagatcacagatgtggacctggtccacgcccagatccacgtggccgagggccggagcctgcccgacctgggcctgcggcaggagaacatccgcatcaacggctgtgccatccagtgccgggtcaccaccgaggaccccgcgcgcagcttccagcccgacactggccgcatcgaggtgttccggagtggggagggcatgggcatccgtctggataacgcatctgccttccaaggagctgtcatctccccccactacgattccctgctggtcaaggtcatcgcccacggcaaagaccaccccacggccgccaccaagatgagcagagcccttgccgagttccgagtccgaggcgtcaagaccaacatccccttcctgcagaacgtgctcaacaaccagcagttcctggcaggcaccgtggacacccagttcatcgacgagaacccggagctgttccagctgcggcctgcacagaaccgggcccagaagctgctgcactaccttggacatatcatggtgaatggcccaaccaccccgattcctgtcaaggccaaccccagccccacggaccctgttgtccctgtggtgcccataggcccgcctccagctggtttcagagacatcctgctgcgggagggtcccgagggcttcgctcgagccgtgcggaaccaccaggggctgctgctgatggacacaaccttcagggacgcccaccagtcactgctggccactcgtgtgcgaacccacgacctcaaaaagatctccccctacgtcgcccacaacttcagcaaactcttcagcatagagaactggggaggagccacatttgatgttgcgatgcgcttcctgtatgagtgcccttggcggcggctgcaggagctccgggagctcatccccaacatcccgttccagatgcttctgcggggggccaacgccgtgggctacaccaactaccccgacaatgtggtcttcaagttctgcgaggtggccaaggagaatggcatggatgtctttcgggtctttgactccctcaactacctgcccaacctactgctgggcatggaggcggtgggcagtgccggcggtgtggtggaggccgccatctcctacacgggtgacgtggccgaccccagccgcaccaagtactcgctgcagtactacatggacttggctgaagagctggtgcgagctggcacccacatcctgtgcatcaaggacatggcagggctgctgaagccagccgcctgcaccatgctggtcagctccctccgggaccgcttccccgacctcccgctgcacatccacacccatgacacgtcaggggcgggcgtggcggccatgctggcctgtgcccaggctggggccgatgtggtcgacgtggcagccgactccatgtctggaatgacttcgcagcccagcttgggggccctggtggcctgtacccgagggactcccctggacacaggggtgcccatggagcgcgtgtttgactacagtgagtactgggagggggcccgggggctgtacgcagcctttgactgcacggccaccatgaagtctggcaactcggatgtgtacgagaacgagatcccaggaggccagtacaccaacctgcacttccaggcacacagcatggggctcggctccaagttcaaggaggtcaagaaggcctacgtggaggccaaccagatgctgggtgacctcatcaaggtgacaccctcctccaagatcgtgggggacctggcccagtttatggtgcagaatgggctgagtcgggcagaggctgaggcccaggcagaagagctgtccttcccccgctcagtggtggagttcctgcagggctacatcggcaccccgcatgggggctttcctgagccccttcgctccaaggtactaaaggacctgccaagggtggaggggcggcctggagcctccctccctcccctggacctgcaggccctggagaaggagctgacggaacggcacggggaggaggtgaccccggaggatgtgctctcagcagccatgtaccccgacgtctttgcccacttcaaggacttcactgccacctttgggcccctagacagcctcagtacccggctcttcctgcagggacccaaaattgcagaggagtttgaggtggagctggagcggggcaagacgctgcacatcaaagccctggccataagtgacctgaaccgggctggccagaggcaggtcttcttcgagctcaacggacagctgcgatccatcctggtcaaggacactcaggccatgaaggagatgcacttccaccccaaggccctgaaggatgtgaagggccagattggggcacccatgcccgggaaggtgatagacatcaaggtggtggcaggggccaaggtggccaagggccagccgctgtgtgtgctcagtgccatgaagatggagactgtggtgacctcgcccatggagggcactgtccgcaaggtccacgtgaccacagacatgacactggagggggacgacctcatcctggagattgaatga

SEQ ID NO: 4833 - protein, 1178 aa, Sus scrofa
MLKFRTVRGGLRLLGIRRTSTAPAASPNVRRLEYKPIKKVMVANRGEIAIRVFRACTELGIRTVAVYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNVLHLYERDCSIQRRHQKVVEIAPAAHLDPQLRTRLTSDSVKLAKQVGYENAGTVEFLVDKHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIPFLQNVLNNQQFLAGTVDTQFIDENPELFQLRPAQNRAQKLLHYLGHIMVNGPTTPIPVKANPSPTDPVVPVVPIGPPPAGFRDILLREGPEGFARAVRNHQGLLLMDTTFRDAHQSLLATRVRTHDLKKISPYVAHNFSKLFSIENWGGATFDVAMRFLYECPWRRLQELRELIPNIPFQMLLRGANAVGYTNYPDNVVFKFCEVAKENGMDVFRVFDSLNYLPNLLLGMEAVGSAGGVVEAAISYTGDVADPSRTKYSLQYYMDLAEELVRAGTHILCIKDMAGLLKPAACTMLVSSLRDRFPDLPLHIHTHDTSGAGVAAMLACAQAGADVVDVAADSMSGMTSQPSLGALVACTRGTPLDTGVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGTPHGGFPEPLRSKVLKDLPRVEGRPGASLPPLDLQALEKELTERHGEEVTPEDVLSAAMYPDVFAHFKDFTATFGPLDSLSTRLFLQGPKIAEEFEVELERGKTLHIKALAISDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTTDMTLEGDDLILEIE

SEQ ID NO: 4834 - DNA, 7041 bp, Homo sapiens
  CDS (1)..(7041)
atggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagtggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtatactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccgtatgacgcagcacatatcacccactcagcgagcagaagtcatacggatcctctccacaatggattccccttccacgtga

SEQ ID NO: 4835 - protein, 2346 aa, Homo sapiens [sequence omitted]

SEQ ID NO: 4836 - DNA, 2467 bp, Mus musculus
  CDS (6)..(2180)
ggacgatggcggggcagtgggtcaggaccgtggcgctgttggcggccaggcggcattggcggcggtcctcgcagcagcaattgctggggacgctgaagcatgctccagtctattcataccaatgcctagtggtgtccagaagtctcagttctgtggaatatgagcctaaagaaaagacttttgataaaattctcattgctaacagaggagaaattgcctgtagggttattaaaacttgcaagaagatgggcatcaagacagttgccattcacagtgatgttgatgccagttctgttcacgtgaaaatggcggatgaggctgtctgtgttggcccagctcccaccagtaaaagctacctcaacatggatgccatcatggaagccattaagaaaaccagggcccaagctgtacacccagggtatggattcctgtcagaaaacaaagagtttgcaaagcgtctggcagcagaagatgtcactttcattggacctgatactcatgctattcaagccatgggtgacaagatagaaagcaaactattagccaagagagcaaaggtcaacacaatccctggttttgatggggtagtaaaggatgcagatgaagctgtcagaattgcaagggaaattggctaccctgtgatgatcaaggcctcagcaggcggtggtgggaaaggcatgcgcatcgcctgggatgacgaagagaccagggatggctttagattttcatcccaggaagctgcttctagttttggtgatgatagactactaatagaaaaatttatcgataaccctcgtcatatagaaatccaggttttaggggataaacatggcaatgctctgtggctcaatgagagggagtgctcgatccagagaaggaaccagaaggtggtagaggaggcgccaagcatttttctggatcctgaaactcgccaagcaatgggagagcaggccgtggctttggctaaagccgtgaagtattcttctgctggaactgtggaatttcttgtggactcccagaagaatttttacttcttggagatgaatacaagactacaggtcgaacatcctgtcacagagtgcattactggcctggacttagtccaagaaatgatccttgttgctaagggttacccactcaggcacaagcaagaggatattcccatcagtggctgggcagttgaatgtcgggtttatgctgaggacccctacaagtctttcggtttaccgtctattgggaggctgtcccagtaccaagagccgatacatctacctggtgtccgagttgacagtggcatccaaccaggaagtgacatcagcatctattatgatcctatgatttcaaagctagtcacatatgggtctgacagagcagaagccctgaagaggatggaagacgcactggacaattatgtgatccggggtgttacacacaacatcccattgctccgggaggtgataatcaacacacgttttgtgaaaggagacatcagcactaagtttctctctgatgtgtatcctgatggcttcaaagggcacacgttaacactgagtgagagaaaccagttattggccattgcatcatctgtatttgtggcatcccagctacgagctcagcgcttccaagaacattcaagagtaccagttattaggcctgatgtggctaagtgggagctctcggtaaagttacatgatgaagatcatactgtcgtggcatctaacaatgggccggcatttaccgtggaagttgatggctcgaaactaaatgtgaccagtacgtggaacctggcgtcacccttattgtctgtcaacgttgatggcacgcagaggactgtgcagtgtctttctcgggaagcaggtggaaacatgagcatccagtttcttggcacagtgtacaaagtgcacattttaaccaagcttgctgcagagctgaacaaattcatgcttgaaaaagtgcccaaggacaccagcagcactctgtgctccccgatgcctggagtggtggtggccgtttctgtcaagcctggagacatggtagcagaaggtcaggaaatctgtgtgattgaagctatgaaaatgcagaacagtatgacagctgggaaaatgggcaaggtgaaattggtgcactgcaaagctggagacacagttggtgaaggagacctgcttgtggagctggaatgaagtatttctagcctttccgtcagcactgctcactgctttaactggcgtctccattattctctaaccctcaatttgcgcaagcatttacaggagcactcctgtgcaggaggttctacagcctcctgtttattcctcagaagaggcaaaaccgacattctgccaacaaatcaccaatggaaattcttgatataaatacttgtacatatgatttgtacttctgctgagatttcctagtgtcaaaattaaatcaataaaaccaagcatttgtctaaaaaaaaaaaaaaaaa

SEQ ID NO: 4837 - protein, 724 aa, Mus musculus
MAGQWVRTVALLAARRHWRRSSQQQLLGTLKHAPVYSYQCLVVSRSLSSVEYEPKEKTFDKILIANRGEIACRVIKTCKKMGIKTVAIHSDVDASSVHVKMADEAVCVGPAPTSKSYLNMDAIMEAIKKTRAQAVHPGYGFLSENKEFAKRLAAEDVTFIGPDTHAIQAMGDKIESKLLAKRAKVNTIPGFDGVVKDADEAVRIAREIGYPVMIKASAGGGGKGMRIAWDDEETRDGFRFSSQEAASSFGDDRLLIEKFIDNPRHIEIQVLGDKHGNALWLNERECSIQRRNQKVVEEAPSIFLDPETRQAMGEQAVALAKAVKYSSAGTVEFLVDSQKNFYFLEMNTRLQVEHPVTECITGLDLVQEMILVAKGYPLRHKQEDIPISGWAVECRVYAEDPYKSFGLPSIGRLSQYQEPIHLPGVRVDSGIQPGSDISIYYDPMISKLVTYGSDRAEALKRMEDALDNYVIRGVTHNIPLLREVIINTRFVKGDISTKFLSDVYPDGFKGHTLTLSERNQLLAIASSVFVASQLRAQRFQEHSRVPVIRPDVAKWELSVKLHDEDHTVVASNNGPAFTVEVDGSKLNVTSTWNLASPLLSVNVDGTQRTVQCLSREAGGNMSIQFLGTVYKVHILTKLAAELNKFMLEKVPKDTSSTLCSPMPGVVVAVSVKPGDMVAEGQEICVIEAMKMQNSMTAGKMGKVKLVHCKAGDTVGEGDLLVELE

SEQ ID NO: 4838 - DNA, 1323 bp, Bacillus cereus
  CDS (1)..(1323)
atggggaaaattgctgtacgaattattcgtgcttgtaaagaaatggatattgaaacagttgcaatttattcagaagcagataaagagtcacttcacgtacagattgcagacgaggcgtattgtgtaggaccaacgatttcgaaagaaagctatttaaatttgacaaacattattagcgttgcgaagttaacaggctgcgatgctattcatccgggatacggatttttagcagagaatgcagatttcgcagagttatgccgtgaatgtaacttgatttttatcggtccaagtccagaagctatttcaaagatgggcacaaaagacgttgctcgtgatacaatgaaagaagcaggggttccgattgagccaggttcacaagggattattaaaaataccgaagaagcgatcgagcttgctaatcaaattggatatccagttattattaaagcgactgcaggtggcggcggaaaaggtattcgtgttgcacgccatgaagaagagcttataaaaggaattcaaattacacagcaagaagctagtaccgcttttgggaaccctggtgtatacttagaaaagtacgttgaagatttccgccatgttgagattcaaataatggcagatacacacggaaatgccattcatttaggagagcgtgattgtacaattcagcgccgtttcaaaactatagaagaaagtccatcacctgcacttgatgaagatattcgcaagcagatgggtgaagcggcagttaaagcggcggtagcggttgattatacaggtgctggtacggttgagtttatttatgaatataaaacgaaaaccttttatttcatggagatgaatacgagaattcaggttgagcatccggttactgaaatggtaacgggaatggacttaattaaagagcaaattcttgttgcttcaggagaaaagttatcgttacagcaagaagaagtacaatttaatggttgggcaattgaatgtcgaattaatgcggaaaaccctgccaaaaaatttatgccatctccaggtaaagtagaaatgtatttaccaccaggaggatttggtattcgcgtcgattcagctgtatatccgggatattcaatcccacctttctatgattcgatggttgctaaattaattgttcacggaaaaacacgtgaagaggcaattgcaaaaatgaagcgcgcacttagtgaatttgtcattgaaggcgtacatacaacaatcccgttccatttgcaattgctagatcatcctgattttgtaaaaggtgagtttaatacgaaatttttggaagagcatgaacttgtgacgcagtga

SEQ ID NO: 4839 - protein, 440 aa, Bacillus cereus
MGKIAVRIIRACKEMDIETVAIYSEADKESLHVQIADEAYCVGPTISKESYLNLTNIISVAKLTGCDAIHPGYGFLAENADFAELCRECNLIFIGPSPEAISKMGTKDVARDTMKEAGVPIEPGSQGIIKNTEEAIELANQIGYPVIIKATAGGGGKGIRVARHEEELIKGIQITQQEASTAFGNPGVYLEKYVEDFRHVEIQIMADTHGNAIHLGERDCTIQRRFKTIEESPSPALDEDIRKQMGEAAVKAAVAVDYTGAGTVEFIYEYKTKTFYFMEMNTRIQVEHPVTEMVTGMDLIKEQILVASGEKLSLQQEEVQFNGWAIECRINAENPAKKFMPSPGKVEMYLPPGGFGIRVDSAVYPGYSIPPFYDSMVAKLIVHGKTREEAIAKMKRALSEFVIEGVHTTIPFHLQLLDHPDFVKGEFNTKFLEEHELVTQ

SEQ ID NO: 4840 - DNA, 3447 bp, Bacillus cereus
  CDS (1)..(3447)
atgacaaagctgcaacgtattcaaaaagtattggtagctaaccgtggagagattgcaattcgtgtgtttcgagcttgttcggaacttggattaaaaacagttgcaatctattctaaagaggatagtggttcttatcatcgctataaagccgatgagtcctatttagttggggaaggaaaaaaaccaattgatgcttatctagatattgaaggcattattgagattgcaaaaagtaatcatgtagatgcaatccaccctggatatggtttcttgtcagaaaatattcaattcgctaaacgttgtgaagaagaaggaattatctttatcggtccgaaaagtaagcatttagatatgtttggagataaagtgaaagcaagaacacaagcgcagctagcacaaattccagttatacctggtagtgatggtccagtaaattcattagaagaagtcgaaaaatttgctgaaaagtatgattacccgattattattaaagcatcccttgggggtggcggtcgtggtatgcgtattgtgcgtactagtgaggaattaggagaatcatataatcgagcgaaatcagaagcgaaagcagcctttggtaatgatgaagtttacgtcgaaaaattcgttgaaaaacctaaacatatagaagtacaaattttagcagatgaagaaggcaatgttgttcatttatacgagcgtgactgttctgtacaacgtcgtcatcaaaaagttgtagaaattgcaccgagtgtatcactttcagatgatctgcgtcagcgtatttgtgatgctgctgtgaagttaacgaaaaatgtaaattatttaaatgcaggaacagtagaattccttgtaaaagatgatgagttttactttattgaagtaaatccacgtgttcaagtagaacatacgattacagaaatgattacgggagtagatattgttcaatcacaaattttaatagctgatggacattcattacatagcaaaatggtaggtgttccgaagcaagaggaagtagttgtacatggatttgcaattcaatctcgtgtaacaactgaagatccgctaaataattttatgccggatacaggaaaaattatggcgtatcgatcaggcggtggttttggtgtacgtcttgatacaggaaatagcttccaaggtgcagttattacaccgtactacgattctttacttgtaaaagttacaacttgggcacttacttttgagcaagctgctgcaaaaatggaacgtaacttaaaagaattccgtattcgtggtattaaaacaaatattccattcctagagaatgtagtaaaacataaaaacttcttatcaggagaatatgatacttcatttatcgatgcgtcacctgaattgttcttgttcccgaaacgtaaagaccgtggaacgaaaatgttaaattacattggtacagtaacagtaaatggtttcccaggagtaggtaaaaaagaaaaaccaatattcccagatgctcgtattccatgtttaaaacattcagagccaatccaaaatggaacgaaacaaattttggacgagcgtggagcggacggattagtaaaatgggtacaggatcaaaaacgtgtacttttaacggatacaacattccgtgatgcacaccagtcattacttgcaactcgtattcgtacaaaagatttacatcaaattgcggagccaacagcgagaatgttaccgaacctattctcagcggaaatgtggggcggtgcaacgtttgatgttgcgtatcgtttcttaaaagaagatccatgggaacgattactagatcttcgtgaaaaaatgccgaacgttttattccaaatgttacttcgttcttcaaacgcagttggatacaaaaactatccagataatttaattcaaaaatttgtggaatgttctgctcaagcaggcattgatgtattccgtatttttgatagcttaaactgggtggaaggcatgagagttgcaattgacgctgtacgagacactggtaaaattgcagaagcaacaatgtgctacacaggggatatccatgatccactgcgtagtaaatatgatttaaattactataaaaatttagcaaaagagttagaagcatcaggagctcacattttaggtattaaagatatggcgggcttattaaaaccaaatgcagcatatgatttagtttctgcattaaaagagacagtgtcgattccgattcacctgcatacgcacgatacgagtggaaatggtatattaacgtatacgaaggcaattgaagcgggtgttgatatcgtcgatgtagcagtgagttctatggctggtcaaacgtcacaaccaagtgcgaacacgctatactatgcattaggtggaaacgaaagacaaccagatgttaatatagattctttagaaaaactatctcattattgggaagatgtacgcaaatactatgcaccgtttgaaagtggtatgaatgcgcctcatacagaggtatatatgcatgaaatgccgggtgggcagtatagtaatcttcagcaacaagcgaaggcggttggtttaggagatcgcttcgatgaagtgaaagtaatgtaccgccgtgtgaatgacatgtttggagatattgtaaaagtaacgccatcatcaaaagttgttggtgatatggcattatttatggttcaaaaccatctgacagaacaagatgttttagagcgtggacatgctatggacttcccaggatctgttgttgaaatgttctctggtgatttaggtcaaccgtacggtggtttcccgaaagaattacaaaagattattttaaaagggaaagagccattaacagtaagaccaggtgaattactagagccagtagatttcgaagcgttaaaagaagaattattccataaacttggacgcgaagtaacgatttttgatgtagttgcatatgctttatatccaaaagtatttatggattatgaaaaagttgctgagctttatggaaatgtatctgtacttgatacaccgacgttcttctatggtatgagactaggtgaagaaattgatgtagaaattgaacagggtaaaacattgatggttaaactagtatcaattggagaacctcagccggatggaaatcgtgtcctttacttggaatttaacggtcaaccacgtgaaattatcgtgaaagacgagagtgtaaaagcaacagttgcacaacgtgtgaaaggaaaccgtgagaatccaaatcatattagtgcaacgatgccaggaacggtaattaaagtagttgtaaaagaaggcgatgaagtgaaaaaaggcgattctatggcaattacagaagcgatgaaaatggaaacgacagttcaagcgccgttcaatggtaaagtgaagaaagtatatgttaacgatggtgatgcgattcaaacgggtgatttacttattgaattagatcactaa

SEQ ID NO: 4841 - protein, 1148 aa, Bacillus cereus
MTKLQRIQKVLVANRGEIAIRVFRACSELGLKTVAIYSKEDSGSYHRYKADESYLVGEGKKPIDAYLDIEGIIEIAKSNHVDAIHPGYGFLSENIQFAKRCEEEGIIFIGPKSKHLDMFGDKVKARTQAQLAQIPVIPGSDGPVNSLEEVEKFAEKYDYPIIIKASLGGGGRGMRIVRTSEELGESYNRAKSEAKAAFGNDEVYVEKFVEKPKHIEVQILADEEGNVVHLYERDCSVQRRHQKVVEIAPSVSLSDDLRQRICDAAVKLTKNVNYLNAGTVEFLVKDDEFYFIEVNPRVQVEHTITEMITGVDIVQSQILIADGHSLHSKMVGVPKQEEVVVHGFAIQSRVTTEDPLNNFMPDTGKIMAYRSGGGFGVRLDTGNSFQGAVITPYYDSLLVKVTTWALTFEQAAAKMERNLKEFRIRGIKTNIPFLENVVKHKNFLSGEYDTSFIDASPELFLFPKRKDRGTKMLNYIGTVTVNGFPGVGKKEKPIFPDARIPCLKHSEPIQNGTKQILDERGADGLVKWVQDQKRVLLTDTTFRDAHQSLLATRIRTKDLHQIAEPTARMLPNLFSAEMWGGATFDVAYRFLKEDPWERLLDLREKMPNVLFQMLLRSSNAVGYKNYPDNLIQKFVECSAQAGIDVFRIFDSLNWVEGMRVAIDAVRDTGKIAEATMCYTGDIHDPLRSKYDLNYYKNLAKELEASGAHILGIKDMAGLLKPNAAYDLVSALKETVSIPIHLHTHDTSGNGILTYTKAIEAGVDIVDVAVSSMAGQTSQPSANTLYYALGGNERQPDVNIDSLEKLSHYWEDVRKYYAPFESGMNAPHTEVYMHEMPGGQYSNLQQQAKAVGLGDRFDEVKVMYRRVNDMFGDIVKVTPSSKVVGDMALFMVQNHLTEQDVLERGHAMDFPGSVVEMFSGDLGQPYGGFPKELQKIILKGKEPLTVRPGELLEPVDFEALKEELFHKLGREVTIFDVVAYALYPKVFMDYEKVAELYGNVSVLDTPTFFYGMRLGEEIDVEIEQGKTLMVKLVSIGEPQPDGNRVLYLEFNGQPREIIVKDESVKATVAQRVKGNRENPNHISATMPGTVIKVVVKEGDEVKKGDSMAITEAMKMETTVQAPFNGKVKKVYVNDGDAIQTGDLLIELDH

SEQ ID NO: 4842 - DNA, 1353 bp, Bacillus anthracis
  CDS (1)..(1353)
atgataaaaaaagtattaatagccaatcgtggggaaattgctgtacgaattattcgtgcttgtaaagaaatggatattgaaacagtcgcaatttattcagaagcagataaagagtcacttcacgtacaaattgctgatgaggcgtattgtgtaggaccaacgatctcgaaagaaagctatttaaatttgacgaacattattagtgttgcgaagttaacaggctgcgatgctattcatccaggatatggatttttagctgagaatgcagattttgcagagttatgccgtgaatgtaacttaatttttatcggtccaagtccagaagctatttcaaagatgggcacaaaagacgttgctcgtgatacaatgaaagaagcaggggttccgattgtaccaggttcacaaggaattattaaaaataccgaagaagcgattgaacttgctaatcaaattggatatccagttattattaaagcgactgcaggtggcggcggaaaaggtattcgtgttgcgcgccatgaagaagagcttgtaaaaggaattcaaattacacagcaagaagctagtaccgcttttgggaaccctggtgtatacttagaaaagtacgttgaagatttccgccatgttgagattcaaataatggcagatacacacggaaatgccattcatttaggagagcgtgattgtacaattcaacgccgcttgcaaaaactactagaagaaagtccatcaccagcacttgatgaaaatgtgcgtaaacagatgggtgaggcggcagttaaagcggcggtagcggttgattatacaggtgctggtacggttgagtttatttatgaatataaaacgaaaagcttttatttcatggagatgaatacgagaattcaagttgagcatccagttactgaaatggtaacaggggtggacttaattaaagaacaaattcttgttgcttctggagaaaagttatcgttacagcaagaagaagtacaatttaatggttgggcaattgaatgccgaattaatgcggaaaaccctgccaaaaaatttatgccatctccaggtaaagtagaaatgtacttgccaccaggcggatttggtattcgcgtcgattcagctgtatatccgggatattcaatcccacctttctatgattcgatggttgctaaattaattgttcacggaaaaacacgtgaagaggcaattgcaaaaatgaagcgtgcactcagtgagtttgtcgttgaaggcgtacatacaacaatcccgttccatttgcaattgttagatcatcctgattttgtaaaaggtgagtttaatacgaaatttttggaagagcatgaacttgtgacgcagtga

SEQ ID NO: 4843 - protein, 450 aa, Bacillus anthracis
MIKKVLIANRGEIAVRIIRACKEMDIETVAIYSEADKESLHVQIADEAYCVGPTISKESYLNLTNIISVAKLTGCDAIHPGYGFLAENADFAELCRECNLIFIGPSPEAISKMGTKDVARDTMKEAGVPIVPGSQGIIKNTEEAIELANQIGYPVIIKATAGGGGKGIRVARHEEELVKGIQITQQEASTAFGNPGVYLEKYVEDFRHVEIQIMADTHGNAIHLGERDCTIQRRLQKLLEESPSPALDENVRKQMGEAAVKAAVAVDYTGAGTVEFIYEYKTKSFYFMEMNTRIQVEHPVTEMVTGVDLIKEQILVASGEKLSLQQEEVQFNGWAIECRINAENPAKKFMPSPGKVEMYLPPGGFGIRVDSAVYPGYSIPPFYDSMVAKLIVHGKTREEAIAKMKRALSEFVVEGVHTTIPFHLQLLDHPDFVKGEFNTKFLEEHELVTQ

SEQ ID NO: 4844 - DNA, 3447 bp, Bacillus anthracis
  CDS (1)..(3447)
atgacaaagctgcaacgtattcaaaaagtattggtagctaaccgtggagagattgcaattcgtgtgtttcgagcttgttcggaactgggattaaaaacagttgcaatctattccaaagaggatagtggttcttatcatcgttataaagccgatgagtcctatttagttggggaaggaaaaaagccaattgatgcttatctagatattgagggcattattgagattgcgaaaagtaatcatgtagatgcaatccaccctggatatggtttcttgtcagaaaatattcaattcgcaaaacgttgtgaagaagaaggaattatctttattggtccaaaaagtaagcatttagatatgtttggagataaagtgaaagcaagaacacaagcgcagctagcacaaattccagttattcctggtagtgatggaccggtagattcgttagaagaagttaaagaatttgctgaaaagtatgattacccgattataatcaaagcttcccttggcggtggcggtcgtggtatgcgtattgtacgtactagtgaagaattaagagaatcgtataatcgagcgaagtcagaagcaaaggcagcctttggtaatgatgaagtatacgttgaaaaattcgttgaaaaacctaaacatatagaagttcaaattttagcagatgaagagggcaatgttgttcatttatacgagcgagactgttctgtacaacgtcgtcaccaaaaagtagtagaaattgcacctagtgtgtcgctttcagatgatttgcgtcagcgtatttgtgaagctgctgtaaagttaacgaaaaatgtaaattatttaaacgcaggaacagttgaattccttgttaaagatgataatttctatttcattgaagtaaatccacgtgttcaagtagaacatacaattacagaaatgattacaggagttgacatcgttcaatcgcaaattttaatagctgatggacatgcattacatagtaaaatggtaggtgttccaaagcaagaggaagtggttgtgcacggttttgcaatccaatctcgtgtaacgactgaggacccactaaataatttcatgccggatacagggaaaattatggcataccgatcaggtggtggctttggggttcgtcttgatacaggtaatagtttccaaggtgcagtaattgcaccgtactatgattctttacttgtaaaagttacaacatgggcgcttacttttgaacaggctgctgcaaaaatggaacgtaacttaaaagaattccgtattcgtggtattaaaactaatattccatttctagagaatgtagtaaaacataaaaacttcttatcaggggaatatgacacttcatttattgatgcgtcacctgaactattcttgttcccgaaacgtaaagaccgcggaacgaaaatgttaaattacatcgggacagtaacagtaaatggtttcccaggagtagggaaaaaagagaaaccaattttcccggatgctcgtataccgaatgtattacactcagagccgatccaaaatggaacgaaacaaattttggatgagcgtggagcagacggattagtaaaatgggtacaagatcaaaaacgtgtccttttaacggatacaacgttccgtgatgcgcatcagtcattacttgcaacgcgtattcgtacaaaagatttacatcaaattgcagagccgacagcgagaatgctaccaaacttattctcagcggaaatgtggggcggtgcaacttttgatgttgcatatcgtttcttaaaagaagatccatgggaacgattactagatcttcgtgaaaaaatgccaaatgttttattccaaatgttacttcgttcttcaaacgcagttggctacaaaaactatccggataatttaattcaaaagtttgtggagtgttctgctcaagctggaattgatgtgttccgtatttttgatagcttaaactgggtggaaggtatgagagttgcgattgatgctgtacgagatactggtaaaattgcagaagcaacgatgtgctacacaggggatattcacgatccaatgcgtagtaaatacgatttgaattactataaaaacttagcaaaagaattagaagtatcaggagctcacattttaggtattaaagatatggcgggcttactaaaaccaaacgcagcatatgatttagtttcagcattaaaagagacggtatcgattccgattcacctgcacacacacgacacgagtggaaatggtattttaacgtatacgaaagcaattgaagcaggtgttgacattgtcgatgtagcagtaagttctatggctggtcaaacgtcacaaccaagtgcgaacacgctatactatgcgttaggcggaaacgaaagacagccagatgttaatatagattcattagaaaaactatctcattactgggaagatgtacgtaaatactacgcaccgtttgaaagtggtatgaacgctcctcatacagaggtatatatgcacgaaatgccaggcggacagtacagtaatttacaacaacaagcgaaagtggttggcttaggcgatcgcttcgatgaagtgaaagtaatgtatcgccgtgtgaatgatatgtttggtgatattgttaaagtaacgccatcatctaaagttgtcggtgatatggcattattcatggttcaaaatcacttaacagaacaagatgttttagagcgtggacattctatggacttcccaggatctgttgttgaaatgttctctggagacttaggacaaccatatggtggtttcccgaaaaagttacaagaaattattttaaaagggaaagaaccattaacagtaagaccgggtgaattattagagccagtagatttcgacgcgttaaaagaagagctattccataagcttggacgcgaagtgacgatgtttgatgtagttgcatatgcattatatccaaaagtatttatggattacgaaaaagttgctgagctttatggaaatgtatctgtgcttgatacaccgacattcttctatggtatgagacttggtgaagaaatcgatgtggaaattgaacaaggtaaaacattgatggttaaactagtatcaatcggagagcttcagccagatggaaatcgtgttctttatctggaatttaacggtcaaccacgtgagattgttgtgaaagacgaaagtgtgaaagcaacagttgcacaacgcgtgaaaggaaaccgtgaaaatccaaaccacattagcgcaacaatgccaggaacggttattaaagtagttgtaaaagaaggcgatgaagtgaaaaaaggcgattctatggcaattacagaagcgatgaaaatggaaacgacagttcaagcgccgttcaatggtaaagtgaaaaaagtatatgttaatgatggagatgcaattcaaacgggtgacttactcattgaattagatcactaa

SEQ ID NO: 4845 - protein, 1148 aa, Bacillus anthracis
MTKLQRIQKVLVANRGEIAIRVFRACSELGLKTVAIYSKEDSGSYHRYKADESYLVGEGKKPIDAYLDIEGIIEIAKSNHVDAIHPGYGFLSENIQFAKRCEEEGIIFIGPKSKHLDMFGDKVKARTQAQLAQIPVIPGSDGPVDSLEEVKEFAEKYDYPIIIKASLGGGGRGMRIVRTSEELRESYNRAKSEAKAAFGNDEVYVEKFVEKPKHIEVQILADEEGNVVHLYERDCSVQRRHQKVVEIAPSVSLSDDLRQRICEAAVKLTKNVNYLNAGTVEFLVKDDNFYFIEVNPRVQVEHTITEMITGVDIVQSQILIADGHALHSKMVGVPKQEEVVVHGFAIQSRVTTEDPLNNFMPDTGKIMAYRSGGGFGVRLDTGNSFQGAVIAPYYDSLLVKVTTWALTFEQAAAKMERNLKEFRIRGIKTNIPFLENVVKHKNFLSGEYDTSFIDASPELFLFPKRKDRGTKMLNYIGTVTVNGFPGVGKKEKPIFPDARIPNVLHSEPIQNGTKQILDERGADGLVKWVQDQKRVLLTDTTFRDAHQSLLATRIRTKDLHQIAEPTARMLPNLFSAEMWGGATFDVAYRFLKEDPWERLLDLREKMPNVLFQMLLRSSNAVGYKNYPDNLIQKFVECSAQAGIDVFRIFDSLNWVEGMRVAIDAVRDTGKIAEATMCYTGDIHDPMRSKYDLNYYKNLAKELEVSGAHILGIKDMAGLLKPNAAYDLVSALKETVSIPIHLHTHDTSGNGILTYTKAIEAGVDIVDVAVSSMAGQTSQPSANTLYYALGGNERQPDVNIDSLEKLSHYWEDVRKYYAPFESGMNAPHTEVYMHEMPGGQYSNLQQQAKVVGLGDRFDEVKVMYRRVNDMFGDIVKVTPSSKVVGDMALFMVQNHLTEQDVLERGHSMDFPGSVVEMFSGDLGQPYGGFPKKLQEIILKGKEPLTVRPGELLEPVDFDALKEELFHKLGREVTMFDVVAYALYPKVFMDYEKVAELYGNVSVLDTPTFFYGMRLGEEIDVEIEQGKTLMVKLVSIGELQPDGNRVLYLEFNGQPREIVVKDESVKATVAQRVKGNRENPNHISATMPGTVIKVVVKEGDEVKKGDSMAITEAMKMETTVQAPFNGKVKKVYVNDGDAIQTGDLLIELDH

SEQ ID NO: 4846 - DNA, 3636 bp, Nitrosomonas europaea
  CDS (1)..(3636)
atgtttacaaaagttctgatcgccaatcggggcgccattgcctgccgtgttatccgtactttgcatcggatgggcatcgggagtgtggctgtttttacgaaagctgacgcgctatcacggcatgtgctggatgctgatgacagtatttgtatcggcgatggacttgccagcgaaagttatttgcgtgccgataaaatactggaagttgcacaccgcaccggtgctcaggcaatccacccggggtacggattcctcagtgaaaatgcttcatttgccgagcaatgtgccgcagaagggatttgttttctgggccccactcctgaacagatacgcactttcggtctgaaacatactgcccgtgcgctcgcacagcaactcgacgcgccgatgctgccgggtaccggattattggaacacctcgaaaccgcctgcgaggaagcacaccggatcggttacccagtcatgctcaaaagtacggcaggagggggggggatcggtatgcgcttgtgccgcaaccggcaagagctgattgatgcctatgagtctgtcaaaaacctggcacaaagtaatttcagtaatgccggcttgttcctggaaaaatacatcgaccaggctcgccatatcgaagtacagattttcggcgacggccgtggaaaagtgattgcattagaagaacgtgattgttccatgcagcggcgcaaccagaaagtgatcgaggaaacaccagcaccgggtctgtcgccagcaacccgtaacgcgttacaggaaacagccatacgcctgggagaatcagttcaataccgatctgccggcacagtggaatatgtctacgacccctcggtcgatcggttttattttctggaagtcaatacccgcctgcaggtggaacatggcgtcaccgagatggtgaccggcattgatctggtcgaatggatggtgctgctgggtgccgatgctttaccgccactggaatcatttaccattcaactgcagggagcttccatacaggctcgtgtgtatgcggaaaatccagccaagaattttcagccggccagtggtttgctgagcgctgtcgaatttccggaaactgcacggattgaaacctgggtggacgcgggttgtgaagtatcggccttctatgacccaatgctcgctaagatcatcgttcacgccagcaatcgtgatcaggccatcgaccgtttgatcgccgcattagacaaaaccacgctctacggcattgaaaccaatctggattatctcaggcaggtattatccggaacggtattccgcagcgggcaggtcagcacccaattcctttccgggtttcactaccaaccgcataccctggatgtactcaacgccggtgtacagacgacagtgcaagattacccgggcagaacaggctattggaacgtaggagtacctccatccggtccgatggacagtctggcttttcgtctggccaatcatctggttggaaaccccgatgactcggcgggattggaaatcacgctggccgggccaacgttgagattcaactgcaacagtctgattgcagtatgtggagcacccattgatgtctggctggatggtgcccccctggaacagtggcgatctcacttcatcaaagcaggttcgctgttacgattcggtaaaatccgtcagtttggcagccgatcctgcctggccatcaagggtgggattcaggtaccggattatttgggcagccgctccacttttacactggggcagttcggcgggcatgccggacgggcgctgtgcaccggggatgtgctgcatatcctgccagcagaagatactgagccaagcatattgccctccgaaaacattccccactacaccagccggtgggaaatcggagtcctgtatggtccgcatggtgcaccggatttctttaccggggctgacatcgatgaattctttaccaccgactggaaggtgcatcacaattccagccgtaccggtatacgcctgatcggccccaaaccacaatgggcacgcaaagacggaggtgaagccggcctgcacccctccaacatccatgacaatccctatgcggtcggtgcgatcgattttaccggtgatatgcccatcatccttggcccggatggccccagcctgggaggatttgtctgtcctgctgtgatcgtacaggcggaattatggaaaaccggtcagctcaaacctggtgatagcgtgcgttttcacccgctcacagcggaacaggcgctgaagctggaaaagcaacaggacaagatgatccagcagctggattccttcactcgcgtaccacccgatattcctgcttccctggttgagccgagtgatcctgtactgcatcggattccggcaaataacgggcaggtacaagtggtttaccgacaatccggggataaatatctgctgatcgagtatggcgaagcggtactcgatatcgcactgcattttcgcgcacatgccctgatggcctggctgcagcactgtgttgaaaaaggcgatctgcccggaattctcgacatgacaccgggcattcgctctttgcagatacatttcgattcgcggcttctggatcgtgaccatctcctgaataaactcattaccgccgagaaggatttaccggcaagcgacgatatggaaatgccttcgcgtatcgtgcatttacccctttcctgggatgacgctgccacaaaacttgccatcgaaaaatatatgcagtcagtccggccggatgcaccctggtgcccgagcaacatcgaattcatccggcgtatcaacggactggacagtatcgatgaggtcaaacgtatcattttcgatgccagctatctggtcatggggctgggagatgtctacctgggcgccccggtggccacgccgatcgatccgcgccatcggctggtcaccaccaaatacaacccggcacgcacctggacacccgaaaatgcagtcggaataggaggagcctatctctgtatttatggtatggaaggtcccggaggatatcagtttgtcggaagaacagtgcagatgtggaatcgttaccgtcagactcgggactttaccgccggtaaaccctggctgctgcgcttttttgatcagatcaggttttaccctgtttctgaacaggagctgcttgagttacgccacgactttatcaccgggcgttttacacttcataccgaagataccgttttcagtctgcgcaactatcatgcattcctgcatcagcatgcagacagtattcaagcattcaaaacccgtcagcaaaaggcttttgaggctgaacgcgagcgctggaagatcgggaacgtacaggaagaaaacagtatcagcgatgagggtgaaggcgtgcttgataaacccggtatgcaaaatgcacctgatttacccgacggagcatacgccatcagttcagatgtgaccggtactgtatggaaactgctgatcgaaaccagacaactggtcaatgccggagatccggtcatcatcatcgaatccatgaaaatggaaatcaccctgagtgcaccggtcagcgggatcgtgaagcagatcagctgcagacagggtgattatgtattttccggccagatgctgctgatcgttcaggaagaataa

SEQ ID NO: 4847 - protein, 1211 aa, Nitrosomonas europaea
MFTKVLIANRGAIACRVIRTLHRMGIGSVAVFTKADALSRHVLDADDSICIGDGLASESYLRADKILEVAHRTGAQAIHPGYGFLSENASFAEQCAAEGICFLGPTPEQIRTFGLKHTARALAQQLDAPMLPGTGLLEHLETACEEAHRIGYPVMLKSTAGGGGIGMRLCRNRQELIDAYESVKNLAQSNFSNAGLFLEKYIDQARHIEVQIFGDGRGKVIALEERDCSMQRRNQKVIEETPAPGLSPATRNALQETAIRLGESVQYRSAGTVEYVYDPSVDRFYFLEVNTRLQVEHGVTEMVTGIDLVEWMVLLGADALPPLESFTIQLQGASIQARVYAENPAKNFQPASGLLSAVEFPETARIETWVDAGCEVSAFYDPMLAKIIVHASNRDQAIDRLIAALDKTTLYGIETNLDYLRQVLSGTVFRSGQVSTQFLSGFHYQPHTLDVLNAGVQTTVQDYPGRTGYWNVGVPPSGPMDSLAFRLANHLVGNPDDSAGLEITLAGPTLRFNCNSLIAVCGAPIDVWLDGAPLEQWRSHFIKAGSLLRFGKIRQFGSRSCLAIKGGIQVPDYLGSRSTFTLGQFGGHAGRALCTGDVLHILPAEDTEPSILPSENIPHYTSRWEIGVLYGPHGAPDFFTGADIDEFFTTDWKVHHNSSRTGIRLIGPKPQWARKDGGEAGLHPSNIHDNPYAVGAIDFTGDMPIILGPDGPSLGGFVCPAVIVQAELWKTGQLKPGDSVRFHPLTAEQALKLEKQQDKMIQQLDSFTRVPPDIPASLVEPSDPVLHRIPANNGQVQVVYRQSGDKYLLIEYGEAVLDIALHFRAHALMAWLQHCVEKGDLPGILDMTPGIRSLQIHFDSRLLDRDHLLNKLITAEKDLPASDDMEMPSRIVHLPLSWDDAATKLAIEKYMQSVRPDAPWCPSNIEFIRRINGLDSIDEVKRIIFDASYLVMGLGDVYLGAPVATPIDPRHRLVTTKYNPARTWTPENAVGIGGAYLCIYGMEGPGGYQFVGRTVQMWNRYRQTRDFTAGKPWLLRFFDQIRFYPVSEQELLELRHDFITGRFTLHTEDTVFSLRNYHAFLHQHADSIQAFKTRQQKAFEAERERWKIGNVQEENSISDEGEGVLDKPGMQNAPDLPDGAYAISSDVTGTVWKLLIETRQLVNAGDPVIIIESMKMEITLSAPVSGIVKQISCRQGDYVFSGQMLLIVQEE

SEQ ID NO: 4848 - DNA, 1356 bp, Chlamydophila caviae
  CDS (1)..(1356)
atgaaaaaagtcttaatagctaatcgtggggaaattgcggtacgtattatacgtgcgtgtcatgatcttggcttatccacagtcgcagtatattccctagcagatcaagaagctttgcacgtgctattagcagacgaagctgtttgtataggagaacctcaagctgggaaatcctatttaaaaatatctaatattttagctgcttgtgagattacaggtgcagatgctgttcatcccggttatggttttttaagtgagaatccgaattttgcttctatttgtgaaagttgtggattgactttcattggccctagctcagagtctatagcgacaatgggagataaaatagcggcaaaacagctggctaaaaagattaaatgtcctgtgattccaggttctgagggcattatcaaagacgaagctgagggattaaaaatcgctgaaaaaataggcttccctatagtgattaaggctgttgctggtggtggtggccggggtatccgcatcgttagagagaaagatgaatttttccgtgctttctcagcggcgaaagcagaagcagaagcaggatttaataatcctgatgtttatattgaaaagttcattgaaaacccaaggcacttagaagtccaggtccttggagataagcatggcaattatgtccatcttggagaaagagactgtacggtacaaagacgtcggcaaaaactgattgaagagactcctagtcctatactcactccagaattacgtaccaaggtagggaaggttgctgtagatctagcgagaagtgccaactaccactctgtagggactgtagagttcttgttagataaagataagaagttctacttcatggaaatgaacacgcgtattcaggtagagcatacgattacggaagaagttacagggattgatcttcttaaagagcagatttatgtagcgatggggaaaaagcttgcttggaaacagaaaaacattgttttcacggggcatgttatccagtgtcgtattaatgctgaggatccgagcaataactttgccccatctccgggtcgtttagattactatcttcctcctgcggggccttcaatacgtgtggatggagcttgctatagcggctacgctattcctccttactatgattctatgattgctaaggtgatttctaagggaaagaaccgtgaagaggctatagccattatgaagcgtgctttaaaagagtttcatattggaggggtgcattctactatacctttccatcaattcatgttggacaatccacaattcatcaattcagactatgatatcaactacgttgatcatcttctctctcaggggaataccctattttaa

SEQ ID NO: 4849 - protein, 451 aa, Chlamydophila caviae
MKKVLIANRGEIAVRIIRACHDLGLSTVAVYSLADQEALHVLLADEAVCIGEPQAGKSYLKISNILAACEITGADAVHPGYGFLSENPNFASICESCGLTFIGPSSESIATMGDKIAAKQLAKKIKCPVIPGSEGIIKDEAEGLKIAEKIGFPIVIKAVAGGGGRGIRIVREKDEFFRAFSAAKAEAEAGFNNPDVYIEKFIENPRHLEVQVLGDKHGNYVHLGERDCTVQRRRQKLIEETPSPILTPELRTKVGKVAVDLARSANYHSVGTVEFLLDKDKKFYFMEMNTRIQVEHTITEEVTGIDLLKEQIYVAMGKKLAWKQKNIVFTGHVIQCRINAEDPSNNFAPSPGRLDYYLPPAGPSIRVDGACYSGYAIPPYYDSMIAKVISKGKNREEAIAIMKRALKEFHIGGVHSTIPFHQFMLDNPQFINSDYDINYVDHLLSQGNTLF

SEQ ID NO: 4850 - DNA, 3516 bp, Streptomyces avermitilis
  CDS (1)..(3516)
atgaccttcgacaccctgctcgtcgccaaccggggcgagatagccgtccgcgtcatccgcacggcgcgtgaactcggcctgcgcaccgtcgcggtgtactccgacccggaccgctcggcgccccatgtccggctcgccgacgaggccgtacgcctgggccccgcgcccgcgaaggagtcgtacctcgacgcggatctcgtactgaaggccgccaaggacaccggcgccggcgcgatccaccccggctacggcttcctctccgaggacgcggcgttcgcgcgccgctgcgaggacgccgggatcgtgttcgtcggaccgacgcccgagcagctggaactcttcggcgcgaagcacacggcgcgggccgcggccgaggcggccggggtgccgctcgcacccggcacggggctgctcgcctcgctcgacgaagcgctcgacgcggcctcccgcatcggctatcccgtcatgctcaaggccaccggcggcgggggcggcatcggcatgtcggcctgccgttccgccgccgaactggccgagtcgtgggagcgggtgcggcgcgtcaccgcggcctcgttctcctcggcggggatcttcctggaacgcctggtcgagcacgcccgccatgtcgaggtacaggtcttcggcgacggccggggccgggtcgtcaccctcggcgaccgggactgctcgctccaacgccgcaaccagaaggtggtcgaggaggcccccgcgccgggactcccctcacacgtgcgcgaccacctcgcctcggcggcacgggacttgtgcgccgcggtcggctaccgctccgccggaaccgtcgagttcgtgtacgacgccgcccgcgaggaggcgtacttcctcgaggtcaacacccgtctccaggtggagcatccggtcaccgaggagatctacggggtcgacctggtcgcctggatgctgcggctcgcgggcggcgacgccgacgtcgtacgcgatccggggccgccccgcggccacgccgtggaggcccgggtgtacgcggaggacccctcccgcgagcaccggcccagcgcgggcctgctgacgcgggtggagttcccgcagggcgtacgggtggacggctgggtggagacggggacggaggtcacgacgtcgtacgaccccatgctcgccaaggtcgtggcgtacgggtccgaccgggcgcacgcgctggcccgcctcgacgaggcgctggcccggacgcgggtcgacggcatcgagacgaatctggggctcgtccgggcggcgctcgccgaccacggcttgcgcaccgccacccacacgacggcgacactggccaagatcaccgaccccactccgcgcgtcgaggtggtcgcggccggcacgctcaccaccgtccaggactggccgggccgcaccggctactggcaggtgggcgtgccgccgtgcggcccgatggacgaccgctccttccggctcggcaaccgggcgctcgggaacgaggagggagcgccgggtctggagtgcaccctgcggggaccggcgctgcgcttcacccacgccacgacggtgtgcgtcacgggcgccccggcaccggtcaccgtggacggaacgccggtcgcccagtgggagccggtgacggtgcccgccggggccctcctggaggtcggcgcccccgccgagcccggcctgcggacctatgtgctgttcgcgggcggcctggacgtccccgcgttcctcggcagcgcggccaccttcacactgggccggttcggcgggcacggcgggcgggcgctgcgcacgggggacgtgctgcacggcgggtcggtcacggaccggggcgctcccgtgcccgccggggaccggccggtgttcgctacggagtggcacgtcggcgccctggaaggaccgcacgccgcaccggagttcttcaccgaggacgacatccgcgacttctacgcggccggctggaaggtccacttcaactcggcccggacgggcgtacgactggtcggacccaagccccgctgggcgcgctcggacggcggagaggcggggctgcacccgtccaacatccacgacaccccgtactcggtcggtgccgtcgactacacgggcgacatgccggtactgctcggcccggacgggccctcgctcggcggtttcgtctgcccggcgacggtcgccacggcggagcgctggaagctcgggcagctgcgccccggcgacacggtccgcttcacaccgctggccgaggacggctcgacgcggcccgcgatcgtggacggcggggtgctcgcacgggacggcgacgtgacctaccggcgcagcggcgacgacaacctgctggtcgaattcggcccgatgcagctcgacctggccctgcgcatgcgggtgcacgcgctgatggaagcggtggccgaagccgggctggacggcgtcacggacctcaccccgggcattcgctcgctccagatccggacggacccgcgccgcctgccgctacgcgaactcctcgcggtcgtacgggagacggtgagcgcgctcccgcccaccgaccagctcgtcgtcccgtcccgcacggtccacctccccctctcctgggacgacccggccacccgcgaggcgatcgagcgctacatggcgggcgtgcgcgacgacgcgccctggtgcccgtggaacatcgagttcatccgccgcgtcaacggcctggagtcggtggcggacgtgtacgacacggtcttcgacgcggagtacctcgtactcggcctgggcgacgtgtacttgggagcgccggtggccacaccgctcgacccgcgccaccgcctggtcaccaccaagtacaacccggcgcgcacctggaccgccgagaactcggtcggcatcggcggcgcgtacctgtgcgtctacgggatggagggccccggcggctaccagttcgtgggccgcacgacccaggtctggtcgggctggcagcagcgcggcgcgttcgaaccgggctcgccgtggctgctgcgcttcttcgaccggatcaagtggtacgccgtcgggcccgacgaactcctcgacctgcgcgccgacatcgcctcgggccgcttcgtgccgcgcgtcgaggagggcgagttctcgctggccgggtacgagtccttcctcgccgcgaacgccggctccatcgccgccttccgggcccgccagggcgcggccttcgcggcggagcgggacgcgtgggaggcggcgggcgagttcgcgcgggccgaggcggcgacggcgcccgaggccccgccggccgaggtgaccgttccggtgggcggcgctctggtggaggccgagttcgccgcgtcggtctggcagctgaacgtgggaccgggcgacgcggtgacggccggccagccgctgctcaccctggaggcgatgaagatggagtccagggtgcccgcgccgatggccggtgtggtgacggagatcctggccaggccgggcgatcaggtggcggcgggcacggcgctggtcgtgctcgcaccggccacgagctga

SEQ ID NO: 4851 - protein, 1171 aa, Streptomyces avermitilis
MTFDTLLVANRGEIAVRVIRTARELGLRTVAVYSDPDRSAPHVRLADEAVRLGPAPAKESYLDADLVLKAAKDTGAGAIHPGYGFLSEDAAFARRCEDAGIVFVGPTPEQLELFGAKHTARAAAEAAGVPLAPGTGLLASLDEALDAASRIGYPVMLKATGGGGGIGMSACRSAAELAESWERVRRVTAASFSSAGIFLERLVEHARHVEVQVFGDGRGRVVTLGDRDCSLQRRNQKVVEEAPAPGLPSHVRDHLASAARDLCAAVGYRSAGTVEFVYDAAREEAYFLEVNTRLQVEHPVTEEIYGVDLVAWMLRLAGGDADVVRDPGPPRGHAVEARVYAEDPSREHRPSAGLLTRVEFPQGVRVDGWVETGTEVTTSYDPMLAKVVAYGSDRAHALARLDEALARTRVDGIETNLGLVRAALADHGLRTATHTTATLAKITDPTPRVEVVAAGTLTTVQDWPGRTGYWQVGVPPCGPMDDRSFRLGNRALGNEEGAPGLECTLRGPALRFTHATTVCVTGAPAPVTVDGTPVAQWEPVTVPAGALLEVGAPAEPGLRTYVLFAGGLDVPAFLGSAATFTLGRFGGHGGRALRTGDVLHGGSVTDRGAPVPAGDRPVFATEWHVGALEGPHAAPEFFTEDDIRDFYAAGWKVHFNSARTGVRLVGPKPRWARSDGGEAGLHPSNIHDTPYSVGAVDYTGDMPVLLGPDGPSLGGFVCPATVATAERWKLGQLRPGDTVRFTPLAEDGSTRPAIVDGGVLARDGDVTYRRSGDDNLLVEFGPMQLDLALRMRVHALMEAVAEAGLDGVTDLTPGIRSLQIRTDPRRLPLRELLAVVRETVSALPPTDQLVVPSRTVHLPLSWDDPATREAIERYMAGVRDDAPWCPWNIEFIRRVNGLESVADVYDTVFDAEYLVLGLGDVYLGAPVATPLDPRHRLVTTKYNPARTWTAENSVGIGGAYLCVYGMEGPGGYQFVGRTTQVWSGWQQRGAFEPGSPWLLRFFDRIKWYAVGPDELLDLRADIASGRFVPRVEEGEFSLAGYESFLAANAGSIAAFRARQGAAFAAERDAWEAAGEFARAEAATAPEAPPAEVTVPVGGALVEAEFAASVWQLNVGPGDAVTAGQPLLTLEAMKMESRVPAPMAGVVTEILARPGDQVAAGTALVVLAPATS

SEQ ID NO: 4852 - DNA, 2103 bp, Streptomyces avermitilis
  CDS (1)..(2103)
atgttcgacaccgttcttgtggccaaccggggtgagatcgccgtccgcgtcatccgtaccctgcgcgcgctgggcgtgcgctcggtggccgtcttctccgacgccgacgcggacgcacggcacgtccgcgaggccgacacggccgtacggatcggtccgccgccggccgccgagagctatctgtccgtggagcggctgctggaggcggccgcccggaccggcgcgcaggcggtgcacccggggtacggcttcctcgcggagaacgccggcttcgcgcgtgcgtgcgccgacgcggggctcgtgttcatcgggccgcccgcggacgcgatctccttgatgggcgacaagatccgcgccaaggagacggtgcaggcggtcggcgtcccggtggtccccggctcctcgggcagcggcctgacggacgcccagctggtcgacgcggcacgggagatcggcatgcccgtactcctgaagcccagcgcgggcggcggcggcaagggcatgcggctggtgcgcgacgagaggctgctcgccgacgagatcgccgccgcccgccgcgaggcccgcgcctccttcggcgacgacacgctcctcgtggagcgttgggtggaccgcccccggcacatcgagatccaggtcctggcggacggccacggcaacgtggtgcacctgggcgagcgcgagtgctcgctccagcgccgccaccagaaggtcatcgaggaggcgcccagcgtgctcctcgacgaggcgacccgcgccgcgatgggcgaggcggcggtccaggcggcccgctcctgcggctacgagggcgcgggcaccgtcgagttcatcgtccccggcggggacccctcctcgtactacttcatggagatgaacacccgccttcaggtcgagcacccggtcaccgagctggtcaccggcctcgacctggtggagtggcagctccgggtggccgcgggcgagcgccttccgtacgggcagcgggacatcgaactcaccgggcacgcggtcgaggcccgcatctgcgccgaggaccccgcgcgcggcttccttccctccggggggacggtgctcgcgctgcacgagccacagagcgacgtggtgcgcaccgactcgggcctctccgagggcaccgaggtcggcagcctgtacgacccgatgctctccaaggtcatcgcgtacggccccgaccgcccgaccgcgctgcgcaggctccgggcggcgctcgcggagacggtcacactcggcgtgcagaccaacgccgggttcctgcggcggctgctggcccacccggcggtcgtggcgggggacttggacacgggcctggtggagcgggaggtggacgggctcgtcgcgcaggcggtcccgccggaggtgtacgcggcggcggcgctgctgcgccacgccgccctcggcccccaggcttcagggacctcggattcctccgggtccttcgggacatccgggtcccccgggacctcaggggcctccggctcgtccggggcctccgcctgggtcgatccgttctccgtgcccgacggctggcgtctgggcggcgagcgtgcctggacggctcaccacatgcggccggcggggcaggatcccgtgaccgtccgcgtgcgcgccacggcggacggcggcgtcgagctgctactcgacgacggactgccgcccctgcggggcacgctccccgtagcggtggccgcccgcgggggcgccgcgtcccggttcgccttccggctcgacggcgtcacccacaccttcgccgccctgccggacggcacctggctgggccgcgacggcgactcctggcacctgcgcgaccacgacccggtcgcggcgtccctcaccggcgccgcccactccggcgtcgactccctcaccgcccccatgcccggcacggtgaccgtcgtgaaggtcgccgtcggggacgaagtggccgccgggcagagcctgctggtggtcgaggcgatgaagatggagcacgtcatctccgccccgcacgccggcaccgtcagcgagctggacgtcacaccgggcacgaccgtcgccatggatcaggtgctggcggtcatcacccccgcagaggaggagacggcatga

SEQ ID NO: 4853 - protein, 700 aa, Streptomyces avermitilis
MFDTVLVANRGEIAVRVIRTLRALGVRSVAVFSDADADARHVREADTAVRIGPPPAAESYLSVERLLEAAARTGAQAVHPGYGFLAENAGFARACADAGLVFIGPPADAISLMGDKIRAKETVQAVGVPVVPGSSGSGLTDAQLVDAAREIGMPVLLKPSAGGGGKGMRLVRDERLLADEIAAARREARASFGDDTLLVERWVDRPRHIEIQVLADGHGNVVHLGERECSLQRRHQKVIEEAPSVLLDEATRAAMGEAAVQAARSCGYEGAGTVEFIVPGGDPSSYYFMEMNTRLQVEHPVTELVTGLDLVEWQLRVAAGERLPYGQRDIELTGHAVEARICAEDPARGFLPSGGTVLALHEPQSDVVRTDSGLSEGTEVGSLYDPMLSKVIAYGPDRPTALRRLRAALAETVTLGVQTNAGFLRRLLAHPAVVAGDLDTGLVEREVDGLVAQAVPPEVYAAAALLRHAALGPQASGTSDSSGSFGTSGSPGTSGASGSSGASAWVDPFSVPDGWRLGGERAWTAHHMRPAGQDPVTVRVRATADGGVELLLDDGLPPLRGTLPVAVAARGGAASRFAFRLDGVTHTFAALPDGTWLGRDGDSWHLRDHDPVAASLTGAAHSGVDSLTAPMPGTVTVVKVAVGDEVAAGQSLLVVEAMKMEHVISAPHAGTVSELDVTPGTTVAMDQVLAVITPAEEETA

SEQ ID NO: 4854 - DNA, 1851 bp, Streptomyces avermitilis
  CDS (1)..(1851)
atgattgcatctgtcctcgtcgccaaccgcggcgagatcgcctgccgggtcttccgtacctgccgcgcgtccggaatccggacggtcgccgtgtactcggacgccgacgagaacgccctccacgcgcgcgtggccgacgcggcggtacggctgccgggtgcggcgcccgctcagacgtatctgcgcggcgacctgatcgtgaaggcggccctcgcggcgggcgccgacgccgtccacccggggtacgggttcctgtccgagaacgccggcttcgcgcgcgccgtgcgggacgcggggctcgtctggatcgggccgccgccggaggcgatcgaggcgatggcgtccaagacgcgcgccaagaagctgatggggctcgagcccctgacggaggtcacgccgccggacctgcccgtgctggtcaaggcggccgcgggcggcggcggccgcggcatgcgcgtcgtgcgggacctcgccgagctggacgccgagttggcggcggcccgcgccgaggcgctgagcgccttcggggacggggaggtgttcgtcgagccctatgtggagggcggacgccatgtcgaggtccaggtgctcgccgacacgcacggcacggtgtgggcgctcggcacgcgcgactgctccctgcaaaggcgccaccagaaggtgatcgaggagtcaccggcccccggtgtggacgccgaactcacggcggaactccacgagctggcgatacgcgccgcgcgcgccgtcggctacacgggcgccggcaccgtcgagttcctggtcgcggacgggcgggcgcacttcctggagatgaacacccgcctccaggtggaacacccggtcacggaggcggtcttcggtatcgacctggtcgcccagcagatacgcgtcgccgagggcgcggcgctggagagcgacccgccacgcgcgcgtgggcacgcgatcgaggcccgcctgtacgcggaggacccgtcccgggactgggccccgcagacgggcacgctgcaccggctcgccctgccgcgggaagcggacgtccgcctggacacgggctacaccgacggcgaccccgtcggcgtccactacgacccgatgctcgccaaggccgtcgcccacgcccccacgcgcgcggaggcggtgcgcacgctggcggacgccctggaacgggccgagatccacgggccggtcaccaaccgcgacctcctcgtacggtcactgcggcacccggagttcacggcggcccgcatggacaccgggttctacgaccggcacctgaccgaactgacggcgcccgccccggacccgtacgcccccttggccgccgccctcgcggacgcccacggccgctcccggttcggcggctggcggaacctgccctcccagccgcagaccaggcgctacctgatggcgggcgacgagcacgaggcccgctaccaccacacccggcacggcctgaccgccgaaggggtgcgcgtcgtgcacgcggacgccggcctcgtcgtcctcgaaatcggcggcgtacagcggaagttccgggtcagccgctacggcgaccaggtccatgtgaacgcgacggccctcacggaactgccccgcttccccgaccccgccgcccgccaggaaccgggttccctgctcgctcccatgccgggcaccgtcgtccgcgtcgccgaggggctcgccgaaggagcccgggtggaggccggacagcccctgctgtggctggaggcgatgaagatggaacacaagatctccgcgccgacggcgggcaccctcggcgccctgcacgccaccccgggccaacaggtcgaggtaggcactctgctcgcggtagtacagcgcgccctttag

SEQ ID NO: 4855 - protein, 616 aa, Streptomyces avermitilis
MIASVLVANRGEIACRVFRTCRASGIRTVAVYSDADENALHARVADAAVRLPGAAPAQTYLRGDLIVKAALAAGADAVHPGYGFLSENAGFARAVRDAGLVWIGPPPEAIEAMASKTRAKKLMGLEPLTEVTPPDLPVLVKAAAGGGGRGMRVVRDLAELDAELAAARAEALSAFGDGEVFVEPYVEGGRHVEVQVLADTHGTVWALGTRDCSLQRRHQKVIEESPAPGVDAELTAELHELAIRAARAVGYTGAGTVEFLVADGRAHFLEMNTRLQVEHPVTEAVFGIDLVAQQIRVAEGAALESDPPRARGHAIEARLYAEDPSRDWAPQTGTLHRLALPREADVRLDTGYTDGDPVGVHYDPMLAKAVAHAPTRAEAVRTLADALERAEIHGPVTNRDLLVRSLRHPEFTAARMDTGFYDRHLTELTAPAPDPYAPLAAALADAHGRSRFGGWRNLPSQPQTRRYLMAGDEHEARYHHTRHGLTAEGVRVVHADAGLVVLEIGGVQRKFRVSRYGDQVHVNATALTELPRFPDPAARQEPGSLLAPMPGTVVRVAEGLAEGARVEAGQPLLWLEAMKMEHKISAPTAGTLGALHATPGQQVEVGTLLAVVQRAL

SEQ ID NO: 4856 - DNA, 1773 bp, Streptomyces avermitilis
  CDS (1)..(1773)
atgcgcaaggtgttgatcgccaaccgtggcgaaatcgctgtccgcgtcgcccgggcctgccgtgacgccgggatcgcgagcgtggccgtgtacgcggagccggaccgggacgcgctgcacgtccgggcggccgacgaggcgttcgccctgggcggtgacaccccggccaccagttacctggacatcgccaaggtgctccaggccgccaaggattccggtgcggacgccatccacccgggttacggctttctttccgagaacgcggagttcgcccaggcggtcctggacgcgggcctcgtctggatcgggccgccgccgcaggccatccgcgacctcggcgacaaggtcgccgcccggcacatcgcgcagcgcgcgggtgcccccctcgtggcgggcacgcccgacccggtctccggcgccgacgaggtcgtcgcgttcgcccgggagcacggtctgccgatcgccatcaaggccgccttcggtggcggcgggcgcggtctgaaggtggcccgcaccctcgaagaggtccccgagctgtacgactcggcggtccgcgaggcggtcgccgcgttcggccgcggcgagtgcttcgtcgagcggtacctcgacaagccccggcacgtcgagacgcagtgcctggccgacacccacggcaacgtggtcgtcgtgtccacccgcgactgctccctccagcgccgtcaccagaagctggtcgaggaggccccggcgccgttcctgtcggacgcccaggtcgaggagctgtactcctcctccaaggcgatcctgaaggaggccggctacgtcggcgcgggcaccgtcgagttcctcgtcggtgtcgacggcaccatctccttcctcgaggtcaacacccgcctccaggtcgaacacccggtcaccgaggaggtcgccggcatcgacctcgtgcgggagatgttccgcatcgccgacggcgaggaactcggctacggcgaccccgagctgcgtggtcattccttcgagttccgtatcaacggcgaggacccgggccgcaacttcctgcccgcccccggcacggtgacgaccttcgccccgccgtcgggcccgggcgtgcgcctggacgccggcgtcgagtccggcagcgtgatcggccccgcctgggactccctgctcgccaagctgatcgtcaccggcgccacccgcgaacaggctctccagcgcgccgcccgcgccctggccgagttcaacgtcgagggcatggccaccgccatcccgttccaccgcgcggtggtcagggacccggcgttcgcccccgaactcaccggctccgccgaaccgttcacggtccacacccgctggatcgagaccgagttcgtcaacgagatcaagccgttcaccgtccccaccgacgcggacgccgaggaggagcccggtcgcgagaccgtcgtcgtcgaggtcggcggcaagcgcctggaagtctccctgccgtcctccctcggcatgtcgctggcccgcaccggcctcgcggcgggcgccaagcccaagcgccgcgcggccaagaagtccggcccggtggcctccggggacaccctcgcctccccgatgcagggcaccatcgtcaaggtcgccgtcgaggagggccaggaggtccaggaaggcgacctggtcgtcgtactcgaagcgatgaagatggaacagccgctgaacgcgcacaagtccggcaccatcaagggtctgggcgccgaggtcggcgcgtccatcacctccggcgccgccatctgcgagatcaaggactga

SEQ ID NO: 4857 - protein, 590 aa, Streptomyces avermitilis
MRKVLIANRGEIAVRVARACRDAGIASVAVYAEPDRDALHVRAADEAFALGGDTPATSYLDIAKVLQAAKDSGADAIHPGYGFLSENAEFAQAVLDAGLVWIGPPPQAIRDLGDKVAARHIAQRAGAPLVAGTPDPVSGADEVVAFAREHGLPIAIKAAFGGGGRGLKVARTLEEVPELYDSAVREAVAAFGRGECFVERYLDKPRHVETQCLADTHGNVVVVSTRDCSLQRRHQKLVEEAPAPFLSDAQVEELYSSSKAILKEAGYVGAGTVEFLVGVDGTISFLEVNTRLQVEHPVTEEVAGIDLVREMFRIADGEELGYGDPELRGHSFEFRINGEDPGRNFLPAPGTVTTFAPPSGPGVRLDAGVESGSVIGPAWDSLLAKLIVTGATREQALQRAARALAEFNVEGMATAIPFHRAVVRDPAFAPELTGSAEPFTVHTRWIETEFVNEIKPFTVPTDADAEEEPGRETVVVEVGGKRLEVSLPSSLGMSLARTGLAAGAKPKRRAAKKSGPVASGDTLASPMQGTIVKVAVEEGQEVQEGDLVVVLEAMKMEQPLNAHKSGTIKGLGAEVGASITSGAAICEIKD

SEQ ID NO: 4858 - DNA, 1359 bp, Nitrosomonas europaea
  CDS (1)..(1359)
atgtttgaaaaaatattgatcgcaaatcgtggtgagatcgcgctgcgcatccagcgggcatgtcgcaccatgggtattaaaacagtagccgttcattctgaagcagatgctgaggccaagtacgtcaaactggccgatgagtcggtgtgtatcggcccggcagcctctgcacagagttatctgaacattcctgccattatcagtgcggctgaagtcaccgatgctgaagccattcacccgggttacggttttctatccgagaatgcggattttgccgagagagtggaaaaaagcggctttttctttattggaccccggccggatacgatccggttgatgggggataaagtcagtgccaaaaatgccatgcgacaggcgggggtaccttgtgtaccgggttccggtggtgcattaccggaatctctcgatgaggtaaagaagatcgttaaagaaataggctatccggtcatcattaaagcggccggaggcggtggagggcgcggtatgcgtgtggtgcataccgaagcagcgctttcaaacgcggtgattacgacacgtaacgaggcgcagactgcattcggcaatccggttgtttatgcagaaaaatacctggaaaaccctcgtcatatcgaatttcaggtactggccgacgagtacggcaatgtcgttcatctgggggagcgggattgctctatgcaacgtcgccatcagaagatcattgaagaagcacctgcccgcggtatttctgtacagttgcgtgacaaaatcggggagctgtgtgtcgaggcttgcaagcgtatcaattatcgcggtgtcgggacttttgaatttctttacgagaacaatgaattttatttcattgagatgaatacccggttgcaggtcgaacatccggtaacggaggcgatcaccgggatcgatctggttcaggcgcaaattcgtgtggcagccggagaaaagctgtctttgcagcagaaggatatcgtgttcaagggccatgccatagaatgccgtatcaatgcggaagatccctataaactgaccccatcggccgggcgcatcactcaataccatgctccgggcggcccgggaatcagggttgattcacatatctatcacaactatcgtgtaccaccttactacgattccatgattgccaaggtaattgcctatggcgatgatcgcgacctggctattgcccgtatgcgtatagcattgacggaaatgatcgttgaaggcatcaaaaccaatataccgttgcatctcgaccttctgacagattgcaatttcctgtccggccccgtttccattcatcatcttgaaggtaaactcgcgttgtataacaaaaaatcgacctga

SEQ ID NO: 4859 - protein, 452 aa, Nitrosomonas europaea
MFEKILIANRGEIALRIQRACRTMGIKTVAVHSEADAEAKYVKLADESVCIGPAASAQSYLNIPAIISAAEVTDAEAIHPGYGFLSENADFAERVEKSGFFFIGPRPDTIRLMGDKVSAKNAMRQAGVPCVPGSGGALPESLDEVKKIVKEIGYPVIIKAAGGGGGRGMRVVHTEAALSNAVITTRNEAQTAFGNPVVYAEKYLENPRHIEFQVLADEYGNVVHLGERDCSMQRRHQKIIEEAPARGISVQLRDKIGELCVEACKRINYRGVGTFEFLYENNEFYFIEMNTRLQVEHPVTEAITGIDLVQAQIRVAAGEKLSLQQKDIVFKGHAIECRINAEDPYKLTPSAGRITQYHAPGGPGIRVDSHIYHNYRVPPYYDSMIAKVIAYGDDRDLAIARMRIALTEMIVEGIKTNIPLHLDLLTDCNFLSGPVSIHHLEGKLALYNKKST

SEQ ID NO: 4860 - DNA, 1371 bp, Enterococcus faecalis
  CDS (1)..(1371)
atgttttcgaaagtattaatcgcaaaccgcggagaaatcgctgttcgtattattcgtgcctgtcgcgaattaggcgttcaaacagttgctgtttactctgaagcggatcaagaagcgttacacacacagttagcagatgaagccatttgtattggaccggcgaaagcaactgattcttatttaaatgttcaagctgttttaagtgcagcgattgttaccaatgctgaagcgattcatccagggtttggtttcttatctgaaaatagtcaatttgcttcaatgtgcgaagaatgtaacattacttttatcggtcctaaagcagaaacgattgatgcaatgggcaataaaataaacgcacgtcaactgatgcaaaaagccaaggtacctgttattcctgggagtgatggcgtcattgattctgtcgaagaagcgttgacgattgctgaagaaattggttacccagtgatgttaaaggcagctgctggtggtggcggaaaaggaatccgaaaagttctttcaaaagaagagttaccgaaacactttacttcagcgcagcaagaagccaaagccgcatttggtaatgatgatatgtatttagaaaaaattatttatccagcacgtcatatcgaagtgcaaattttaggtgatcaatatgggcatgtgattcacttaggggaacgtgattgctcactacaaagaaataatcaaaaagtgttagaagaatcaccatcgattgctatttctgaagaaaagcgtcagatgttaggcgaaacggccgttcgagcggcacaagctgtgcattatgaaaatgccggaaccattgaatttttgatggatccagctggcgacttttatttcatggaaatgaatacccgcatccaagtcgaacatccagttacggaaatggtaacagggattgatttagtcaaagcacaattagaaattgcttcaggtgaacctttaggctatacccaagaggatgttatcatgagtgggcatgcgattgagtgccgaattaacgctgaaaatcctgcctttaattttgctccttcaccaggtaaaattcaaaatctcttgttgcctagtggtggaatgggcttgcgtgtagacagcgctatgtattcagggtattcaattccgccttattatgattcaatgattgcaaaagtcatcgtacatggtgaaaatcgttttgatgccttgatgaaaatgcaaagggctttaaatgaaattgtaacagaaggtattattacgaatgccgaattccaattagatttaattacacatgacaatgttttgacaggtgactatgacacaagctttttacaagaaacatttctaccaaattgggagccagaaagcaatcattaa

SEQ ID NO: 4861 - protein, 456 aa, Enterococcus faecalis
MFSKVLIANRGEIAVRIIRACRELGVQTVAVYSEADQEALHTQLADEAICIGPAKATDSYLNVQAVLSAAIVTNAEAIHPGFGFLSENSQFASMCEECNITFIGPKAETIDAMGNKINARQLMQKAKVPVIPGSDGVIDSVEEALTIAEEIGYPVMLKAAAGGGGKGIRKVLSKEELPKHFTSAQQEAKAAFGNDDMYLEKIIYPARHIEVQILGDQYGHVIHLGERDCSLQRNNQKVLEESPSIAISEEKRQMLGETAVRAAQAVHYENAGTIEFLMDPAGDFYFMEMNTRIQVEHPVTEMVTGIDLVKAQLEIASGEPLGYTQEDVIMSGHAIECRINAENPAFNFAPSPGKIQNLLLPSGGMGLRVDSAMYSGYSIPPYYDSMIAKVIVHGENRFDALMKMQRALNEIVTEGIITNAEFQLDLITHDNVLTGDYDTSFLQETFLPNWEPESNH

SEQ ID NO: 4862 - DNA, 3492 bp, Enterococcus faecalis
  CDS (64)..(3492)
gtactatttatctttagaacagaaccaataaatttgaaggaaattgatggtaggagtgacgttatgaaaaaggtattagttgccaatcgtggcgaaattgcgattcgaatttttagagcttgtacagaattagatatccgtacagtagcgatttatgctgcagaagatgagtattctgttcatcgtttcaaagcagatgaagcgtatttagttggtaaggggaaaaaaccaattgaagcctatttagacattgaaaatattatccaaattgccaaaaaatcgggagcagatgccattcatcctggttatggctttttatcagagaacttacgcttcgccgaacgttgtgaagaagaaggaatcatttttgtcggacctaaaacacatcatttagatatttttggcgataaaattaaagcgaaagaagcagctgtagctgcggggattgcttcgattccaggctcagacgggccagtagcaacggtggaagaggttgtagcttttggtgaaacacatggctttcctatcatgattaaagctgctttaggtggcggcggtcgcgggatgcgcgttgcccacgatgccaaagaagcacgagaaggttacgaaagagcaaaaagtgaagcgaaagcagcctttggttctgacgaggtttatgttgaaaagtatatttctaatcctaaacatatcgaagtacaaattttaggcgatcatcatgggaacgtcttgcatttatttgaacgtgattgttccgttcaacggcgccaccaaaaagtggtagaagtcgcaccatgtgtatcaatgaatgaagaacaacgagcagccatttgttcggctgctgtgcagttaatggcacatgtcggctacgtgaatgcgggaacggttgagtttttagtagaaggggatcagttttattttattgaagtgaatcctcgtgttcaggtagaacatactatcacagaaatgattacagatattgatattgtgatctctcaattacaaattgcgcaagggcttgatttgcataaagatatgcatttgccaaaacaaaacgaattgacattaaaaggcgcggctattcaatgtcggattacgactgaagatcccctgaaccagtttatgccagacacagggaaaatcgatacgtatcgttcaccaggtggttttggtgtgcgtttagatgtagggaatgcttattctggctacgctgtgactccctactttgattctttattggttaaagtctgtacgcatggtttctcttttgaacaggcaatcagtaaaatgcaacgctgcttaaaagaatttcggattcgtggcgtgaaaacaaatattccgtttttacaaaatgttgtgagctatccagcgtttcaatctggcgaagccaaaacaacctttattgataatacacctgaattatttgaatttcctcgtatgcgcgatcgtggcaataaaacgatgaaatacattggagaagtaacggtcaatgggttccctggcattgaaagaacggagaaaaaatattttgaagccccgcgcgtgccgacagatattgaagttccagaaaaagtgattacagctaaaaatattctagacgctcaaggagcaaccgccgtcatcgattgggttaagaatcaagaaagtgtgttaatgacagataccacgttccgtgatgcgcaccaaagtttattagctactcgtgtgagaacacaagattttaaagcaattgctggtctaactgatgcagccctgcctgagctgttttctagtgaaatgtggggtggcgctacgttcgatgttgcctatcgcttcttaaccgaagacccatggcaacgtttaagaaaaattcgtcagttgatgccaaacacacttttacaaatgctgttcagaggatctaatgcggtaggctatcaaaattatcctgataatgttattgaagaatttattaaagaatccgctcgccaaggagtcgatgttttccgaatttttgatagcttaaactggattcctcaaatggaaaaaagtattcaagtcgttcgggataccggaaaaattgcggaagcagcaatttgttatactggggacatcaatgatccagcccgagcaaaatataatgttcaatattaccttgatatggctaaagaattggaaaatttaggtgcacaaatcattgcgattaaagatatggctggcttattgaaaccacaagctgcttatcgtttaattagtgaattaaaggcagccacggatttaccaattcatctccacactcacgacactagtggcaatgggatcatcacatattcagcagctactaaagcgggcgttgatattgttgacgtcgcaatgagtgcgatgagtggcgcaactagccagccaagtatgaacagtctatattatgctttagtcaatggtgaacggacgccaactattaacattgataatgcacagaaaatcaatcattattgggaagatgtgcgcatgtattatcaaccatttgaaaatgggttaaatgccccgcaaacagaagtctatatgcatgaaatgcctggtgggcaatactctaatctacagcagcaagcaaaagcggtaggcttagggcaccgttgggatgaaatcaaaaaaatatatcacacagtgaatttgatgtttggcgatattgtaaaagtgacgccatcttcaaaagtcgtgggagacatggcactcttcatggttcaaaataatctgacagaacaagatgtttatgcgcgtggtgaagaactaagttttcctgaatcagttgtgacttttttccaaggtgatttaggtcaaccagttggtgggttcccgaaagagctgcaacgaattattctaaaaggtcgaccagccttcacagagcggccaggtgacttagcagcacctgttgattttgcgaaagtacaagaagaattagccgaaaaaattgggtatcaacctaaattggaagaagttttaagttatttaatgtatccacaagtatttttagagtatcgtcaaaaatacgaaacctttggagatataaccttattagatacgccaacattctttaatggtattcgtcaaggagagacattggaagttcaaattgaacgaggaaaaacgttaattattcgtttagatgaaattggcgaacctgatattgacggaaaccgtgtcttgttcttcaatttgaatgggcaacgtcgtgaggttttagttaaagatgcctctattaagtctgctgttcaagtaaaacaaaaggcggaaccaactaataaagaacaaatcggcgcaacgatgtctggttctgttctacaagtattggtcaaacgtggcgataaagtagaaaaaggtcagccgttgctgattacagaagccatgaaaatggaaacgactatcgaagcacgttttgcgggcacggtagatcacatttatgttgaagaaggcgaagcaatcagctcaggtgatttgttattagaagtgaaagaaaaataa

SEQ ID NO: 4863 - protein, 1142 aa, Enterococcus faecalis
MKKVLVANRGEIAIRIFRACTELDIRTVAIYAAEDEYSVHRFKADEAYLVGKGKKPIEAYLDIENIIQIAKKSGADAIHPGYGFLSENLRFAERCEEEGIIFVGPKTHHLDIFGDKIKAKEAAVAAGIASIPGSDGPVATVEEVVAFGETHGFPIMIKAALGGGGRGMRVAHDAKEAREGYERAKSEAKAAFGSDEVYVEKYISNPKHIEVQILGDHHGNVLHLFERDCSVQRRHQKVVEVAPCVSMNEEQRAAICSAAVQLMAHVGYVNAGTVEFLVEGDQFYFIEVNPRVQVEHTITEMITDIDIVISQLQIAQGLDLHKDMHLPKQNELTLKGAAIQCRITTEDPLNQFMPDTGKIDTYRSPGGFGVRLDVGNAYSGYAVTPYFDSLLVKVCTHGFSFEQAISKMQRCLKEFRIRGVKTNIPFLQNVVSYPAFQSGEAKTTFIDNTPELFEFPRMRDRGNKTMKYIGEVTVNGFPGIERTEKKYFEAPRVPTDIEVPEKVITAKNILDAQGATAVIDWVKNQESVLMTDTTFRDAHQSLLATRVRTQDFKAIAGLTDAALPELFSSEMWGGATFDVAYRFLTEDPWQRLRKIRQLMPNTLLQMLFRGSNAVGYQNYPDNVIEEFIKESARQGVDVFRIFDSLNWIPQMEKSIQVVRDTGKIAEAAICYTGDINDPARAKYNVQYYLDMAKELENLGAQIIAIKDMAGLLKPQAAYRLISELKAATDLPIHLHTHDTSGNGIITYSAATKAGVDIVDVAMSAMSGATSQPSMNSLYYALVNGERTPTINIDNAQKINHYWEDVRMYYQPFENGLNAPQTEVYMHEMPGGQYSNLQQQAKAVGLGHRWDEIKKIYHTVNLMFGDIVKVTPSSKVVGDMALFMVQNNLTEQDVYARGEELSFPESVVTFFQGDLGQPVGGFPKELQRIILKGRPAFTERPGDLAAPVDFAKVQEELAEKIGYQPKLEEVLSYLMYPQVFLEYRQKYETFGDITLLDTPTFFNGIRQGETLEVQIERGKTLIIRLDEIGEPDIDGNRVLFFNLNGQRREVLVKDASIKSAVQVKQKAEPTNKEQIGATMSGSVLQVLVKRGDKVEKGQPLLITEAMKMETTIEARFAGTVDHIYVEEGEAISSGDLLLEVKEK

SEQ ID NO: 4864 - DNA, 1347 bp, Coxiella burnetii
  CDS (1)..(1347)
atgtttaaaaaagtattaatcgctaaccgcggtgagattgctcttcgcatccatcgcgcttgtaaagaaatgggtattaaaaccgtagcggcttattcaatcgcggatcgcgatttaatgcatgtgcgcttagccgatgaagcggtgtgtattggcccttcaaacagcacgcacagttacctcagcgttccggcggttatttccgctgctgaaattacggatgttgaggccattcaccccgggtatggttttttggcggaaaatcctaatttttgcgaacaagtggaaaaaagtggattcgtttttattggaccttcacacgaagccattcatttaatgggaaacaaagtttcagcgattaaagcgatgaaagaagcagggctcccttgtatccctggctccgatggcgctttagggaaagatggggatgctaatctgcttattgccgagcaaattggttaccccattttaattaaagcggccggtgggggcggtgggcgaggaatgcgcgtcgtgcatagagaggccgagcttttaaatgcgatcgccatgacacgaacggaagcggcagcggcttttggtacggataaagtgtatatggaaaaattcctcgaaaatccgcgccatattgaaattcaagttctgggcgacggccaaggccatgctattcacttaggggaacgggattgttccatgcaacgccggcatcaaaaagtaattgaagaagcaccggctcccggcattacgcccaaacaacgggccaccattggcgaacgttgcgtacaggcttgtattgcgatgaattataggggagcgggaacatttgaattcctgtatgaaaacggcgagttttatttcattgaaatgaacacgcgcattcaggtggaacatcccgttacggaaatgattaccggtattgatcttgttaaagaacaaattcgagtggcggctggcttgccgctgagttatcgtcaaagcgatgtccaaattaagggtcacgccattgaatgccgcattaatgccgaagatcccaaaaatttcatgccttgcccaggccgagtgactgcctatcacgctcccggcggattcggcgtgcgcatggactcccatttatacgcgggttataacgtccccccgtattacgattctttaattggtaaattgattgtctacgacgaaaatcgcgaggaggctatcgcgcgcatgaaaaattctttagaagaacttgtgattgaaggaatcaagaccaatacaccgctccatttgacgatgatgacagatgagaaatttaaaaaaggcgctcagaatattcattatttagaaaagaaattgggacttaaaaactag

SEQ ID NO: 4865 - protein, 448 aa, Coxiella burnetii
MFKKVLIANRGEIALRIHRACKEMGIKTVAAYSIADRDLMHVRLADEAVCIGPSNSTHSYLSVPAVISAAEITDVEAIHPGYGFLAENPNFCEQVEKSGFVFIGPSHEAIHLMGNKVSAIKAMKEAGLPCIPGSDGALGKDGDANLLIAEQIGYPILIKAAGGGGGRGMRVVHREAELLNAIAMTRTEAAAAFGTDKVYMEKFLENPRHIEIQVLGDGQGHAIHLGERDCSMQRRHQKVIEEAPAPGITPKQRATIGERCVQACIAMNYRGAGTFEFLYENGEFYFIEMNTRIQVEHPVTEMITGIDLVKEQIRVAAGLPLSYRQSDVQIKGHAIECRINAEDPKNFMPCPGRVTAYHAPGGFGVRMDSHLYAGYNVPPYYDSLIGKLIVYDENREEAIARMKNSLEELVIEGIKTNTPLHLTMMTDEKFKKGAQNIHYLEKKLGLKN

SEQ ID NO: 4866 - DNA, 1986 bp, Coxiella burnetii
  CDS (1)..(1986)
atgtttcgaaagttactcatcgctaatcgggacgaaattgcttgtcggattattaaaaccgctaaaaaatggaatattagaactattgcactttattcaacaatcgataaaaacgcattgcacgtccgcttagccgacgaaagttatttaatcggccccccgccggcagcaaaaagttatttaaaccgagaaaaaataatcaatattgcaatgcaaacaaacgcggatgcgatccatcctggctacggatttttagcggaagatgaaaaattcgcggcgctttgtcaccaaaaaggacttacgtttatcggcccacctcccgctgctattgctgcgatgggagataaacgagaggcaaaacgtttaatggaaaaagcaagcgttcccgttgtacccggctatcaaggaaaacaacaagaccttaaaacgctaaccgaacaggctaaaaaaataggttttccgcttcttatcaaagcctccgctggcggtggcggaaaaggaatgcgtttagtaacgattgccaacgaactcgaacacgctttgcaatcggccaagcgtgaggctaaatccagttttgatgacgattcggtttttcttgaaaagtacatcaatccggctcgacatatagaagtgcaaatttttatcgatcaaaagggaaatggcgtgtatttgtttgaccgcgattgttcgattcaacggcgtcaccaaaaaattattgaggaagcccccgcaccgaacttaagtgacctgactcgacaaaaaatgggtgaaacggctgtaaaagcggctaaagccgttaattacgtcggggcaggaacggtcgaatttctcgtggataaaatggaaaatttttatttcatggaaatgaatacccgtttacaagttgaacatcccgtcaccgaaatgattaccggattagatttagtcgaatggcaactaaagattgctcaaggcgaaatgcttcccctttcacaaaaacaaattaaagccaagggtcatgcttttgaagctcggctctatgctgaaaatcccgccaataatttctccccctccaccggtaaaattatttttttctcttcaccgaaagaaaatagaaatgtgcgattggatacaggcgttgttcagggcgatacgatcagtccctactatgatcccttaatggcgaaattgattgtccatgatgagaatcgctccaccgctctgcaacggctgcaaaactcactggaaaatacatttattgtgggcgttaataccaatatttcttttttacaccaaatttgtacaaatcctgactttaaaaaagctaacatttacacgaccctaatcgaggaaacaccattaaataatcttgaaaaaataattcccaacgaaattttattttttgcagctttagctgaattacaacagcaaaaaaaacaagccaaagaatttgccactcaatccgacgacctattttcaccgtggtttgctcgcgatggttggcggttatccagctgtcccacccaaattttacgcttttgggatacagaaaaaacgttcgatattaaaataactccttctcccgagggctataacctgctgctaaagaataaagaaatttctctttctcaatttcaacaaaccgatcatttagttgaatttacttacaacaaccagaattacaaagcggccgttattaatgatgcagataactggcatattttttataaaggaaatcatttcaccattgttcgctacaatcctaaaacacactctaccgacagctcaacaatcgaaaaccaattcatcgcttctatgcctggcaccgtcattgaaatttttgtaacagcggaacaaaacgttaaaaaaggcgaccgtcttcttattttagaggcaatgaaaatggaacacacagtaacagcaccgaaggatggcgttgtaaaatctgtattttgccgccctggcgatctagtgagcgaaggcactgaattattaagctttttttaa

SEQ ID NO: 4867 - protein, 661 aa, Coxiella burnetii
MFRKLLIANRDEIACRIIKTAKKWNIRTIALYSTIDKNALHVRLADESYLIGPPPAAKSYLNREKIINIAMQTNADAIHPGYGFLAEDEKFAALCHQKGLTFIGPPPAAIAAMGDKREAKRLMEKASVPVVPGYQGKQQDLKTLTEQAKKIGFPLLIKASAGGGGKGMRLVTIANELEHALQSAKREAKSSFDDDSVFLEKYINPARHIEVQIFIDQKGNGVYLFDRDCSIQRRHQKIIEEAPAPNLSDLTRQKMGETAVKAAKAVNYVGAGTVEFLVDKMENFYFMEMNTRLQVEHPVTEMITGLDLVEWQLKIAQGEMLPLSQKQIKAKGHAFEARLYAENPANNFSPSTGKIIFFSSPKENRNVRLDTGVVQGDTISPYYDPLMAKLIVHDENRSTALQRLQNSLENTFIVGVNTNISFLHQICTNPDFKKANIYTTLIEETPLNNLEKIIPNEILFFAALAELQQQKKQAKEFATQSDDLFSPWFARDGWRLSSCPTQILRFWDTEKTFDIKITPSPEGYNLLLKNKEISLSQFQQTDHLVEFTYNNQNYKAAVINDADNWHIFYKGNHFTIVRYNPKTHSTDSSTIENQFIASMPGTVIEIFVTAEQNVKKGDRLLILEAMKMEHTVTAPKDGVVKSVFCRPGDLVSEGTELLSFF

SEQ ID NO: 4868 - DNA, 3396 bp, Tropheryma whipplei
  CDS (1)..(3396)
atgtttaaaaagattctcatagcaaaccgcggtgaaatagcgatccgtatctccagagccgcatttgagcggcagatacaaacggttgcgatatatgcccatgaggatcgtaatagtctacacagactaaaagctgatgaagcctatcaaatagggcaagttggcagccctgttgcggcttatcttgatgttcacgagattattcgtgtggcacttatgtcaaactctgatgcaattcatccgggatatggattcttatcagaaagctatctccttgccgatgaagccgaaaagaacggaataacttttataggcccaccaaaggatgtcctaaaaagtgcaggggataaggttctggcaaaacatatggcgcaggcagcaggcttgccaaccctgagatccagcaccgcaagtagcaattatgacgagttactccgtgaggctgaattatttgaatatccgatttttgtcaaggctgcgagtggcggtggtggccgtggaatgcgcattgtcgagaacaggacggccttaaagaactctcttgagagtgcgattcaagaagcggcggcatcatttggtgacccgcgcgttttcctggaaacagctttggacaaaccccgtcatatagaagttcaggttttggcagacaaattcggtaacattgtgcacttgtttgagagggattgctcgctgcaaaggcgacatcaaaaagttattgagattgctcccgctccaaatattccagaattactcagaaccactctctatcgtgatgcaattgcatttgcaaaaagcgtgaagtatgaaaatgcaggcacagttgaatttcttgttgactcaaagatgaatcattacttcattgaaatgaaccccaggattcaggttgagcatactgttaccgaagaaataaccgatattgatatagttcagagtcaaattcgtattgctgccggcgccagtcttgacgatattgggcttgttcaagacaaaatagaacgaaggggctttgcactgcaatgcagaattacaacagaagatccccatgcaaactttagaccggacactgggcgtataacctcttatcaatctcccggcggcgcggggattcgtcttgatgccagtgctgtaaatccaggggtagagataacaccttattttgactcgatgcttgtcaaaatgacttgccgaggcaatagctttgcggatgcaacaaacagagctcgtagaggtcttgccgagtttagagttggtggcgttgcaacaaatatctccttcttacgcacattgcttgatagcagtaattttctgaatgcagattttgacacaacatttatagagaagaatggatatttactacaacaatcttttttgcttgataagcatgataggttggtgtcttacctgggacatgtaacagtaaataaaccgtacggagatcgcccagagcttgttgacccgtgttccaaaattgccaactttttacctgactcatctgaggtcaagaaaagtgtggagggaagcagagatgttcttttacgccttggaccccaagggtttgcaaaatggcttttatgccgcaagggtttagctgtaactgatacaacatttcgtgatgcacatcaatccctcctggcaacccgggttagaacaatagatctctcccgcgccgctgagtgcacatctgccgctttgcctgaactgttttctatggaggtctggggtggtgctacatatgatgtagctcttcgttttttgtatgaagatccatgggagagactttcaaaaatacgtgaaaaggtcggaagcatatgtctgcagatgcttcttcgagggcgcaacacggttggatataccccttacccagaccaggttactcgcgcttttgtagacgaggcatcggacttggggattgatatattccgtatatttgatgcgctaaatgatgtagaccagatgcgcatagctatagatgcggtacaacagacgaacagcgttgccgaagtggcaatctgttatacaggtgacctccttgataagcgtgaaacagtgtacacaattgactattatctcgagatagccaagaaaattgttgatgcgggtgcgcatattttagctataaaagatatggccggcgtcctgcgccctcgcgctgcgacacttctcgtaagcgccctgaaaagggaatttgcccttccggttcatttacacacacacgatactcctggaggacagcttgctacccttttggcggctgcggattcgggtgtcgatgcggtagatgttgccagtggccccatgtctggcacaaccagtcaaccctccatgtcgtcccttgttgccgccacagataatacagagcatgaaacaggcctttccctgagtcgtgtgaatgaattggagccatactgggaagcggtgcgccggctgtatgttccttttgaatctggtttactatccccaacaggtcgcgtatacatccatgaaattcccggaggtcagctctctaatctaaaacaacaggcaattgcactaggactttctgatcgatttgagattattgaggaaatgtatgcctatgtcaacacactctttgggcgtataccaaaagttaccccctcctccaaggtcgttggggatttggcgctttatttggcttctgtcaatcccgatttgggtgattttgaaatgaatccgaaaaaatatgatatcccggattctgttatttcttttttagccggcgaactgggcactcctccagctggttggcccgattttagagaccgggtactggccgaaagagaaattagcattgaacaacacccactgagcagtgatgattcaaagaatcttgccacctcgggcaaaatacggcagcaaaccctaagtaaactacttttcccagaaccttaccgcgcatttgaagcaaatagggcggaatacggcgacctatcaatcttgaggagtgaagagtttttctatggacttgattttggcattgagtacaaaatagccgtttcttcatcagttggcatccttgtgcgtcttgaggcaatcggcggagttgatagcaagggtgaacgatcgcttgtactatcagtcaatggtgaactgcgccccatacaggtaagggatgaatctgccaatgtcgaggtctcccgcgcagaaaaagccgacccgaataacccgggtcatattgcctccccttttgctgggcaggttacaattaaggtcgacgttggcgatgaggttgtttccggacaggctgttgcgatacttgaagctatgaagatgaccactgtggtcaatgcgccagtctccgggcaggttattcgcatttcaattccaccgggtcgtcaggtggatattggcgatctgattatggaaataagggtctga

SEQ ID NO: 4869 - protein, 1131 aa, Tropheryma whipplei
MFKKILIANRGEIAIRISRAAFERQIQTVAIYAHEDRNSLHRLKADEAYQIGQVGSPVAAYLDVHEIIRVALMSNSDAIHPGYGFLSESYLLADEAEKNGITFIGPPKDVLKSAGDKVLAKHMAQAAGLPTLRSSTASSNYDELLREAELFEYPIFVKAASGGGGRGMRIVENRTALKNSLESAIQEAAASFGDPRVFLETALDKPRHIEVQVLADKFGNIVHLFERDCSLQRRHQKVIEIAPAPNIPELLRTTLYRDAIAFAKSVKYENAGTVEFLVDSKMNHYFIEMNPRIQVEHTVTEEITDIDIVQSQIRIAAGASLDDIGLVQDKIERRGFALQCRITTEDPHANFRPDTGRITSYQSPGGAGIRLDASAVNPGVEITPYFDSMLVKMTCRGNSFADATNRARRGLAEFRVGGVATNISFLRTLLDSSNFLNADFDTTFIEKNGYLLQQSFLLDKHDRLVSYLGHVTVNKPYGDRPELVDPCSKIANFLPDSSEVKKSVEGSRDVLLRLGPQGFAKWLLCRKGLAVTDTTFRDAHQSLLATRVRTIDLSRAAECTSAALPELFSMEVWGGATYDVALRFLYEDPWERLSKIREKVGSICLQMLLRGRNTVGYTPYPDQVTRAFVDEASDLGIDIFRIFDALNDVDQMRIAIDAVQQTNSVAEVAICYTGDLLDKRETVYTIDYYLEIAKKIVDAGAHILAIKDMAGVLRPRAATLLVSALKREFALPVHLHTHDTPGGQLATLLAAADSGVDAVDVASGPMSGTTSQPSMSSLVAATDNTEHETGLSLSRVNELEPYWEAVRRLYVPFESGLLSPTGRVYIHEIPGGQLSNLKQQAIALGLSDRFEIIEEMYAYVNTLFGRIPKVTPSSKVVGDLALYLASVNPDLGDFEMNPKKYDIPDSVISFLAGELGTPPAGWPDFRDRVLAEREISIEQHPLSSDDSKNLATSGKIRQQTLSKLLFPEPYRAFEANRAEYGDLSILRSEEFFYGLDFGIEYKIAVSSSVGILVRLEAIGGVDSKGERSLVLSVNGELRPIQVRDESANVEVSRAEKADPNNPGHIASPFAGQVTIKVDVGDEVVSGQAVAILEAMKMTTVVNAPVSGQVIRISIPPGRQVDIGDLIMEIRV

SEQ ID NO: 4870 - DNA, 1776 bp, Tropheryma whipplei
  CDS (1)..(1776)
atgaaaaaaataacccgactattgatagcgaaccgcggcgaaatagcggtaagggttatacgtgcctgtcgcgataaagcaattgcctccattgcaatatattcggatcaagacagggatgcggtacatactcaacttgcggatgaagcttactgcctggagggtgaaaccgctgccgaaacctacctaaacatagagaaaatactcgatatagcaaaactcagtcgggcagatggaatacatccgggatacggctttcttgccgaaagccccgaatttgctgaagcggtatcaagtgcgggtattacatgggtcggtccacgcgcaggggtcatagcgctcctggcagacaaattatcggcacgaaagattgcagaacaggttggagtgccggtccccccgggtggcgaacatgtggtctcttgtgcatctgaagtgcataattttgcagacaagtatggacttccaattgcaataaaggctgcgtatggcggtggtggtcttggcatgaaagttgtaaaacaaaaaaagaatatagatgagcttttcgcatcagcacaacgtgaagcgcaggcggcattcggaaacaaggaatgtttcatagaaaaatatattgatagaccacgacatgtagaaacacaatgtctggctgatctgtttggcaatgtacaagtcgtttccacgcgagactgttccgtgcagcgcagacaccaaaaactaattgaagaagcgcccgcctacacgctgacagataaacaagaagaaacccttatcaccgcgagcaaggctgttatgaaagcagctgaatattcaggtgcaggcacctgcgaatttctcattgaccaagatgggaaaatattttttctggaagttaatgcaaggcttcaagttgaacacccagtaacagaagagataaccggaattgatctcgttctggagcagataaatatagctgagggaaagctgctcaaaaaccttgaaacacccgtatacaaaggacatagtctggagtttaggataaatgctgaggatgcaaacagtggttttatgccgagacatgggaaggttgtaaaattcgaaccccctggcggtctaggaattcgtattgatagtggaataaaggcgggcgatacaataggggcagcctttgattctctgctgtgcaaactcattgttacgggaaacaatagggaatgcgctttggcacgtgccaggcgggctcttgatgagtttgtaattgacggtgtgacaacgcttattccgttccacaggaatattctcaatcaacccgacttcataaatggagggatgtatacgggttgggtggaaaacgaatatagcaagctagttaacaagcaaactgatgcaagtacggtgccggatatacaagacactctgtctgtatcaaaaaatttaagagaaataattgttgaggtaaacagaaaacaaattagagtgcgcctgccatcccccataggggaatatcccacagaaaggcaaaaacctcccggcaggcgggtagggcacaatttcagacagaaaacacaggagaagaaccccgattctattttttcgccaatgcaagcggttgttgtgaaagtaaatgttacggaaggccagtccgtcaaaaaagacgacctgttaatcgtgcttgaggccatgaaaatggaacagccgatagtggccccacgagatggggtagttgaaaaaatcaacgcgcacacaggcgagacagtgccaagcggtcacgaattgttacgcttgaagaaggtttga

SEQ ID NO: 4871 - protein, 591 aa, Tropheryma whipplei
MKKITRLLIANRGEIAVRVIRACRDKAIASIAIYSDQDRDAVHTQLADEAYCLEGETAAETYLNIEKILDIAKLSRADGIHPGYGFLAESPEFAEAVSSAGITWVGPRAGVIALLADKLSARKIAEQVGVPVPPGGEHVVSCASEVHNFADKYGLPIAIKAAYGGGGLGMKVVKQKKNIDELFASAQREAQAAFGNKECFIEKYIDRPRHVETQCLADLFGNVQVVSTRDCSVQRRHQKLIEEAPAYTLTDKQEETLITASKAVMKAAEYSGAGTCEFLIDQDGKIFFLEVNARLQVEHPVTEEITGIDLVLEQINIAEGKLLKNLETPVYKGHSLEFRINAEDANSGFMPRHGKVVKFEPPGGLGIRIDSGIKAGDTIGAAFDSLLCKLIVTGNNRECALARARRALDEFVIDGVTTLIPFHRNILNQPDFINGGMYTGWVENEYSKLVNKQTDASTVPDIQDTLSVSKNLREIIVEVNRKQIRVRLPSPIGEYPTERQKPPGRRVGHNFRQKTQEKNPDSIFSPMQAVVVKVNVTEGQSVKKDDLLIVLEAMKMEQPIVAPRDGVVEKINAHTGETVPSGHELLRLKKV

SEQ ID NO: 4872 - DNA, 2004 bp, Methylobacterium extorquens
  CDS (1)..(2004)
atgttcgataagatcctgattgccaaccggggcgaaatcgcctgccgtatcatcaagacggcccagaaaatgggcatcaagacggtggcggtctattcggacgccgaccgtgatgcggtccacgtcgcgatggccgacgagccggtgcatatcggcccggcgcccgctgcgcagtcctaccttctgatcgaaaagatcatcgacgcctgcaagcagaccggcgcccaagcggtccatccgggctacggcttcctttccgagcgcgagtccttccccaaggcgctggcggaagcgggcatcgtctttatcggccccaatccgggtgccatcgccgccatgggcgacaagatcgaatcgaagaaggccgcggccgcggccgaggtctcgacggtgccgggcttcctcggcgtgatcgagagccccgagcacgccgtgacgatcgccgatgagatcggctatccggtgatgatcaaggcgtcggcgggcggcggcggcaagggtatgcgcatcgccgaatcggccgatgaggtcgccgagggcttcgcccgcgccaagtccgaggcctcgtcctccttcggcgacgaccgcgtcttcgtggaaaagttcatcaccgacccgcgccacatcgagatccaggtgatcggcgataagcacggcaacgtgatctatctcggtgagcgcgagtgctcgatccagcgccgcaaccagaaggtcatcgaggaggcgccgtcgccgctcctcgacgaagagacgcgccgcaagatgggcgagcaggcggtcgcgctcgccaaggccgtgaattacgactccgccggcaccgtcgagttcgtcgccggccaggacaagtcgttctacttcctcgaaatgaacacccgcctgcaggtggagcacccggtcaccgagatgatcaccgggctcgacctcgtcgagctgatgatccgggtggccgccggcgagaagctgccgctgtcgcaggatcaggtgaagctcgacggctgggcggtcgagagccgcgtctatgccgaggatccgacccgcaacttcctgccctcgatcggtcggctgactacctaccagccgccggaggagggcccgctcggcggggcgatcgtgcgcaacgataccggcgtggaggagggcggcgagatcgcgatccactacgatccgatgattgccaagctcgtaacctgggcgccgacccggttggaagccatcgaagcgcaggcgaccgcgctcgacgccttcgccatcgagggcatccgccacaacatccccttcctcgccaccctgatggcccatccccgctggcgcgacggccggctctcgacgggcttcatcaaggaagagttccccgaaggcttcatcgcacccgagcccgaggggccggtcgctcatcggctcgcggcggtggcggcggcgatcgatcacaagctcaacatccgcaagcgcggcatctccggccagatgcgcgacccgagcctgctgaccttccagcgcgagcgcgtggtggtgctctccggccagcgcttcaacgtcaccgtcgatcctgacggcgacgacctcctcgtcaccttcgacgacggtacgacagccccggtgcgcagcgcgtggcgccccggtgcgccggtctggagcggtacggtcggagatcagtcggtcgcgatccaggtgcgtccgctcctcaacggtgtgttcctgcagcatgcgggcgcggcggcggaagcgcgggtgttcacccgccgcgaggccgaactcgccgacctgatgccggtcaaggagaatgccggctccggcaagcagctcctttgcccgatgcccggcctggtcaagcagatcatggtcagcgagggccaggaggtgaagaacggcgagccgctggccatcgtcgaggcgatgaagatggagaacgtgctgcgcgccgaacgcgacggcaccatctccaagatcgccgccaaggaaggcgacagcctcgccgtcgatgccgtgatcctggaattcgcctga

SEQ ID NO: 4873 - protein, 667 aa, Methylobacterium extorquens
MFDKILIANRGEIACRIIKTAQKMGIKTVAVYSDADRDAVHVAMADEPVHIGPAPAAQSYLLIEKIIDACKQTGAQAVHPGYGFLSERESFPKALAEAGIVFIGPNPGAIAAMGDKIESKKAAAAAEVSTVPGFLGVIESPEHAVTIADEIGYPVMIKASAGGGGKGMRIAESADEVAEGFARAKSEASSSFGDDRVFVEKFITDPRHIEIQVIGDKHGNVIYLGERECSIQRRNQKVIEEAPSPLLDEETRRKMGEQAVALAKAVNYDSAGTVEFVAGQDKSFYFLEMNTRLQVEHPVTEMITGLDLVELMIRVAAGEKLPLSQDQVKLDGWAVESRVYAEDPTRNFLPSIGRLTTYQPPEEGPLGGAIVRNDTGVEEGGEIAIHYDPMIAKLVTWAPTRLEAIEAQATALDAFAIEGIRHNIPFLATLMAHPRWRDGRLSTGFIKEEFPEGFIAPEPEGPVAHRLAAVAAAIDHKLNIRKRGISGQMRDPSLLTFQRERVVVLSGQRFNVTVDPDGDDLLVTFDDGTTAPVRSAWRPGAPVWSGTVGDQSVAIQVRPLLNGVFLQHAGAAAEARVFTRREAELADLMPVKENAGSGKQLLCPMPGLVKQIMVSEGQEVKNGEPLAIVEAMKMENVLRAERDGTISKIAAKEGDSLAVDAVILEFA

SEQ ID NO: 4874 - DNA, 7446 bp, Setaria italica
  CDS (59)..(7024)
aatggcactttgcctttgagaaaatatttaattgtgctgtctgggctacggaacgacaatgtcgcaacttggattagctgcagctgcctcaaaggcgctgccactacttcctaatcgccatagaacttcagctggaactacattcccatcacctgtatcatcgcggccctcaaaccgaaggaaaagccgcactcgttcacttcgtgatggaggagatggggtatcagatgccaaaaagcacaaccagtctgtccgtcaaggtcttgctggcatcatcgacctcccaaatgaggcaacatcggaagtggatatttctcatggatccgaggatcccagggggccaaccgattcatatcaaatgaatgggattgtaaatgaagcacataatggcagacatgcctcagtgtccaaggttgttgaattttgtgcggcgctaggtggcaaaacaccaattcacagtatactagtggccaacaatggaatggcagcagcaaagttcatgaggagtgtccggacatgggctaatgatacttttggatcggagaaggcgattcagctcatagctatggcaactccagaagacatgaggataaatgcagaacacattagaattgctgatcaatttgtagaggtgcctggtggaacaaacaataacaactatgcaaatgttcaactcatagtggaggtagcagaaagaataggtgtttctgctgtttggcctggttggggtcatgcttctgagaatcctgaacttccagatgcattgaccgcaaaaggaattgttttccttgggccacctgcggcatcaatgaatgcattgggagataaggtcggttcagctctcattgctcaagcagctggggtcccgaccctttcgtggagtggatcacatgttgaagttccattagagtgctgcttagatgcgatacctgaggaaatgtatagaaaagcttgtgttactaccacagaagaagctgttgcgagttgtcaggtggttggttatcctgccatgattaaggcatcctggggaggtggtggtaaaggaataagaaaggttcataatgacgatgaggttagagcactgtttaagcaagtacaaggtgaagtccctggctccccaatatttatcatgaggcttgcatcccagagtcgtcatcttgaagttcagttgctttgtgatcaatatggcaatgtggcagcacttcacagtcgtgattgcagtgtgcaacggcgacaccaaaagattattgaggaaggcccagttactgttgctcctcgtgagacagttaaagcgcttgagcaggcagcaaggaggcttgctaaggctgtgggttatgttggtgctgctactgttgaatacctttacagcatggagactggggaatactattttctggagcttaatcccagattacaggtcgagcatccagtcactgagtggattgctgaagtaaatcttcctgcagctcaagttgcagttggaatgggcatacctctttggcagattccagaaatcagacgtttctatggaatggactatggaggaggatatgacatttggaggaaaacagcagctcttgccacaccatttaattttgatgaagtagattctcaatggccaaagggccattgtgtagcagttagaattactagcgaggatccagatgatggtttcaaacctactggtgggaaagtgaaggagataagttttaaaagcaagcctaatgtttgggcctacttctcagtaaagtctggtggaggcattcatgaatttgctgattctcagtttgggcatgtttttgcatatgggctctctagatcagcagcaataacgaacatggctcttgcattaaaagagattcaaattcgtggagaaattcattcaaatgttgattacacagttgatctcttaaatgcttcagacttcagagaaaataagattcatactggctggcttgataccagaatagctatgcgtgttcaagctgagaggcccccatggtatatttcagtggttggaggagctctatataaaacagtaactgccaatgcagccactgtttctgattatgtcagttatctcaccaagggccagattccaccaaagcatatatcccttgtcagttcaacagttaatctgaatatcgaagggagcaaatacacagttgaaactgtaaggactggacatggtagctacagattacgaatgaatgattcagcaattgaagcgaatgtacaatctttatgtgatggaggcctcttaatgcagttggatggaaatagccatgtaatttacgcggaagaagaagctggtggtacacgacttctgattgatggaaagacatgcttgttacagaatgatcatgatccatcaaagttattagctgagacaccctgcaaacttcttcggttcttggttgctgatggtgctcatgttgatgctgatgtaccatatgcggaagttgaggttatgaaaatgtgcatgcctctcttgtcgcctgcttctggtgtcattcatgttatgatgtctgagggccaggcattgcaggctggtgatcttatagcaaggctggatcttgatgacccttctgctgtgaaaagagctgaaccatttcatggaatatttccacaaatggaccttcctgttgctgcctctagccaagtacacaaaagatatgctgcaagtttgaatgctgctcgaatggtccttgcaggatacgagcataatatcaatgaagttgtacaagatttggtatgctgcctggatgatcccgagcttcccttcctacagtgggatgaacttatgtcagttctagcaactaggcttccaagaaatcttaagagtgagttagaggataaatacatggaatacaagttgaacttttaccatgggaaaaacaaggacttcccgtccaagctgctgagagacatcattgaggcaaatcttgcatatggttcagagaaggaaaaagctacgaatgagaggcttattgagcctcttatgagcctacttaagtcatatgagggtgggagagaaagccatgctcattttgttgtcaagtcccttttcaaggagtaccttgctgtggaagaacttttcagtgatgggattcagtctgatgtgattgaaaccctgcgtcatcagcacagtaaagacttgcagaaggttgtagacattgtgttgtctcaccagggtgtgaggaacaaagctaagcttgtaacagcacttatggaaaagctggtttatccaaatcctgctgcttacagggatctgttggttcgcttttcttcactcaatcataaaagatattataagttggcccttaaagcaagcgaacttcttgaacaaactaaactaagtgaactccgtgcaagcatcgcaagaagcctttctgatctggggatgcataagggagaaatgactattgaagatagcatggaagatttagtctctgccccattacctgtcgaagatgcacttatttctttgtttgattacagtgatccaactgttcagcagaaagtgatcgagacatacatatctcgattgtatcagcctcttcttgtgaaagatagcatccaagtgaaatttaaggaatctggtgcctttgctttatgggaattttctgaagggcatgttgatactaaaaatggacaagggaccgttcttggtcgaacaagatggggtgccatggtagctgtcaaatcagttgaatctgcacgaacagccattgtagctgcattaaaggattcggcacagcatgccagctctgagggcaacatgatgcacattgccttattgagtgctgaaaatgaaaataatatcagtgatgatcaagctcaacataggatggaaaaacttaacaagatactcaaggatactagtgtcgcaaatgatcttcgagctgctggtttgaaggttataagttgcattgttcaaagagatgaagcacgcatgccaatgcgccacacattactctggtcagatgaaaagagttgttatgaggaagagcagattcttcggcatgtggagcctcccctctccatgcttcttgaaatggataagttgaaagtgaaaggatacaatgaaatgaagtatactccatcacgtgatcgtcaatggcatatctacacactaagaaatactgaaaaccccaaaatgttgcatagggtatttttccgaactattgtcaggcaacccaatgcaggcaacaagtttatatcagcccaaattggcgacactgaagtaggaggtcctgaggaatctttgtcatttacatctaatagcattttaagagccttgatgactgctattgaagaattagagcttcatgcaattaggactggtcattctcacatgtatttgtgcatattgaaagaacaaaagcttcttgatctcattccgttttcagggagcacaatcgtcgatgttggccaagacgaagctactgcttgttcacttttaaaatcaatggctttgaagatacacgaacttgttggtgcacagatgcatcatctttctgtatgccagtgggaggtgaaactcaagttgtactgcgatgggcctgccagtggcacctggagagttgtaactacaaatgttactagtcacacttgcaccattgatatctaccgggaagtggaagatactgaatcgcagaagttagtataccattcagcttctccgtcagctagtcctttgcatggtgtggccctggataatccgtatcaacctttgagtgtcattgatctaaaacgctgctctgctaggaacaacagaactacatattgctatgattttccactggcatttgaaactgccctgcagaagtcatggcagtccaatggctccagtgtttctgaaggcagtgaaaatagtaggtcttatgtgaaagcaacagagctggtgtttgctgaaaaacatgggtcctggggcactcctataatttccatggagcgtcccgctgggctcaatgacattggcatggtagcttggatcttagagatgtccactcctgaatttcccaatggcaggcagattattgtcatagcaaatgatattactttcagagctggatcatttggcccaagggaagatgcgttttttgaagctgtcacgaacctggcctgcgagaggaagcttcctcttatatacttggcagcaaactccggtgctaggattggcatagccgatgaagtgaaatcttgcttccgtgttgggtggtccgatgaaggcagccctgaacggggttttcagtacatttatctgactgacgaagactatgcccgtattagcttgtctgttatagcacacaagctgcagctggataatggtgaaattaggtggattattgactctgttgtgggcaaggaggatgggcttggtgttgagaatctacatggaagtgctgctattgccagtgcttattctagggcatatgaggagacatttacacttacatttgtgactgggcggactgttggaataggagcatatctcgctcggctcggtatacggtgcatacagcgtcttgaccagcctattattttaactgggttttctgccctgaacaagcttcttgggcgggaagtgtacagctcccacatgcagttgggtggtcctaagatcatggcgaccaatggtgttgtccacttgactgtttcagatgaccttgaaggtgtttccaatatattgaggtggctcagctatgttcctgccaacattggtggacctcttcctattacaaaacctttggacccaccagacagacctgttgcatacatccctgagaacacatgtgatccgcgcgcagccattcgtggtgtagatgacagccaagggaaatggttgggtggtatgtttgacaaagacagctttgtcgagacatttgaaggatgggcgaaaacagtggttacgggcagagcaaagcttggaggaattcctgttggtgtcatagctgtggagacacaaaccatgatgcagcttatccctgctgatccaggccagcttgattcccatgagcgatctgttcctcgggctggacaagtgtggttcccagattctgcaaccaagacagctcaggcattgttggacttcaaccgtgaaggattgccgctgttcatccttgctaactggagaggattctctggtggacaaagagatctgtttgaaggaattcttcaggctgggtcaacaattgttgagaaccttaggacatacaatcagcctgcttttgtctacattcctatggctggagagctgcgtggaggagcttgggttgtggttgatagcaaaataaatccagaccgaattgagtgttatgctgagaggactgctaaaggcaatgttcttgaacctcaagggttaattgaaatcaaattcagatcagaggagctccaagactgtatgggtaggcttgacccagagttgataaatctgaaagcaaaactccaaggtgcaaagcttggaaatggaagcctaacagatgtagaatcccttcagaagagtatagatgctcgtacgaaacagttgttgcctttatacacccagattgcaatacggtttgctgaattgcatgatacttccctcagaatggcagctaaaggtgtgattaagaaagttgtagattgggaagaatcacgttctttcttctacagaaggctacggaggaggatctctgaagatgttcttgcaaaagaaataagaggaatagctggtgaccacttcactcaccaatcagcagttgagctgatcaaggaatggtacttggcttctcaagccacaacaggaagcactgaatgggatgatgatgatgcttttgttgcctggaaggagaatcctgaaaactataagggatatatccaagagttaagggctcaaaaggtgtctcagtcgctctccgatcttgcagactccagttcagatctagaagcattctcacagggtctttccacattattagataagatggatccctctcagagagccaagttcattcaggaagtcaagaaggtcctgggttgatgaataccaacacattcaacacaatgtgtatgctacatgtttttgttcaagtacatacatagaaggatattgatcatatctgatctgaatcgaccatgatttgttaaaagttctgttggacctaattctgtggttggtatcagcacaaagcttgggggagctgagtgacagacagtcagcaagggcacaagtgaatctgtgttctggttttgcaggggtccagtaaggcacaaagttgtttcgctatagttatgtgatgtaaccagcggttcaattctgtaatttttgggtgtatcatgcggatcctagcatactgttgaggtcattaaattttgaacttgaataatatgttttgtaggcatgtgtaccactacgtgtaataaacttgttgaattagcagtctaaaaaaaaaaaaaaaaaaa

SEQ ID NO: 4875 - protein, 2321 aa, Setaria italica
MSQLGLAAAASKALPLLPNRHRTSAGTTFPSPVSSRPSNRRKSRTRSLRDGGDGVSDAKKHNQSVRQGLAGIIDLPNEATSEVDISHGSEDPRGPTDSYQMNGIVNEAHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVEVAERIGVSAVWPGWGHASENPELPDALTAKGIVFLGPPAASMNALGDKVGSALIAQAAGVPTLSWSGSHVEVPLECCLDAIPEEMYRKACVTTTEEAVASCQVVGYPAMIKASWGGGGKGIRKVHNDDEVRALFKQVQGEVPGSPIFIMRLASQSRHLEVQLLCDQYGNVAALHSRDCSVQRRHQKIIEEGPVTVAPRETVKALEQAARRLAKAVGYVGAATVEYLYSMETGEYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEISFKSKPNVWAYFSVKSGGGIHEFADSQFGHVFAYGLSRSAAITNMALALKEIQIRGEIHSNVDYTVDLLNASDFRENKIHTGWLDTRIAMRVQAERPPWYISVVGGALYKTVTANAATVSDYVSYLTKGQIPPKHISLVSSTVNLNIEGSKYTVETVRTGHGSYRLRMNDSAIEANVQSLCDGGLLMQLDGNSHVIYAEEEAGGTRLLIDGKTCLLQNDHDPSKLLAETPCKLLRFLVADGAHVDADVPYAEVEVMKMCMPLLSPASGVIHVMMSEGQALQAGDLIARLDLDDPSAVKRAEPFHGIFPQMDLPVAASSQVHKRYAASLNAARMVLAGYEHNINEVVQDLVCCLDDPELPFLQWDELMSVLATRLPRNLKSELEDKYMEYKLNFYHGKNKDFPSKLLRDIIEANLAYGSEKEKATNERLIEPLMSLLKSYEGGRESHAHFVVKSLFKEYLAVEELFSDGIQSDVIETLRHQHSKDLQKVVDIVLSHQGVRNKAKLVTALMEKLVYPNPAAYRDLLVRFSSLNHKRYYKLALKASELLEQTKLSELRASIARSLSDLGMHKGEMTIEDSMEDLVSAPLPVEDALISLFDYSDPTVQQKVIETYISRLYQPLLVKDSIQVKFKESGAFALWEFSEGHVDTKNGQGTVLGRTRWGAMVAVKSVESARTAIVAALKDSAQHASSEGNMMHIALLSAENENNISDDQAQHRMEKLNKILKDTSVANDLRAAGLKVISCIVQRDEARMPMRHTLLWSDEKSCYEEEQILRHVEPPLSMLLEMDKLKVKGYNEMKYTPSRDRQWHIYTLRNTENPKMLHRVFFRTIVRQPNAGNKFISAQIGDTEVGGPEESLSFTSNSILRALMTAIEELELHAIRTGHSHMYLCILKEQKLLDLIPFSGSTIVDVGQDEATACSLLKSMALKIHELVGAQMHHLSVCQWEVKLKLYCDGPASGTWRVVTTNVTSHTCTIDIYREVEDTESQKLVYHSASPSASPLHGVALDNPYQPLSVIDLKRCSARNNRTTYCYDFPLAFETALQKSWQSNGSSVSEGSENSRSYVKATELVFAEKHGSWGTPIISMERPAGLNDIGMVAWILEMSTPEFPNGRQIIVIANDITFRAGSFGPREDAFFEAVTNLACERKLPLIYLAANSGARIGIADEVKSCFRVGWSDEGSPERGFQYIYLTDEDYARISLSVIAHKLQLDNGEIRWIIDSVVGKEDGLGVENLHGSAAIASAYSRAYEETFTLTFVTGRTVGIGAYLARLGIRCIQRLDQPIILTGFSALNKLLGREVYSSHMQLGGPKIMATNGVVHLTVSDDLEGVSNILRWLSYVPANIGGPLPITKPLDPPDRPVAYIPENTCDPRAAIRGVDDSQGKWLGGMFDKDSFVETFEGWAKTVVTGRAKLGGIPVGVIAVETQTMMQLIPADPGQLDSHERSVPRAGQVWFPDSATKTAQALLDFNREGLPLFILANWRGFSGGQRDLFEGILQAGSTIVENLRTYNQPAFVYIPMAGELRGGAWVVVDSKINPDRIECYAERTAKGNVLEPQGLIEIKFRSEELQDCMGRLDPELINLKAKLQGAKLGNGSLTDVESLQKSIDARTKQLLPLYTQIAIRFAELHDTSLRMAAKGVIKKVVDWEESRSFFYRRLRRRISEDVLAKEIRGIAGDHFTHQSAVELIKEWYLASQATTGSTEWDDDDAFVAWKENPENYKGYIQELRAQKVSQSLSDLADSSSDLEAFSQGLSTLLDKMDPSQRAKFIQEVKKVLG

SEQ ID NO: 4876 - DNA, 3994 bp, Bos taurus
  CDS (69)..(3605)
gacttgggtgttcgctccggcaccgaggacagtgtggcctccctgggccctgcggaccagctgctgcgatgctgaagtttcagactgtccgggggagcctgaggctcctggctatccgccggacctccaccgcaaccgctgcctctcccaatgtccggcgcctggagtacaagcccatcaagaaggtcatggtggccaacagaggcgagatcgccatccgtgtgttccgggcctgcacggagctgggcatccgcacggtggctgtctactcggagcaggacacgggccaaatgcaccgacagaaagctgacgaagcctacctcatcggccggggtcttgccccggtgcaggcctatctgcacattccagacatcattaaggtcgccaaggagaacaacgtggacgctgtgcacccgggctacgggttcctgtcggagcgggccgactttgcccaggcctgccaggatgctggggtccggttcattgggccaagccccgaggtggtccgcaagataggtgacaaggtggaggcccggaccatcgccatcgccgcagatgtgcccgtggtgcccggcacgaatgcccccatcacttccctgcacgaggcccacgagttctccaacacctacggcttccccatcatcttcaaggccgcctacgggggcgggggccgcggcatgagggtcgtgcacagctacgaggagctggaggagaactacacccgggcctactcggaggctctggccgccttcgggaacggggcgctgttcgtggagaagttcatcgagaagccacgccacatcgaggtgcagatcctgggggaccagtacgggaacatccttcacctctacgagcgggactgctccatccagcggcggcaccagaaagtggtggagatcgccccggctgcccacttggacccccagctgcgcacccggctcactagcgactccgtcaagcttgcaaagcaggtgggctacgagaacgcgggcaccgtggagttcctggtggacaggcacggcaagcactacttcatcgaggtcaactcgcgcctgcaggtggagcacacggtgaccgaggagatcacagatgtggacctggtccacgcccagatccacgtggccgagggccggagcctgcctgacctgggcctccggcaggagaacatccgcatcaacggctgtgccatccagtgccgggttaccaccgaggaccctgcgcgcagcttccagcccgacaccggccgcatcgaggtgttccggagcggggagggcatgggcatccgcctggacaacgcctctgccttccaaggcgccgtcatctccccccactacgactccctgctggtcaaggtcatcgctcacggcaaggaccaccccacggacgccaccaagatgagcagagccctggccgagttccgagtccgaggcgtgaagaccaacatccccttcctgcagaacgtgctcaacaaccagcagttcctggcaggcaccgtggacacgcagttcatcgacgagaacccagagctgttccagctgcggcccgcacagaaccgggcccagaagctgctgcactacctcggacacgtcatggtgaatggcccaactactccgatccccgtcaaggccagccccagccccacggaccccatcgtccctgtggtgcccataggcccacccccaacgggtttcagagacatcctgctacgggaggggcccgagggctttgctcgagcggtgcggaaccatgaggggctgctgctgatggacacgaccttcagggacgcccaccagtcactgctggccactcgagtgcgcacccacgatctcaaaaagatctccccctatgttgcccacagcttcaacaaactcttcagcatagagaactggggaggagccacctttgacgtcgccatgcgcttcctgtacgagtgcccctggcgacggctgcaggagctccgggagctcgtccccaacatcccattccagatgctgctgcggggggccaacgccgtgggctacaccaactaccccgacaatgtggtcttcaagttctgcgaggtggccaaggagaatggcatggacatcttccgggtctttgactccctcaactacctgcccaacctgctgctgggcatggaggcggcgggcagtgctggtggcgtggtggaggccgccatctcctacacgggtgacgtgtccgaccccagccgcaccaagtactcgctgcagtactacatgggcttggccgaggagctggtgcgagccggcacccacatcctgtgcatcaaggacatggctgggctgctgaagcctacggcctgcaccatgctggtcagctccctccgggaccgcttccctgacctcccgctgcacatccacacccacgacacgtcaggggcgggcgtggcagccatgctggcctgtgctcacgcaggggctgacgtggtggatgtggcggctgactccatgtctggaatgacatcacagcccagcatgggggccctggtggcctgtacccgagggacgcccctggacacaggcgtgcccctggagcgtgtgttcgactacagcgagtactgggagggggcccgggggctgtacgcggcctttgactgcacggccaccatgaagtctggcaactcggacgtgtatgagaacgagatcccagggggccagtacaccaacctgcacttccaggcgcacagcatggggctcggctccaagttcaaggaggtcaagaaggcctacgtggaggccaaccagatgctgggcgacctcatcaaggtgacgccctcctccaagatcgtgggggacctggcccagttcatggtgcagaacgggctgacccgagctgaggccgaagcgcaggcagaggagctgtccttcccccgctcggtggtggagttcctgcagggctacatcggcatcccccacgggggcttcccagagccccttcgctccaaggtgctgaaagacctgccgagggtggagggccggccaggagcctccctcccacccctggacctgcaggcgctggagaaggagctgacggaacggcacggggaggaggtgaccccggaggacgtgctctcagccgccatgtaccccgacgtctttgcccacttcaaggacttcactgccaccttcggccccctggacagcctcaatacgcgcctcttcctgcagggacccaagattgcagaggagtttgaggtggagctggagcgaggcaagacgctgcacatcaaagccttggccataagtgacctcaaccgggcgggccagaggcaggtcttcttcgagctcaacggacagctgcggtccatcctggtcaaggacacccaggccatgaaggagatgcacttccaccccaaggccctgaaggacgtcaagggccagattggggcacccatgcccgggaaggtgatagacatcaaggtggcagcaggggccaaggtgaccaagggccaacccctgtgtgtgctcagcgccatgaagatggagactgtagtgacctcgcccgtggagggcactgtccgcaaggtccacgtgactaaggacatgacgctggagggtgacgacctcatcctggagatcgagtgaccacgctgagactggcagcctgaccatccccgcccctgccttcaggacactgtgctgccagggcaggcccaggccggccagtgcccgaggccaggaaggcctggccctgcagctcctgtccgcggctcttcacggcaggacagactgcctgtggcggtccattcccacctcccaccatctgtcctttccctgcggtcgacagtcgctcacgtattcatctcctgccaaataaaggtcccctccttgctggagactgcaggtgggcctggggcccgtgggagcagacctaggggtgctacctcctgcaggggagacctgaggcccaggttgaagaactttgctcaataaaactggcttccccgccctccaaaaaaaaaaaaaaaaaaaaa

SEQ ID NO: 4877 - protein, 1178 aa, Bos taurus
MLKFQTVRGSLRLLAIRRTSTATAASPNVRRLEYKPIKKVMVANRGEIAIRVFRACTELGIRTVAVYSEQDTGQMHRQKADEAYLIGRGLAPVQAYLHIPDIIKVAKENNVDAVHPGYGFLSERADFAQACQDAGVRFIGPSPEVVRKIGDKVEARTIAIAADVPVVPGTNAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTDATKMSRALAEFRVRGVKTNIPFLQNVLNNQQFLAGTVDTQFIDENPELFQLRPAQNRAQKLLHYLGHVMVNGPTTPIPVKASPSPTDPIVPVVPIGPPPTGFRDILLREGPEGFARAVRNHEGLLLMDTTFRDAHQSLLATRVRTHDLKKISPYVAHSFNKLFSIENWGGATFDVAMRFLYECPWRRLQELRELVPNIPFQMLLRGANAVGYTNYPDNVVFKFCEVAKENGMDIFRVFDSLNYLPNLLLGMEAAGSAGGVVEAAISYTGDVSDPSRTKYSLQYYMGLAEELVRAGTHILCIKDMAGLLKPTACTMLVSSLRDRFPDLPLHIHTHDTSGAGVAAMLACAHAGADVVDVAADSMSGMTSQPSMGALVACTRGTPLDTGVPLERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLTRAEAEAQAEELSFPRSVVEFLQGYIGIPHGGFPEPLRSKVLKDLPRVEGRPGASLPPLDLQALEKELTERHGEEVTPEDVLSAAMYPDVFAHFKDFTATFGPLDSLNTRLFLQGPKIAEEFEVELERGKTLHIKALAISDLNRAGQRQVFFELNGQLRSILVKDTQAMKEMHFHPKALKDVKGQIGAPMPGKVIDIKVAAGAKVTKGQPLCVLSAMKMETVVTSPVEGTVRKVHVTKDMTLEGDDLILEIE

SEQ ID NO: 4878 - DNA, 1530 bp, Acidianus brierleyi
  CDS (1)..(1530)
atgccgccttttagtagagttttagttgcgaacagaggagaaatagctaccagagtgcttaaggcgataaaagaaatgggaatgactgcaattgcagtatattctgaggcagataaatacgccgttcatacaaaatatgctgatgaagcttattatattggtaaggctcctgcgttagatagctatcttaatattgaacatataatagacgctgctgaaaaagctcatgttgacgcaattcatcctggatacggatttttatcagagaatgcagaattcgcagaagcagtagaaaaagctggcataacgtttatcggtccttcatccgaggtcatgagaaaaataaaggataaactagatggaaaaagattagcaaatatggcaggagttcctacagctcctggatcagacggccctgttacctctatagacgaagcgttaaagttagctgaaaaaataggatacccaataatggttaaggctgctagcggaggtggaggtgtaggtataacaagagtagataatcaggatcaattaatggacgtttgggaaagaaataaaagattagcttatcaagcctttggaaaagcagacttatttatagaaaaatacgctgtaaatcctaggcatatagaatttcaattaataggagataaatatggtaattatgtagtagcttgggaaagagaatgtactattcagaggagaaatcaaaaactaatagaggaagcgccatctcctgctcttaaaatggaagaaagagaatctatgtttgagccaatcataaaatttgggaaattgataaactattttacattaggtacatttgaaactgctttttcggacgtttctagagatttctactttttagaactcaataagagattacaagttgaacatcctaccacagagcttatatttaggatagatttggtaaaactgcagataaaacttgctgcaggagagcatctgccttttagccaagaggatctaaacaagagagttagaggaacagcaatagaatatagaataaatgcagaagacgctttaaataattttactggaagttccggatttgtaacatattatagggagcctacagggcctggcgttagagtagatagtggaatagaatctggtagctacgttcctccatattacgattccctagtatctaaattaatagtttatggggaaagtagagaatatgctatacaagccggaataagagcgttagctgactataaaataggaggaataaaaactactatagagctttataaatggataatgcaagatccagattttcaagaaggaaaattcagtacttcgtatatttcacaaaaaactgatcaatttgtaaaatatttgagagaacaagaggagataaaagcagccatagctgcagaaattcagagtagaggacttttgagaacaagcagcactgataacaaaggtaaagcccaaagtaagtctggttggaagacttacggtataataacgcaatcttctacgagggtgatgtggtaa

SEQ ID NO: 4879 - protein, 509 aa, Acidianus brierleyi
MPPFSRVLVANRGEIATRVLKAIKEMGMTAIAVYSEADKYAVHTKYADEAYYIGKAPALDSYLNIEHIIDAAEKAHVDAIHPGYGFLSENAEFAEAVEKAGITFIGPSSEVMRKIKDKLDGKRLANMAGVPTAPGSDGPVTSIDEALKLAEKIGYPIMVKAASGGGGVGITRVDNQDQLMDVWERNKRLAYQAFGKADLFIEKYAVNPRHIEFQLIGDKYGNYVVAWERECTIQRRNQKLIEEAPSPALKMEERESMFEPIIKFGKLINYFTLGTFETAFSDVSRDFYFLELNKRLQVEHPTTELIFRIDLVKLQIKLAAGEHLPFSQEDLNKRVRGTAIEYRINAEDALNNFTGSSGFVTYYREPTGPGVRVDSGIESGSYVPPYYDSLVSKLIVYGESREYAIQAGIRALADYKIGGIKTTIELYKWIMQDPDFQEGKFSTSYISQKTDQFVKYLREQEEIKAAIAAEIQSRGLLRTSSTDNKGKAQSKSGWKTYGIITQSSTRVMW

SEQ ID NO: 4880 - DNA, 1368 bp, Xylella fastidiosa
  CDS (1)..(1368)
atgttagacaaagtcgttattgccaaccgtggtgagatcgcgttgcgtattcttcgcgcatgccacacgttgggtatccgcacggttgcggtgcactctaccgttgatcgtaatctgaagcatgtcgcgatggctgatgagtcggtgtgtattggtcctgcaccatcggcggagagttatctcaatattccggcgctgattgccgccgctgaggtcacggatgctcaggccatccaccctggctatggttttttgtcggaaaacgctagttttgctgaacgtgtggaacagtcgggcttcattttcattgggccacgggcagagacgattcgtttaatgggcgacaaggtgcaggctatccatgcgatgaaagcggctggtgtgccgtgtgtccctggttcggatggtccattgggtgatgacattgtcgctaacgtcaaaattgcacgtgagatcggttatccggtcatcattaaggcttccggcggaggcggtggacgcgggatgcgtgtggtacataccgaggccggtttagaggcggctatcgagaccacgcagtgtgaagctaaagccgcttttggcaatggccaggtgtatatggaaaagtttctggagaatccgcgtcacgtggagattcaggtgctcgccgatggtcaggggaacgcgatccatttgggggagcgggattgttcgatgcaacgccgccatcagaaggtggtggaggaagcccccgcacccggtatcactgaggcgctgcgcaatgaaatcggtcaggtgtgtgtagatgcctgtattcgtatcggttaccgcggtgctgggacgtttgaatttctgttcgagaatggtcgtttttacttcatcgagatgaatacgcgcatccaggtagagcatccggtgacggagcgtatcactggtattgacttggtatgcgagcagttgcgtattgccgctggtcagccattgagtatcaagcagagcgatgtggtgttgcgtggccatgcgatcgaatgccgtatcaatgctgaggatgcggagacgttcttgcccaatccgggtttgattactgcgttccatccaccaggtggtccgggtgtgcgtatggatacgcatatctacagtggttacaaggtgccgccgaactatgattcgatgatcggcaagcttatcgtgcatggtccggaccgtgagacggcgattgcgcgcatgcatttggcgctgagcgaaatggtcgtggatgggatcaagaccaatatcccattgcagcagcgcattatgtgcgataagggtttccagtccggtggacagaacatccattatttggagaagtgtttggcggagcgtaagaaccaaacgatcgggcggacctga

SEQ ID NO: 4881 - protein, 455 aa, Xylella fastidiosa
MLDKVVIANRGEIALRILRACHTLGIRTVAVHSTVDRNLKHVAMADESVCIGPAPSAESYLNIPALIAAAEVTDAQAIHPGYGFLSENASFAERVEQSGFIFIGPRAETIRLMGDKVQAIHAMKAAGVPCVPGSDGPLGDDIVANVKIAREIGYPVIIKASGGGGGRGMRVVHTEAGLEAAIETTQCEAKAAFGNGQVYMEKFLENPRHVEIQVLADGQGNAIHLGERDCSMQRRHQKVVEEAPAPGITEALRNEIGQVCVDACIRIGYRGAGTFEFLFENGRFYFIEMNTRIQVEHPVTERITGIDLVCEQLRIAAGQPLSIKQSDVVLRGHAIECRINAEDAETFLPNPGLITAFHPPGGPGVRMDTHIYSGYKVPPNYDSMIGKLIVHGPDRETAIARMHLALSEMVVDGIKTNIPLQQRIMCDKGFQSGGQNIHYLEKCLAERKNQTIGRT

SEQ ID NO: 4882 - DNA, 2115 bp, Vibrio parahaemolyticus
  CDS (1)..(2115)
atgcatttttcgaaaaacgcgccgccaattggaggaatcatgtttaaaagaatactgatcgcaaaccgcggtgaaattgcctgccgaatcattaaaaccgcaaaaagcatggctatagagacggttgccgtctattccgaagcggatcgcagcagcttacatgtaaaacaggcggatttcgctgaattcattggccctgctccggcgattgaatcgtatctcgatatcaatgcgatcatcgacgcagcgaaaaaatggcaagccgatgctattcaccctgggtatggttttctttccgagaacccgaaactagccaaagcgtgcagtgaaaatggcatcgtttttattggcccttccaccagcgcaattgaagcgatgggctcgaagtcgcaagccaaagccatcatgtcagaggcgaacgtgcctttggttccgggctatcacggcacagacaacagcgttgatcacttattagcggaagcggaaaaaatcggttacccagtgatgctcaaagcaacccaaggtggcggcggtaaaggcatgcgagtggtcaatagcgcagccgaaatgccgctggcaatcgacggtgcgcagcgtgaagcactttcaagttttggcgataagcagcttcttgttgaaaaatgcatattgcagcctcgccacgttgaagttcaggtatttgctgaccaacatggcaactgtgtttatctgtctgatcgcgattgttccattcaacgtcgtcaccaaaaagttgtggaagaagcacctgcccccggtcttagtgatgaactgcgaaaacaaatgggtgaagccgcagttcaggccgctcaagcgatcgattatgttggcgctggtacggttgaattcttgctcgatagccgaggtcaattctacttcatggaaatgaatacccgtctgcaagttgagcaccctgtcactgaattgatcactggcgttgatttagttgaatggcaattcaaagttgcggctggtgagcatttaccaatttcgcaatacgaaatcactcataacggacactcaatcgagctacgaatttacgccgaagacgcagacaacgactttatgccgtcgactggatgcattgattatttacaagaacccatctcggacaacaatgttcgactagcttgtgtgcgtgttgatagtggtgttacccaaggcgataccatcagcgaatactacgatccgatgatcagcaaactgatcgtctgggggcaaactcgtgatatcgccctaaaacagcttaaacaggcgttgactcaatatcacgtgcgtggagtgacaacaaacatcggttatctgcacagcattatttcgcagccagcctttgccgacattgagctcgatactggtttcctcgtcacacaccagcaaggcataagtgagcagcaaaacgtgtcggattctatttggctaacgttggcggcggttactcgctggaatgatctcatttcaaaatcaggcagctcaacgttacccgcgccaaccacacaaggttttaggctgtcagtttacaacgtttatcgatttaacttcacggatgccaatgccaaccatcaagtacgcttgcattattcgtctcaagagtactcgtctcagcaatcatgcactaaacatcccgagcccttcactatcgaatgtggcgaagaacgacatcaggtgacactgcttgaaaatgacaacccgtttatcgtcgatatcgataatgttcgttacacctttaacgcgcttagcgacgagcaccagacaacgctgttttatcttggtcagcaacgtacgttcgctcatcaaccaagttttgaatcaccaaaaggcaaagacgacgaacttagtccaaccgcaccactgaacggcgtgatctcggcggtcatggtaaataagggagacaaagtagcggctggcgatccgctgttagtgctcgaagcgatgaagatggaatacaccattaccgctccggtagctgcgaccgttgatgaagtgttttatcaacatggagaccaagtacagcacggttccatcctgctgcatttaatttctgcacccgataatgtctgtgaagataaggagcacgaatatgctaccagcgaaggttaa

SEQ ID NO: 4883 - protein, 704 aa, Vibrio parahaemolyticus
MHFSKNAPPIGGIMFKRILIANRGEIACRIIKTAKSMAIETVAVYSEADRSSLHVKQADFAEFIGPAPAIESYLDINAIIDAAKKWQADAIHPGYGFLSENPKLAKACSENGIVFIGPSTSAIEAMGSKSQAKAIMSEANVPLVPGYHGTDNSVDHLLAEAEKIGYPVMLKATQGGGGKGMRVVNSAAEMPLAIDGAQREALSSFGDKQLLVEKCILQPRHVEVQVFADQHGNCVYLSDRDCSIQRRHQKVVEEAPAPGLSDELRKQMGEAAVQAAQAIDYVGAGTVEFLLDSRGQFYFMEMNTRLQVEHPVTELITGVDLVEWQFKVAAGEHLPISQYEITHNGHSIELRIYAEDADNDFMPSTGCIDYLQEPISDNNVRLACVRVDSGVTQGDTISEYYDPMISKLIVWGQTRDIALKQLKQALTQYHVRGVTTNIGYLHSIISQPAFADIELDTGFLVTHQQGISEQQNVSDSIWLTLAAVTRWNDLISKSGSSTLPAPTTQGFRLSVYNVYRFNFTDANANHQVRLHYSSQEYSSQQSCTKHPEPFTIECGEERHQVTLLENDNPFIVDIDNVRYTFNALSDEHQTTLFYLGQQRTFAHQPSFESPKGKDDELSPTAPLNGVISAVMVNKGDKVAAGDPLLVLEAMKMEYTITAPVAATVDEVFYQHGDQVQHGSILLHLISAPDNVCEDKEHEYATSEG

SEQ ID NO: 4884 - DNA, 1344 bp, Vibrio parahaemolyticus
  CDS (1)..(1344)
atgctagacaaagtagtcatcgcgaaccgaggtgaaattgcacttcgtattcttcgcgcttgtaaagaattaggtattaagaccgttgctgttcactcaacagctgaccgcgatcttaagcacgtactacttgcagatgaaaccgtgtgtatcggccctgctcgtggtatcgacagctacctaaacatcccacgcatcatttctgcagcagaagtaactggcgcggtagctatccacccaggttacggcttcttgtcagaaaacgctgacttcgcagagcaagttgagcgcagtggtttcatcttcgttggtccaaaagcggacactatccgcatgatgggcgacaaagtatcagcgatcaccgcaatgaaaaaagcgggcgttccatgtgtacctggctcagacggtccactagataacgacgaagacaagaacaaagctcacgctaagcgtatcggctaccctgttatcatcaaagcatctggcggcggcggcggtcgtggtatgcgcgtagttcgtgcagaaaaagacctcgttcaagctattgctatgactcgtgcagaagcaaaagcagcattcaacaacgacatagtttacatggagaaattcctagaaaacccacgtcacgttgaagtacaagttattgctgatggtcaaggcggtgcaatccacctaggtgaacgtgactgttctatgcagcgtcgtcaccaaaaagtagtggaagaagctccagctcctggcatcactgaagagatgcgtaagtacatcggcgaacgttgtactcgtgcatgtgttgaaatcggttaccgcggcgcaggtacattcgaattcctatacgagaacggtgaattctacttcatcgaaatgaacactcgtattcaggtagaacacccagtaacagaaatggttaccggtatcgacctaatcaaagaacagcttcgcgtagcagcaggtcaaccactgtcattcactcaagatgacatcaagatccgcggccatgcgattgagtgtcgtatcaacgcagaagacccagagcgcttcctaccgtctccaggtaagattcaacgcttccacgcgccaggcggcatgggtgttcgttgggaatcgcacatctactctggttacacagtgccacctcactacgattcaatgatcggtaagctgatcacttacggtgaaaaccgtgacgtagcgattgcacgtatgaaaaatgcattgggtgagatgatcatcgaaggcattaaaactaacgtgccactgcaagtgtcaatcatgaatgatgaaaacttccaacacggcggtgcgaacattcactacctagagaagaaactaggcctacaataa

SEQ ID NO: 4885 - protein, 447 aa, Vibrio parahaemolyticus
MLDKVVIANRGEIALRILRACKELGIKTVAVHSTADRDLKHVLLADETVCIGPARGIDSYLNIPRIISAAEVTGAVAIHPGYGFLSENADFAEQVERSGFIFVGPKADTIRMMGDKVSAITAMKKAGVPCVPGSDGPLDNDEDKNKAHAKRIGYPVIIKASGGGGGRGMRVVRAEKDLVQAIAMTRAEAKAAFNNDIVYMEKFLENPRHVEVQVIADGQGGAIHLGERDCSMQRRHQKVVEEAPAPGITEEMRKYIGERCTRACVEIGYRGAGTFEFLYENGEFYFIEMNTRIQVEHPVTEMVTGIDLIKEQLRVAAGQPLSFTQDDIKIRGHAIECRINAEDPERFLPSPGKIQRFHAPGGMGVRWESHIYSGYTVPPHYDSMIGKLITYGENRDVAIARMKNALGEMIIEGIKTNVPLQVSIMNDENFQHGGANIHYLEKKLGLQ

SEQ ID NO: 4886 - DNA, 1416 bp, Pseudomonas syringae
  CDS (1)..(1416)
atgataacaaaaattctgatcgccaaccgcggagaaatcgccgtccgcatcgtgcgtgcctgtgccgaaatgggcattcgctcggtagcgatcttctccgatgcggaccggcatgccttgcacgtcaagcgggccgacgaagcctatagcattggtgccgaaccactggccggttacctgaacccgcgcaagctggtgaatctggcggtggagaccgggtgtgatgcattgcacccaggttatggttttttgtcggaaaacgctgaactcgctgacatctgcaatgaacgtggcatcaaattcatcgggccgtcggcagaagtgattcgccgtatgggcgacaagaccgaagcgcggcgcagcatgatcaaagccggtgtgccggtaacgccgggtactgaaggcaatgtggcagatatcgaagaagcgctggtcgaaggcgagcgtatcggttatccggtgatgctcaaggccacttccggtggtggggggcgcggtatccgccgttgcaacagccgccaagagctggagcaggctttccccagggtgatttccgaggcgaccaaagcctttggctcggcagaagtctttctggaaaagtgcatcgttaaccccaagcacatcgaagcgcagattctcggcgacagcttcggcaacgtggtgcacctgttcgagcgtgactgttccattcagcgccgtaaccagaagctgatcgagatcgctcccagcccgcaactgacccctgagcagcgcgcctatatcggcgatctgtcggtgcgtgcggccaaggctgtcggttacgagaacgcgggtaccgtggagtttctgctcgccgagggcgaggtgtacttcatggagatgaacacccgtgtacaggtcgagcacaccatcaccgaagaaatcaccggcatcgacattgttcgcgagcagatcagcatcgcgtccggcctgccgttgtcggtcaagcaggaagacatcattcaccgcggttttgccctgcagtttcgaatcaacgcagaagacccgaaaaacaacttcctgcccagcttcggcaagatcacccggtattacgcccccggcgggcctggcgtgcgcaccgacacggcgatttacaccggctacacgattccgccgtactacgactccatgtgcctgaagctgatcgtctgggcattgagctgggaagaggcgatggaccgcggcctgcgcgcgctggatgacatgcgcctgcaaggggtgaagaccacggctgcctattaccaggaaattctgcgcaacccggagtttcgcagcggtgagttcaataccagctttgtcgaaagccaccctgagctgaccaattactcgatcaagcgcaaacccgaagagctggccctggccatcgctgccgccattgccgcacatgcaggcttatga

SEQ ID NO: 4887 - protein, 471 aa, Pseudomonas syringae
MITKILIANRGEIAVRIVRACAEMGIRSVAIFSDADRHALHVKRADEAYSIGAEPLAGYLNPRKLVNLAVETGCDALHPGYGFLSENAELADICNERGIKFIGPSAEVIRRMGDKTEARRSMIKAGVPVTPGTEGNVADIEEALVEGERIGYPVMLKATSGGGGRGIRRCNSRQELEQAFPRVISEATKAFGSAEVFLEKCIVNPKHIEAQILGDSFGNVVHLFERDCSIQRRNQKLIEIAPSPQLTPEQRAYIGDLSVRAAKAVGYENAGTVEFLLAEGEVYFMEMNTRVQVEHTITEEITGIDIVREQISIASGLPLSVKQEDIIHRGFALQFRINAEDPKNNFLPSFGKITRYYAPGGPGVRTDTAIYTGYTIPPYYDSMCLKLIVWALSWEEAMDRGLRALDDMRLQGVKTTAAYYQEILRNPEFRSGEFNTSFVESHPELTNYSIKRKPEELALAIAAAIAAHAGL

SEQ ID NO: 4888 - DNA, 1740 bp, Pseudomonas syringae
  CDS (1)..(1740)
atgaaaaaattattgatcgccaaccgtggtgaaatcgccgtccgcatcgctcgcgcttgccgcgactacggtgtgcagtcggttgccgtctacgccgacgccgacattgacgcgctgcacgtgcgccaggccgacgaagcttattctctgaacggccaacgccctgccgagacctatctggacatcgaaaagctgctagctgtcgccaaacgcagcggggcagacgctgtgcacccaggctatggctttctgtctgagcgggccgacttcgcccgggcggtgatcaacgccggtctgatctgggtcggccccaacccggaaaccattgatgtgctgggcgacaaggtcgaggcgcgcaaactggcgcatctggtcggcgcgccattggttgccggcacacccggcccggtcgaaagcgccgcccaagtgctggcctttgccgagcagcacggtttgccgatcgccatcaaagccgctttcggcggtggcggacgcggcatgaaagtggcttggcgtcttgatgaagtcgccgaaatgttcgcttccgccgtgcgcgaagccgaagccgctttcgggcgtggcgaatgttttgttgaacagttcctcgaccgcccacgccacatcgaagcccagatcctggccgacaaacacggcaaggtcgtggttgtgggcacacgcgattgctccctgcaacgccgtaaccagaagctggtggaagaagcgccagcaccgttcatcagcgaagaacagcgtgcgcgcattcaccagtcggctcaggacatctgcgccaaagcgggctacgttggtgcgggcaccgtggagttcctgctcagccaggacggcaccctgtcgttccttgaggtcaacacgcgcttgcaggtcgagcacccagtgacagaagaaaccaccggcatcgacctggtgatcgagcaactgcgtatcgccgacggcctgccgttgtcgttcagcgaaaccccgacgccacgcggccacagctttgaatttcgcatcaacgccgaagacgcaggcaagggctttttgcccacccccgggcaaatcacagaattcctgccgccctctggccccggcgtgcgcctggacagcggcgtggtcagcggttccagcgtgccgagcaccttcgattcgatgatggccaagctgattgtcaccggtgcaactcgtgagcaggcgataacccgcgcccgtcgcgccctggcggaattcaacatcgaaggcatcgcctcagtgctgccgttccaccgggccgtgatggaccatgtcgacttcaccagcgctgaccgattcggcgtgcacacccgctggatcgagaccgacttcgccgaacagatcaccatcgccccacgcaacgcccagtcggggaacccagaagtactgcgcaccttcgtcgaaatcgacggcaagcgccacgaactgggtctgcccgcagcattgttgcgcggcatgagcctgaacgcagcaggccctgccagcgaaagcgcggccccaagcgaagcggttgatcctcaggcggtactgacaccggtggcgggcaacctgcatacctgggtcgtcgaagacggcgagtcggtcagcgccgggcaagttatcgccgtggtagaagcgatgaaaatggaaacttcgattctggccccttgtgctggcgacgttaatattacccaaccagcgggtacttactttgaagcgggctctttgatcggccgtatcaaaaccgttaattga

SEQ ID NO: 4889 - protein, 579 aa, Pseudomonas syringae
MKKLLIANRGEIAVRIARACRDYGVQSVAVYADADIDALHVRQADEAYSLNGQRPAETYLDIEKLLAVAKRSGADAVHPGYGFLSERADFARAVINAGLIWVGPNPETIDVLGDKVEARKLAHLVGAPLVAGTPGPVESAAQVLAFAEQHGLPIAIKAAFGGGGRGMKVAWRLDEVAEMFASAVREAEAAFGRGECFVEQFLDRPRHIEAQILADKHGKVVVVGTRDCSLQRRNQKLVEEAPAPFISEEQRARIHQSAQDICAKAGYVGAGTVEFLLSQDGTLSFLEVNTRLQVEHPVTEETTGIDLVIEQLRIADGLPLSFSETPTPRGHSFEFRINAEDAGKGFLPTPGQITEFLPPSGPGVRLDSGVVSGSSVPSTFDSMMAKLIVTGATREQAITRARRALAEFNIEGIASVLPFHRAVMDHVDFTSADRFGVHTRWIETDFAEQITIAPRNAQSGNPEVLRTFVEIDGKRHELGLPAALLRGMSLNAAGPASESAAPSEAVDPQAVLTPVAGNLHTWVVEDGESVSAGQVIAVVEAMKMETSILAPCAGDVNITQPAGTYFEAGSLIGRIKTVN

SEQ ID NO: 4890 - DNA, 1344 bp, Pseudomonas syringae
  CDS (1)..(1344)
atgttggaaaaagttctgatcgccaaccgcggcgaaattgccttgcgcatcttgcgtgcctgtaaagaactgggcatcaagaccgtcgctgtacactccacggcagatcgcgagttgatgcacctgggcctggcggacgaaaccgtctgcatcggtccggccccggccaacctgtcctacctgaacattccggcgatcatctcggccgctgaagtgaccggtgccacggccattcacccaggctacggtttccttgcggaaaacgccgatttcgctgaacaggttgaaaaatccggctttgccttcattggcccgaaagcagacaccatccgcctgatgggcgacaaggtttctgccaaggacgccatgaagctggccaacgtgccaaccgttccgggctccgacggcccgctgccggaagacgaggcaatcgctctgcgcatcggtcgcgaagtcggttacccggtgatcatcaaggccgccggtggcggtggtggtcgcggcatgcgtgtggtgcatcgcgaagaagacctgatcgaagccgctgcacagacccgtgcagaagctgcggcctggttcagcaacccgatggtctatctggaaaaatacctgaccaacccacgccacgtggaagtccaggtcatttccgatggccagggccaggcgattcatctgggcgaccgcgactgctcgctgcagcgccgtcaccagaaggttctcgaagaagcgccggcaccgttcatcgacgaacaggcgcgtgccgatgtactggcagcctgcgtcaaggcgtgtatcgatatcggctatcgcggtgcgggtactttcgagttcctgtacgagaatggccgtttctacttcatcgaaatgaacacccgtgttcaggtggagcacccggtgtccgagatggtcactggtatcgacatcgtcaaagagatgctcagcatcgccgccggtaacaaactgtcgtacacccaggatgacgtggtcatcaccgggcatgcgctggagtgccggatcaacgccgaagacccgaaaaccttcgtgccaagcccaggcctggtcaagcacttccatgcaccgggcggcaacggcgtacgggtcgattcgcacctgtacagcgggtacaaggttccgtcgaactacgactcgctgatcggcaaagtgatcacctggggcgcaacccgcgaagaagccatggcacgcatgcgtaatgccctggacgaaatcgtggttgacgggatcaagaccaacatcccgttgcaccgtgatctgacccgtgatgaaggcttctgcgaaggcggcgtcaacatccactacctggaacacaaactggccaatcaatag

SEQ ID NO: 4891 - protein, 447 aa, Pseudomonas syringae
MLEKVLIANRGEIALRILRACKELGIKTVAVHSTADRELMHLGLADETVCIGPAPANLSYLNIPAIISAAEVTGATAIHPGYGFLAENADFAEQVEKSGFAFIGPKADTIRLMGDKVSAKDAMKLANVPTVPGSDGPLPEDEAIALRIGREVGYPVIIKAAGGGGGRGMRVVHREEDLIEAAAQTRAEAAAWFSNPMVYLEKYLTNPRHVEVQVISDGQGQAIHLGDRDCSLQRRHQKVLEEAPAPFIDEQARADVLAACVKACIDIGYRGAGTFEFLYENGRFYFIEMNTRVQVEHPVSEMVTGIDIVKEMLSIAAGNKLSYTQDDVVITGHALECRINAEDPKTFVPSPGLVKHFHAPGGNGVRVDSHLYSGYKVPSNYDSLIGKVITWGATREEAMARMRNALDEIVVDGIKTNIPLHRDLTRDEGFCEGGVNIHYLEHKLANQ

SEQ ID NO: 4892 - DNA, 3681 bp, Pseudomonas syringae
  CDS (1)..(3681)
atgttcgacaaactgctgatcgccaaccgtggcgccattgcctgccgcattctgcggaccctgcgcactttgcaggtcaaaggtgtggccgtgtattgcgaagctgacgctgccagcttgcacctgatgcaggccgacgaagcccacagcctgggcgaaggcggcgcggccgggacgtatctggcggtggacaaaatcctcgccatcgccaaagccagcggcgccaatgccattcatccgggttacggctttctctccgaaaatgctgcatttgcccaggcctgcgaagacgccggtatcgccttcgtcggcccgacgcccgagcaactgcgggtgtttggcctcaagcacacggcccgcgcgctggcccgacaacacggcgtgccgctgctggaaggcaccgaactgctcgacagcctggaatcggccatcgccgcagcgcgtgatatcggctatccggtcatgctcaaaagcacggcgggcggcggcggtatcggcatgcgcgtgtgccgcagtgccgaggagctggcggactcgttcgaggccgtcaaacgcctcggccagaacaatttcagcgacgcgggcgtgttcatcgagaaatacatccagcgcgcccgccatctggaagtgcaggtgttcggcgacggccagggcgaggtgctggccctgggcgtgcgcgactgctcggtgcagcgccgcaaccagaaagtactggaagaaaccccggccccgaacctgccggagggcatggccgatgagctgtgcgcggcggcgatcaagctggccaaagcggtcaattatcgcagcgccgggaccgtcgagtttgtgttcgacagtgaagaccagcgcttctattttctggaagtgaacacgcgcctgcaggtcgagcacggcgttaccgaacaggtgtggggcgtcgatctggtcggctggatggtgcaactggctgccggtgatctgccgccgctcagtcagttgcaggccagcttgcaaccggtcggccatgccattcaggcgcggctgtatgccgaagacccaggccgcgatttccagccctgccccggcctgctgaccgcagtgaattttccgcctgctgatgggcatgcgctgcgcatcgatacctgggtcgaagccggttgcgaaataccgccgtatttcgacccgatgatcgccaagctgatcagctgggcgcccacccgcgatcaagccagcgccgggctggctaccgcgcttcagcatacgcgcctgtatggcgtagagaccaaccgagactacctgcgtcaaatcatcgatgacgcgcccttcgccggtggtcagccgtggacgcgttgcctggaaggtctggtgtatcgcgccgatacgttcgaggtgttaagcggcggcacgcaaaccagcgttcaggattatcccggccggctgggctactgggcggtcggtgtaccgccgtccggtccgatggacagccgcgccttgcgtcagggcaaccggctgctgggcaacgccgagggctgcgccgcgctggaaatcaccatgagcgggccgctgctgcgcttcaacacagacgcggtgatcgccgtgaccggcgcgcatattccaatcacgctggatggcgagtcctgcgccatgaacaccgcgttgctggtgcgtgccggttcgacccttgcgctgggcaccattgccggggcgggtgtacgcagttacctgtgcgtgcgtggcgggctggacgtgccggattatctgggcagcaaaagcacctttacccttggccagttcggcggtcatggcggtcgggccttacgcgcgggcgatgtgctgcatatcgcgcggttggttgatcgcactgccgggcaaaaaatcgccgatgagcaactcgacgcgctgcaagacgttcgccagattcgagtgatctacggcccgcacgccgcgccggaatacttcaccgaaagctatatcgagacgttctttgcgaccgactgggaagtgcatttcaactccagccgcaccggcgtgcgcctgatcggccccaagcctgaatgggtccgcgcggatggtggtgaggcgggtctgcatccgtccaacatccacgacaacccgtatgccattggcgcggtggattttacgggcgacatgccggtcatcctaggcccggatggcccgagcctgggcggtttcgtgtgcccggtgaccatcatcgaagcggacttgtggcagttgggacagttgaaggccggggacaaggtcaggttttatccagtgagtgtcgaggcgtgtcatgcagcaatgaactcacaaggcccgctcccacaaggtccgcttaacaccagtgggagcggacttgtccgcgaaggcactattccagacacagaaaatgcatcggatgtaccggcctcttcgcgagcaagctcgctcccacacaaggtagccagcctgcccagcccgatcattctcgacatcggtcagggcgacaaacgcctcgttgcgcggctgtccggcgacactcacctgctgctggaaatcggcgcgcccgagctggatctggtgctgcggctgcgcggccatgcgttgatgctggcgctggaagccaaggcgctggcaggggtgatcgacctgacgccgggcattcgctcgctgcaagtccactatcgccccgagcaactgccgcttgatcaactgctcgtcattattgctggcgaatgggacgccgtgtgtgcagcgaaagacctgcaagtcgcttcacgcattgtccatctgccactgtcctgggacgatccggcctgccagctggccatcgagaaatacatgaccaccgtgcgcaaggacgcgccgtggtgcccgagcaatctggagttcatccggcgcatcaacgacctgcccaacctcaacgaagtgcaacgcacggtgttcgacgccagctatctggtcatgggcctgggcgatgtgtacctgggcgcgccggttgccaccccgctggacccgcgtcaccgtctggtgaccaccaagtacaacccggcgcgtacctggactgccgaaaactcggtcggcatcggtggtgcctatatgtgtgtgtatggcatggaaggccccggcggttatcaatttgtcgggcgcacgttgcagatgtggaatcgctaccgcgaagtcgcagcctttgaaggcaagccgtggctgttgcgcttcttcgatcagatccgcttctacccggtcagcgccgatgaactgctgcgcattcgccgcgattttccgctgggccgttttgcgctgaacatcgaacacagcactctgaacctggccgattaccagacctttctgacgcgtgaagctgacggcatcgcggcgttccgcgctcaacaacagggcgcattcaacgccgaacgtgaacgctggattgccaacggccaggctgatttccaaagcgacgaaggtgtcgcgccatacatcgaagaactgccgctgcaagcgggccagcaaggcgtcgagagccacattgccggtaacctctggcaggtccaggtgcaacccggcgagcgtgtcgaagcaggcgatgtgctggtgattctggagtcgatgaagatggaaatcccgttgctcgcaccggtcgcaggcgtggtgcaggaagtgcgggtgcaacctggctcggcagtccgcgccgggcaacgggtcgtagtgctggcagcagactga

SEQ ID NO: 4893 - protein, 1226 aa, Pseudomonas syringae
MFDKLLIANRGAIACRILRTLRTLQVKGVAVYCEADAASLHLMQADEAHSLGEGGAAGTYLAVDKILAIAKASGANAIHPGYGFLSENAAFAQACEDAGIAFVGPTPEQLRVFGLKHTARALARQHGVPLLEGTELLDSLESAIAAARDIGYPVMLKSTAGGGGIGMRVCRSAEELADSFEAVKRLGQNNFSDAGVFIEKYIQRARHLEVQVFGDGQGEVLALGVRDCSVQRRNQKVLEETPAPNLPEGMADELCAAAIKLAKAVNYRSAGTVEFVFDSEDQRFYFLEVNTRLQVEHGVTEQVWGVDLVGWMVQLAAGDLPPLSQLQASLQPVGHAIQARLYAEDPGRDFQPCPGLLTAVNFPPADGHALRIDTWVEAGCEIPPYFDPMIAKLISWAPTRDQASAGLATALQHTRLYGVETNRDYLRQIIDDAPFAGGQPWTRCLEGLVYRADTFEVLSGGTQTSVQDYPGRLGYWAVGVPPSGPMDSRALRQGNRLLGNAEGCAALEITMSGPLLRFNTDAVIAVTGAHIPITLDGESCAMNTALLVRAGSTLALGTIAGAGVRSYLCVRGGLDVPDYLGSKSTFTLGQFGGHGGRALRAGDVLHIARLVDRTAGQKIADEQLDALQDVRQIRVIYGPHAAPEYFTESYIETFFATDWEVHFNSSRTGVRLIGPKPEWVRADGGEAGLHPSNIHDNPYAIGAVDFTGDMPVILGPDGPSLGGFVCPVTIIEADLWQLGQLKAGDKVRFYPVSVEACHAAMNSQGPLPQGPLNTSGSGLVREGTIPDTENASDVPASSRASSLPHKVASLPSPIILDIGQGDKRLVARLSGDTHLLLEIGAPELDLVLRLRGHALMLALEAKALAGVIDLTPGIRSLQVHYRPEQLPLDQLLVIIAGEWDAVCAAKDLQVASRIVHLPLSWDDPACQLAIEKYMTTVRKDAPWCPSNLEFIRRINDLPNLNEVQRTVFDASYLVMGLGDVYLGAPVATPLDPRHRLVTTKYNPARTWTAENSVGIGGAYMCVYGMEGPGGYQFVGRTLQMWNRYREVAAFEGKPWLLRFFDQIRFYPVSADELLRIRRDFPLGRFALNIEHSTLNLADYQTFLTREADGIAAFRAQQQGAFNAERERWIANGQADFQSDEGVAPYIEELPLQAGQQGVESHIAGNLWQVQVQPGERVEAGDVLVILESMKMEIPLLAPVAGVVQEVRVQPGSAVRAGQRVVVLAAD

SEQ ID NO: 4894 - DNA, 1353 bp, Pseudomonas syringae
  CDS (1)..(1353)
atgttcgataaagtattgatcgccaatcgcggtgaaatcgccctgcgcatattgcgcgcctgcaaaggccttggcctgcagaccgttgcggtttattccgaagcggatcgggacgccagctatgtgcaacaggccgacgaagcgctgtgcatcgggcctgctgcgccggggcagagttacctgaatcaggccgctgtgctttacgcggcccaactgaccggcgctcaggcgatccacccaggctacgggtttctctccgagaacgccgccttcgccgaacgtatcgagcaggctggcctgaccttcatcggccccagcgccgcctgtattcgcgtgatgggcgacaaggttgcggccaaacgcgcaatgcgtgaagccggtgtgccttgcgtgcccggcccggacaccagcatgcctgccgatccgcacagcattctggcgattgcccgcgacatcggctacccggtcatcgtcaaggctgctggcggcggcggtgggcggggtatgcgcgtggttcacgaagaacagcagttgctcgatgccattgcgctgaccggtgaagaagcgcgtcgggcattcggcaatcccgagctgtatatcgagaagtttctcgtccagccgcgccacgtcgaaattcaggtgctgtgtgatgcctatggcaatgccgtctggctcggttcgcgggattgctcaatgcagcgccgccaccagaaggtgcttgaagaggccccggcacctggggttgatgcggcgctgatgacccgggttggcgagcgctgcgcacaagcctgtcgccagatcggctatcagggcgtgggcacgtttgaattcctgtttgaaaacgacgagttctatttcatcgagatgaacacccgcctgcaggtcgagcatccggtcacggaaatgacctctggcatcgacatcgtccagcagcagattcgcatggcgatgggcgagcgcctgagtttcagtcaggccgacgtcagcgtctcgggccattcgctggaatgccggatcaacgccgaagacccgcgcagcttcatgccgacgccggggcaggtcactcgctggcaggtccccggtggctttggcgtgcgcgtcgattcgcatgtcagccacggttaccgggtcccgccttattacgattcgatggtggccaaagtcatcacccacggtgccagccgcgacgaggcactggcgcgcatgcgtctggcgctgagcgaaatgcacgtcgaagggatttccaccaacatcgcgctgcaccgcgacattctgcaggacccggtgttctgcaagggcggtatggacattcaccatctggagcgttggttgcagacaaggagccagccatga

SEQ ID NO: 4895 - protein, 450 aa, Pseudomonas syringae
MFDKVLIANRGEIALRILRACKGLGLQTVAVYSEADRDASYVQQADEALCIGPAAPGQSYLNQAAVLYAAQLTGAQAIHPGYGFLSENAAFAERIEQAGLTFIGPSAACIRVMGDKVAAKRAMREAGVPCVPGPDTSMPADPHSILAIARDIGYPVIVKAAGGGGGRGMRVVHEEQQLLDAIALTGEEARRAFGNPELYIEKFLVQPRHVEIQVLCDAYGNAVWLGSRDCSMQRRHQKVLEEAPAPGVDAALMTRVGERCAQACRQIGYQGVGTFEFLFENDEFYFIEMNTRLQVEHPVTEMTSGIDIVQQQIRMAMGERLSFSQADVSVSGHSLECRINAEDPRSFMPTPGQVTRWQVPGGFGVRVDSHVSHGYRVPPYYDSMVAKVITHGASRDEALARMRLALSEMHVEGISTNIALHRDILQDPVFCKGGMDIHHLERWLQTRSQP

SEQ ID NO: 4896 - DNA, 1950 bp, Pseudomonas syringae
  CDS (1)..(1950)
atgaacacgcctgaactgaccacactgctgatcgccaaccgcggggaaattgcctgccgcatcatgcgcaccgcaaaaaagatgggcctgaccacggttgccgtacacagcgctattgaccgcgacgctcgccacagtcgcgaggccgatatctgcgtcgaccttggcggcagcaaggcggctgaaagctacctggtgatcgacaagctcatcaaagcagccaaggccagcggcgcacaggcgatccatcccggttacggttttttgtctgaaaacgctgattttgcccgcgctatcgaagctgccgggctggttttcctcggcccgcccgcctcggccatcgacgcaatgggcagtaagtccgctgccaaatcgctgatggaacaggctggcgtgccgttggtaccgggctatcacggtgctgcgcaggacatcgacacattccatgcggctgccgagcgcatcggctaccccgtgctgttgaaagccacggcgggcggcggcggcaaaggcatgaaagtggtcgagcaggccagcgaaatggccgaagcgctggcctcggctcaacgtgaggcgctttcctcgtttggcgatgcgcggatgctggtggagaagtacgtcctcagcccgcgtcacgtcgagattcaggtgtttgctgatcagcagggtcattgcctgtacctcaatgagcgcgactgttccattcagcgccgccaccagaaagtcgtcgaggaagcgccagcgccgggcctgacgcctgagctgcgcaaagcgatgggtgaagcggcggtcaaagccgcgcaggccattggctacgtgggcgcgggtacggtggagtttttgctggacgcacgcggcgagttcttcttcatggagatgaacacccgcctgcaagtcgaacacccggtgactgaatacatcacagggcttgatctggtggaatggcagatccgtgtggcccgaggcgaatcgctgcctatcacccaggagcaggtccagctgatcggccatgcgatggaagtcaggctgtatgccgaagacccggccaacgattttctgcccgcaaccggcacgctgcagctctatagagaacctgccagcggccttggcaggcgtgtggacagcggcgtggccgaaggcgacagcatttcgccattttacgaccccatgctcggcaagctgattgcctggggcgaaaaccgtgaagaagcacgcctgcgcctgctcggcatgctcgacgagttcgccgtgggcggtgtcaaaaccaacctggcgtttctgcgccgcatcatcgcccatccggcgtttgccgctgcgcaactggataccggctttatcccccgccatcagaatcagttgctgccgcaaacccgtgaacccgacgagacgttctggcaagccgctggcgaagcgttcaggcagagcgagccggcacgtcttgatcaggcagccccgtactcgccgtgggccgcgatgagcggctttcgcgccggcatgcctgccgaaacggacctgcaactgagctgcgacggccaaagccgggcggttcgcttgctggataacgatgcccggctattgcgactggatggcgagcatctgcacagcgagcacgacggcgtgcgccagaaaaacctggcagtccgtcgtggcgatacgctgtatctcaaatggcagggcgtcctttacaccgtcagtaaagtcgatccgctcagccacaccgacgctgctcaaggccagcacggcggcctgactgcgcccatgaacggcagcatcgtgcgtgtgctggtcgaggtgggccagacggttgaggccggggcgcaactggtggtgctggaagcgatgaaaatggaacacagcatccgcgcagccaatgccggggtcatcaacgcgctttattgccgtgagggcgagatggtcaatgagggggcggtgctggtggagatgggttga

SEQ ID NO: 4897 - protein, 649 aa, Pseudomonas syringae
MNTPELTTLLIANRGEIACRIMRTAKKMGLTTVAVHSAIDRDARHSREADICVDLGGSKAAESYLVIDKLIKAAKASGAQAIHPGYGFLSENADFARAIEAAGLVFLGPPASAIDAMGSKSAAKSLMEQAGVPLVPGYHGAAQDIDTFHAAAERIGYPVLLKATAGGGGKGMKVVEQASEMAEALASAQREALSSFGDARMLVEKYVLSPRHVEIQVFADQQGHCLYLNERDCSIQRRHQKVVEEAPAPGLTPELRKAMGEAAVKAAQAIGYVGAGTVEFLLDARGEFFFMEMNTRLQVEHPVTEYITGLDLVEWQIRVARGESLPITQEQVQLIGHAMEVRLYAEDPANDFLPATGTLQLYREPASGLGRRVDSGVAEGDSISPFYDPMLGKLIAWGENREEARLRLLGMLDEFAVGGVKTNLAFLRRIIAHPAFAAAQLDTGFIPRHQNQLLPQTREPDETFWQAAGEAFRQSEPARLDQAAPYSPWAAMSGFRAGMPAETDLQLSCDGQSRAVRLLDNDARLLRLDGEHLHSEHDGVRQKNLAVRRGDTLYLKWQGVLYTVSKVDPLSHTDAAQGQHGGLTAPMNGSIVRVLVEVGQTVEAGAQLVVLEAMKMEHSIRAANAGVINALYCREGEMVNEGAVLVEMG

SEQ ID NO: 4898 - DNA, 1416 bp, Pseudomonas putida
  CDS (1)..(1416)
atgataaaaaaaatcctgatcgccaaccgaggtgaaatcgcagttcggatcgtgcgtgcttgcgccgagatgggcattcgctcggtagcgatcttttccgacgccgaccggcatgccttgcacgtcaagcgcgctgacgaagcacacagcatcggtgccgagccgctggccggttacctcaacccgcgcaagctggtgaacctggctgtggaaaccggctgtgatgccctgcacccaggctacggtttcctttcggaaaacgctgaactggcagaaatttgcgccgagcgcgggatcaagttcatcggcccggccgccgacgtgattcgccgtatgggcgacaagaccgaagcgcgccgcaccatgatcgccgccggtgtgccggtaaccccgggcaccgaaggtaacgttgccgatattcatgaagccctgagcgaaggtgaccgcatcggttatccggtgatgctcaaggccacctccggtggtggcggccgtggtattcgccgttgcaatagccgcgaagaactggaacagaacttcccacgggtcatttccgaggcgaccaaggcattcggttcggccgaagtgttcctggagaaatgcatcgtcaaccctaagcacatcgaggcgcaaattctcggtgacagcttcggtaacgtagtgcacctgttcgagcgcgactgctctatccagcgccgtaaccagaagctcatcgaaattgcccccagcccacagctcactcctgagcagcgcgcctacatcggcgacctggcggtgcgtgcggccaaagcggtgaattacgagaacgccggtaccgtggagttcctgctcgccgatggcgaagtgtacttcatggaaatgaacacccgggtgcaggtggaacacactattaccgaggaaatcaccggtatcgacatcgttcgtgagcagatccgcatcgcctcggggctgccactgtcggtcaagcaggaagacattcagcaccgcggctacgccctgcagttccgtatcaatgctgaagacccgaaaaacaacttcctgcccagcttcggcaagatcacccgttactacgcccccggcggcccgggcgtgcgcaccgacacggcgatctacaccggctataccattccaccgttctacgactccatgtgcctgaaactggtggtgtgggcgttgacctgggaagaagccatggaccgcggcctgcgggccctggacgacatgcgcgtgcaaggggtgaagaccaccgccgcgtactaccaggaaatcctgcgcaatccggaattccgtagcggccagttcaataccagctttgtcgaaagccaccctgaattgaccaactactcgatcaagcgcaaacccgaagagctggccctggccatcgccgccgccatcgccgcccacgcaggcctgtag

SEQ ID NO: 4899 - protein, 471 aa, Pseudomonas putida
MIKKILIANRGEIAVRIVRACAEMGIRSVAIFSDADRHALHVKRADEAHSIGAEPLAGYLNPRKLVNLAVETGCDALHPGYGFLSENAELAEICAERGIKFIGPAADVIRRMGDKTEARRTMIAAGVPVTPGTEGNVADIHEALSEGDRIGYPVMLKATSGGGGRGIRRCNSREELEQNFPRVISEATKAFGSAEVFLEKCIVNPKHIEAQILGDSFGNVVHLFERDCSIQRRNQKLIEIAPSPQLTPEQRAYIGDLAVRAAKAVNYENAGTVEFLLADGEVYFMEMNTRVQVEHTITEEITGIDIVREQIRIASGLPLSVKQEDIQHRGYALQFRINAEDPKNNFLPSFGKITRYYAPGGPGVRTDTAIYTGYTIPPFYDSMCLKLVVWALTWEEAMDRGLRALDDMRVQGVKTTAAYYQEILRNPEFRSGQFNTSFVESHPELTNYSIKRKPEELALAIAAAIAAHAGL

SEQ ID NO: 4900 - DNA, 1953 bp, Pseudomonas putida
  CDS (1)..(1953)
atgagccgccccgctttgaccaccctgctggtcgccaaccgcggcgaaatcgcctgccgggtgatgcgcaccgccaaggccatgggcctgaccactgtcgccgtgcacagcgccaccgaccgtgacgcccgtcacagccgcgaagccgacatccgcgtcgacctgggcggcaccaaggctgccgaaagctacctgctggtcgacaagctgctggccgcagccaaggccagcggcgcccaggccattcacccaggttatggctttctgtctgagaacgcaggtttcgcccgcgccatcgagcaggccgggctgatcttcctcggcccaccggccagcgccatcgacgccatgggcagcaaatcggcagccaaggcgctgatggaagcggccggcgtgccgttggtgccgggctaccacggcgaggcccaggacctggacaccttccgcgctgcggccgaacgcatcggctacccggtgctgctcaaggccagcgcgggaggcggtggcaagggcatgaaagtggtcgaggaagaaagccaactggccgacgccctggcctcggcccagcgtgaggcacagtcgtcgttcggcgatgcgcgcatgctggtggaaaagtacgtgctcaagccacgccacgtggagattcaggtgttcgccgatcagcacggcaactgcctgtacctcaacgaacgcgactgttccattcagcgccgccatcagaaggtggtggaagaggcccctgcccccggcctgtcgcccgaactgcgccgggccatgggcgaagcggcggtgcgtgccgcccaggctatcggttacgtgggtgccggcacggtggagtttctgcttgatgcccgcggcgaattcttcttcatggagatgaacactcgcctgcaagtggaacacccggtcaccgaggccataaccggcctggaccttgttgcctggcaaattcgcgtggcctgcggcgaagccctgccgatcacacaggaacaggtaccgctgatcggccatgccatcgaagtacgcctgtatgccgaagacccggccaacgattttttacccgcgaccggcaaattagcgctgtaccgtgaatcggcacctggcgaaggccggcgggtggacagtggggtcagcgaaggcgatgtggtgtcgccgttctacgacccgatgctgggcaagctgatcgcctggggcgaagaccgcgagcaggcgcgtttgcgcttgctggccatgctcgatgagttcgccattggcgggctgaaaaccaacattgccttcctgcggcgcattctcgcccacccggcatttgctgcagcggagttggatactggcttcattccccgccaccaggatgtgctgctgccggcgccacgtgcgctgccggctgccttttgggaggcggcagccgaagcctggctgcagggccaggcggggcatcagcgcgaagacgatcgccattcgccgtggagcgggagtaatggcctgcgcttgggcctaccggcacgcagcagcttgcatctggtgagcgctgggcaagatcaggcagtggccctggaacgcagcgctgcttctacctggcagctgcaaggtgagcagttggtgcatgaccagaacggcgtgcgtcgccagcatctggcaatccgtcgcggtggcacgctgtacctgcactgggagggcgaaatgcatgccatcgaagctttcgacccgattgccgaggccgaagccagccacagccatcagggtgggctgggtgcgcccatgaacggcagtatcgtgcgggtgctggtcgaacctggccaggtggtggaagccggtactgcgctgttggtactggaggccatgaagatggagcacagcattcgtgcgccgcatgccggcacggtgaaggcgctgttttgcctggagggggatatggtcagcgaagggactgtgctggtcgaactggtggaataa

SEQ ID NO: 4901 - protein, 650 aa, Pseudomonas putida
MSRPALTTLLVANRGEIACRVMRTAKAMGLTTVAVHSATDRDARHSREADIRVDLGGTKAAESYLLVDKLLAAAKASGAQAIHPGYGFLSENAGFARAIEQAGLIFLGPPASAIDAMGSKSAAKALMEAAGVPLVPGYHGEAQDLDTFRAAAERIGYPVLLKASAGGGGKGMKVVEEESQLADALASAQREAQSSFGDARMLVEKYVLKPRHVEIQVFADQHGNCLYLNERDCSIQRRHQKVVEEAPAPGLSPELRRAMGEAAVRAAQAIGYVGAGTVEFLLDARGEFFFMEMNTRLQVEHPVTEAITGLDLVAWQIRVACGEALPITQEQVPLIGHAIEVRLYAEDPANDFLPATGKLALYRESAPGEGRRVDSGVSEGDVVSPFYDPMLGKLIAWGEDREQARLRLLAMLDEFAIGGLKTNIAFLRRILAHPAFAAAELDTGFIPRHQDVLLPAPRALPAAFWEAAAEAWLQGQAGHQREDDRHSPWSGSNGLRLGLPARSSLHLVSAGQDQAVALERSAASTWQLQGEQLVHDQNGVRRQHLAIRRGGTLYLHWEGEMHAIEAFDPIAEAEASHSHQGGLGAPMNGSIVRVLVEPGQVVEAGTALLVLEAMKMEHSIRAPHAGTVKALFCLEGDMVSEGTVLVELVE

SEQ ID NO: 4902 - DNA, 1356 bp, Pseudomonas putida
  CDS (1)..(1356)
atgtctgggaagctcgaaaaagtcctgatcgccaaccgcggggaaattgccctgcggatcctgcgtgcctgcaaagagctgggtatcaagaccgtcgccgtgcactccactgccgaccgtgaactgatgcacctgggcctggcagacgagtcggtctgcatcggccctgcatcgtccaaggattcctacctgcatatccccgcgatcatcgctgccgccgaagtgactggcgccactgcgattcacccgggttacggcttcctggcggaaaacgccgacttcgccgaacaggtggaaaaatccggtttcgccttcatcggcccgaaagccgacaccattcgcctgatgggcgacaaggtttcggccaaggacgcgatgatcaagtcgggcgtaccgaccgtaccgggctccgatggcccactgccagaagacgaagaagttgccctggcgattgcccgtgacgtcggctacccggtgatcatcaaggccgccggtggcggtggtggtcgcggcatgcgcgtggtgcacaaggaagaggacctgatttcctcggccaagctcacccgtaccgaagccggtgcagccttcggcaacccgatggtttacctggagaagttcctgaccaacccacgccacgtggaagtacaggtactgtccgacggccagggcaacgccattcacctgggcgaccgcgactgctcgctgcagcgccgtcaccagaaagtactggaagaagcaccagccccgggcatcgatgagaaagcccgtcaggaagtgttcaagcgctgcgtcgatgcgtgcatcgagatcggctaccgtggtgccggtactttcgagttcctgtacgaaaacggccgcttctacttcatcgagatgaacacccgcgtgcaggttgagcacccggtgtcggagatggtcactggtatcgacatcgtcaaggagatgctgagcatcgccgctggcaacaagctgtcgttccgccaggaagacgtggtgatccgtggccactcgctggagtgccggatcaacgccgaagacccgaagaagttcatcccgagcccaggcaaggtgaagcacttccacgccccgggcggcaacggcgtacgcgtcgattcgcacctgtacagcggttattcggttccgccgaactacgactcgctgatcggcaagctgatcacctacggcaaggaccgcgacgaggccatggcgcgcatgcgcaatgccctggacgagatcgtcgtcgacggcatcaagaccaacatcccgctgcaccgcgacctggtgcgtgatgaaggcttctgcaaaggcggcgtcaacattcactacctcgagcacaaactggccaaccaggagtag

SEQ ID NO: 4903 - protein, 451 aa, Pseudomonas putida
MSGKLEKVLIANRGEIALRILRACKELGIKTVAVHSTADRELMHLGLADESVCIGPASSKDSYLHIPAIIAAAEVTGATAIHPGYGFLAENADFAEQVEKSGFAFIGPKADTIRLMGDKVSAKDAMIKSGVPTVPGSDGPLPEDEEVALAIARDVGYPVIIKAAGGGGGRGMRVVHKEEDLISSAKLTRTEAGAAFGNPMVYLEKFLTNPRHVEVQVLSDGQGNAIHLGDRDCSLQRRHQKVLEEAPAPGIDEKARQEVFKRCVDACIEIGYRGAGTFEFLYENGRFYFIEMNTRVQVEHPVSEMVTGIDIVKEMLSIAAGNKLSFRQEDVVIRGHSLECRINAEDPKKFIPSPGKVKHFHAPGGNGVRVDSHLYSGYSVPPNYDSLIGKLITYGKDRDEAMARMRNALDEIVVDGIKTNIPLHRDLVRDEGFCKGGVNIHYLEHKLANQE

SEQ ID NO: 4904 - DNA, 3435 bp, Lactobacillus plantarum
  CDS (1)..(3435)
atggtgaagaaagtattaattgctaaccgtggtgaaattgcgacccgggtcattcgtgcttgccacgaattaggccttcagactgttgcgatttacgccaaagaagatgagttttcagttcaccgttttaaagctgatgaagcgtacttagtaggtgagggtaaggcgccgattgcggcttacctggatattgaagatattattcgcattgctaaagaaaatcatgtggatgcgattcacccaggttacggctttttatctgaaaatgctacttttgctcggcggattgctgaagaaggcatgaccttcgttggtcctaagccagagcacctcgagatgtttggtgataagattacggccaaacgtgtagctcgcgatgccggcgtgcagacgattccgagtaccttgcacccggttactagcctgaacgaggcgttacaatttactcagcaatacggttatccaattatgatcaaagctgccatgggtggtggtggtcggggaatgcgcatcgttcacgaagcttctgaattacaagaagcttttgaccgtgcccgttcagaggccatgcaatcctttggtgatgacgagatttacttggaaaaattcatcgcgaatcccaaacacattgaagtccagattttagcggatgctcacggcaatgtcatgcatttatttgaacgtgactgttctgttcagcgccgtaatcaaaaggtgattgaatttgcaccggccgtggccctgccaatcgagttgcgtcaaaagatctgtaacgccgcagtcgacttgatgaagagtgtacactatttaaacgccgcaacggttgaattcttggttgaaggggaccaattctacttcatggaagttaatccgcgggttcaagttgaacatacggtgacagaaatgattaccgaaatcgatattgtccatgctcagctcaaaattgcgatgggtggtgacctattcgaggatttacggttaccacatcaagacgcattgacatataagggtgcggcaattcagtgtcgaattacgacggaagatcccgcaaatgattttatgccagatactggtcgcatcgagacgtaccggtcaccaggtggtaatggggttcgtttggatgctggtaatacctattccggcgcaatcgtaacgccttattttgattcactgcttgtaaaggcttgtgttgcggcgcggaacttcaaagcggccgttcataaaatgcgacgcgtcctagttgaattcgatattcgcggcgtgaagacgaacattccgtttatgctgaatgtgattgacaacccaacgttccaagcaggtgaagcggggacccggtttattgatcagaccccaacgctcttcaaattccctgacgatacgcaacgtgaagataagatgttgaagtatattgggaatgtgacggtcaatggtttcgctgacgttgcccaacattcgaagaagtactatccggacgttgagtttaaggatgattttcaaccgatcgcacccgacatcgtcacggcaaaagacgtgttggatcaacaaggtgtccagggattacaacagtggttgttagcccagaagcaagtgttattaacagatacgaccatgcgggatgcgcatcagagtttatttgcaacgcggatgcggacgaaggatatgttagccgttgccgcggcttcacaaaaagcgttgccacagttattctcctatgagatgtggggtggtgcgacgttcgatgtggcctatcgttttctaaatgaaaatccctggaatcggctgaaagaacttcggcaggcaatgccccggacactcttccaaatgttgttccgtggttccaatgcggtgggttaccagaactatccagataatgtgattcgcgaatttatcttagaagcagctaagagtggcattgatgttttccgcatttttgacagtttgaattggattcctcaaatggaaaagagtattcaggccgtcaaggaaaccgggaagattgcggaagccacgatttgttatacgggcgacattatggaccctgaccggcaaaaatacaatcttgattattaccgtcagctggccttggatctgcaatcaactggtgccgatattattgccatcaaggatatggcgggtgtgttaaagccagaggccgcctatgaattagtatcgacgttgaaagacgcgctgtccgtgccagttcatctgcatacgcatgatacgactggtaatggaatctttacctatgcccgagcagtggaagctggtgttgacgtggtcgatgttgctgcgagtgcgctatcaggcacgaccagccaaccatcaatgagttcgttgtattacgcattagcccacaatgatcgtcaacctgatgttgatattaacaacgttgaagccatcaatcggtattggcaaggcgtacggccatactaccaagacttctcgaacggtatgaccggaccacagacagatatttatcagacgcagatgccgggtggacaatattctaacttgcagcaacaagctaaggctgttggtctcggggatcgttgggaagaagttaagacgatgtatgcgacggtcaatgatatgtttggtgatattatcaaagttacgcccagctctaaagttgttggtgacatggccctgttcatgatggaaaatcacttgacaccggacgatgtttataatcagggtaccaagctcgatttcccagcatcggtcatcaacttctttgctggcaatcttggtcaaccagtcggaggctttccaaagaagctccagcagatcgtcttgaaaggccagccagcgttgactgtgcggcccggtagtttagccaaaccagctgactttgctgcggtcaaagcagagctatcggctaagcttggccatgaagcgagccatcaggaagtgctcagctacatcctgtatccgaaagtattcatggattacgacgctagccataagcgctacgggcacgtatcactgttagacacaccgacctttttccaaggcatgcggctcggtgagacggtcaatattgagttagccaaaggtaagacgatgatcgtcaagcttaatcagattagtgatcccgatgtcgatggtgtccggacactttactttagtatcaatggtcaaaatcaagagattatggtcaaggacaatgccattcaccaatcggcaaccagcacgcgcaaggcggaaccaactaatgaagatgaagttggcgcaacgatgagtggttcagttctgaaactgttagttaagaagggccaaacggttaagaaaggtgagccattacttgtgacggaagcaatgaagatggagacaaccattcaggcaccggaagatggggtcatcgaacatatttatgttaatgcgggtgacgtcattcagacggatgacttactgctcgagattgcaccacaataa

SEQ ID NO: 4905 - protein, 1144 aa, Lactobacillus plantarum
MVKKVLIANRGEIATRVIRACHELGLQTVAIYAKEDEFSVHRFKADEAYLVGEGKAPIAAYLDIEDIIRIAKENHVDAIHPGYGFLSENATFARRIAEEGMTFVGPKPEHLEMFGDKITAKRVARDAGVQTIPSTLHPVTSLNEALQFTQQYGYPIMIKAAMGGGGRGMRIVHEASELQEAFDRARSEAMQSFGDDEIYLEKFIANPKHIEVQILADAHGNVMHLFERDCSVQRRNQKVIEFAPAVALPIELRQKICNAAVDLMKSVHYLNAATVEFLVEGDQFYFMEVNPRVQVEHTVTEMITEIDIVHAQLKIAMGGDLFEDLRLPHQDALTYKGAAIQCRITTEDPANDFMPDTGRIETYRSPGGNGVRLDAGNTYSGAIVTPYFDSLLVKACVAARNFKAAVHKMRRVLVEFDIRGVKTNIPFMLNVIDNPTFQAGEAGTRFIDQTPTLFKFPDDTQREDKMLKYIGNVTVNGFADVAQHSKKYYPDVEFKDDFQPIAPDIVTAKDVLDQQGVQGLQQWLLAQKQVLLTDTTMRDAHQSLFATRMRTKDMLAVAAASQKALPQLFSYEMWGGATFDVAYRFLNENPWNRLKELRQAMPRTLFQMLFRGSNAVGYQNYPDNVIREFILEAAKSGIDVFRIFDSLNWIPQMEKSIQAVKETGKIAEATICYTGDIMDPDRQKYNLDYYRQLALDLQSTGADIIAIKDMAGVLKPEAAYELVSTLKDALSVPVHLHTHDTTGNGIFTYARAVEAGVDVVDVAASALSGTTSQPSMSSLYYALAHNDRQPDVDINNVEAINRYWQGVRPYYQDFSNGMTGPQTDIYQTQMPGGQYSNLQQQAKAVGLGDRWEEVKTMYATVNDMFGDIIKVTPSSKVVGDMALFMMENHLTPDDVYNQGTKLDFPASVINFFAGNLGQPVGGFPKKLQQIVLKGQPALTVRPGSLAKPADFAAVKAELSAKLGHEASHQEVLSYILYPKVFMDYDASHKRYGHVSLLDTPTFFQGMRLGETVNIELAKGKTMIVKLNQISDPDVDGVRTLYFSINGQNQEIMVKDNAIHQSATSTRKAEPTNEDEVGATMSGSVLKLLVKKGQTVKKGEPLLVTEAMKMETTIQAPEDGVIEHIYVNAGDVIQTDDLLLEIAPQ

SEQ ID NO: 4906 - DNA, 1389 bp, Lactobacillus plantarum
  CDS (1)..(1389)
atgtttaaaaaagtcttagtcgcgaaccgtggtgaaattgcggtccaagttattcgcgcgcttcatgagatggggattaaagcggtcgctgtctattcagtggctgatcaggagagcttatttgtacatctggctgatgaggcggtctgtattggggcgagtcccgtcaaccagtcatatttgaatatgcaagcaattattagcgctgctaatttgaccgggtgtcaggcgattcatccaggctacggctttttatctgagaatgcggaatttgccaaaatgtgtgcggattgtcagttaacgtttattggaccgcgtcctgaggtgattgaccagatgggtgacaaagaaaatgcccggcagaccatgcaacgattaggcgtacccgtgattcccggcagtccatcggtgcttaaggatgttgaggcggctatgcaagctgcccataccttaggttacccagttatgatcaaagccgctgctgggggtggcggtaaggggattcgcgcggttagtaatgatcaagatttagcgaaggcttttcgaaccgctcagcaggaagctcaagcttcatacgatgatcatcggttgtacttagaaaaaatcattgccccggcgaagcatatcgaagtgcaggtcttagccgatcaacaggggcatgttatttatctaccagagcgcgattgttcgctacaacggaatcatcaaaaagtgttagaggaaagtccatgtgcggtcatcacgactgctgaacggaccgaattgggacaattagtggctgacgcaaccaaaaagttgggttatacaaatacgggtacctatgagtttttaatggatcagcagcatcatttttattttttggaaatgaatacgcggttgcaagttgaacatacggttactgaaatggtaacgggtattgaattgattaaagcgcaagtacaaattgcagctggtataccattaaaaattaaacaggcggatgtgaaaattcatggtgttgccatggagtgtcgcttgaatgcggaggatccgtaccacgattttcgaccgcaacctggaaaaatcacccggttgatctacccaatggggacactgggagtccggattgatgctggtgtggtgactggtagcatgattgcaccgttttacgactcgatgattgcaaaaatcattgttcacggtattaatcggaagatggtcagtcgcaagatgcatcgttgtttattggaattgaccatcgatggggttcaaacgaaccggaccttcttagcaggattagttgcagattcgactgttagccgtggtacctataccacagcttatatcgaacaagactttttgaaaggatggttaagtgatgcccaagcgcaagtttcaagcacccactga

SEQ ID NO: 4907 - protein, 462 aa, Lactobacillus plantarum
MFKKVLVANRGEIAVQVIRALHEMGIKAVAVYSVADQESLFVHLADEAVCIGASPVNQSYLNMQAIISAANLTGCQAIHPGYGFLSENAEFAKMCADCQLTFIGPRPEVIDQMGDKENARQTMQRLGVPVIPGSPSVLKDVEAAMQAAHTLGYPVMIKAAAGGGGKGIRAVSNDQDLAKAFRTAQQEAQASYDDHRLYLEKIIAPAKHIEVQVLADQQGHVIYLPERDCSLQRNHQKVLEESPCAVITTAERTELGQLVADATKKLGYTNTGTYEFLMDQQHHFYFLEMNTRLQVEHTVTEMVTGIELIKAQVQIAAGIPLKIKQADVKIHGVAMECRLNAEDPYHDFRPQPGKITRLIYPMGTLGVRIDAGVVTGSMIAPFYDSMIAKIIVHGINRKMVSRKMHRCLLELTIDGVQTNRTFLAGLVADSTVSRGTYTTAYIEQDFLKGWLSDAQAQVSSTH

SEQ ID NO: 4908 - DNA, 1341 bp, Clostridium tetani
  CDS (1)..(1341)
atgtttaaaaaaatattaatagccaatagaggagaaatagcggtacgaattataagagcatgtagagaaatggggatagaaactgtagctgtatattctgaaatggatagggaaagtcttcatgttgagatggcagatgaagctatatgtataggaccagcttcttcaaaagatagttatttaaatataaaaaatatattaagtgctacagttttaactggtgcagaagctatacatccaggctttgggtttctatctgaaaatagtaaatttgctaatatgtgtagagaatgcaatatagtatttataggacctgactcagaaataatagagaaaatgggtaataagtctaatgccagaagaattatggaggaagcaggagtagctgttgtgtcaggatcaaaaaagccaatagagagaagtgaagaggctttagaattagcagaaaagataggatatccagttataataaaagcttcagctggtggaggaggaaggggaatccgaatagttaaagagaatgaagagcttatagaagctatagatacagcgaaaaaggaagcactttcggcttttggagatgacagtatgtatatggaaaaatatattgaatgtccaaagcatgtagaaatacaaatattaggagataactatggaaatatagtgtatttaggagaacgggattgttctatacaaagaagaaatcaaaaaattttagaagaagctccatgtacggtaataacacaggaactaagagaaaaaatgggagatgctgcagtaagagcagctaagtatgtaggatataagaatgctggaaccattgaatttctattggataagagtaataatttttatttcatggaaatgaatacaaggattcaggtggagcatcctataacagagtttattactggagtagatttaataaaagagcaaataaaaattgcagctggaatgaaattaagtttttctcagaaagatataaaaatacaaggacactctattgagtgtagaattaatgcagaagatactttaaataattttatgccttgtcctggtaggataagtggattatttgtaccaggaggattaggagttagagtagatagtaatatatatgatggatatactattccacctacttatgattctatgatagcaaaattaatagttcatggtagagataggcaagaagctataaataaaatgaaaagagctttaggagagtttttaatagatggtataaaaaccaatatagattaccatatgggtatattgaataatgagaaatttatatctggtgattatgatacaggatttataggtagaggccataaatag

SEQ ID NO: 4909 - protein, 446 aa, Clostridium tetani
MFKKILIANRGEIAVRIIRACREMGIETVAVYSEMDRESLHVEMADEAICIGPASSKDSYLNIKNILSATVLTGAEAIHPGFGFLSENSKFANMCRECNIVFIGPDSEIIEKMGNKSNARRIMEEAGVAVVSGSKKPIERSEEALELAEKIGYPVIIKASAGGGGRGIRIVKENEELIEAIDTAKKEALSAFGDDSMYMEKYIECPKHVEIQILGDNYGNIVYLGERDCSIQRRNQKILEEAPCTVITQELREKMGDAAVRAAKYVGYKNAGTIEFLLDKSNNFYFMEMNTRIQVEHPITEFITGVDLIKEQIKIAAGMKLSFSQKDIKIQGHSIECRINAEDTLNNFMPCPGRISGLFVPGGLGVRVDSNIYDGYTIPPTYDSMIAKLIVHGRDRQEAINKMKRALGEFLIDGIKTNIDYHMGILNNEKFISGDYDTGFIGRGHK

SEQ ID NO: 4910 - DNA, 3318 bp, Bradyrhizobium japonicum
  CDS (1)..(3318)
atgagagacatcatgtcgttcaagaaactcctgatagccaatcgcggcgagatcgccatccgcatcgcgcgcgcggcggccgatgccggcatcgcgacggtagcgatccaccctgcagacgacgcgctgtcgctgcatgtgcgtgtcgccgacgaggcgctcgagatccccggccgcggcgcgcgggcctatctcgacatcgaggccgtggtgacggcggcgaagggcgccggctgcgatgccgtgcatcccggctacggttttctgagcgagaatgccgcgttcgccaaggcctgtggcgagcaggggatcacctttgtcgggccaaaggtgacagcgctcgaactgtttggcgacaaggtcgcggcacggcaactggccaaacgctgcggcgtgccgatcatcgccggcaccagcgggccttcgtcgctcgaggagatcacggcgttcttcacgtcgcttggcggcaacgcggcgatcgtgatcaaggcgatggccggcggcggtggccgcggcatgcgcgtggtcgagaatgcggccgatctggcggaagcctatgcgcgctgccagtccgaggccaaggcggcattcggcttcgacggcgtctatgccgagcggctgatccgccaggcgcgtcatatcgaggtgcagatcatcggcgaccgtcatggtgcggtctctcatctctgggagcgcgaatgcaccatccagcgccggcaccagaagctggtcgaggtggcgccgagcccgtcgctgagcgggcccttgcgcggccgcatcatcgaggcggcgaggcaactcgcgaccgccgcggcttacgacaatctcggtaccttcgagttcctggtcgacggcacggcggaggatagctttgccttcatcgaggccaatccgcggctccaggtcgagcacaccgtgacggaagcggtgctgggcctcgacctcgtccgcgcccagctcgcggtcgcagcaggcagcacgctggactcgctcgaccttgcgcagggatcgatcccgaagccgcgcggctacgccatgcagctccgcgtcaacatggagacgctggacgagactggcgcgacgcatccgaccggcggcgtgctcgccttgttcgagccgccgtcggggcccggcgtccgtgtcgatagttttggctatgcgggctacaagaccagcgcggccttcgattcgctgctcgcaaaagtcatcgtgcatacgccgggcgaggcctggcatgacgtggtcgccaaggcttcgcgcgccctgcgcgaattccggatcgatggcgtcgtcaccaacatcgcctttctccaggcggtgctcgcgcatcccgatttcaggaccaaccgcatcgcgaccgatttcatcgatcgcaacatcgcgaaactggtcgaggcggccgatggcgcagccaagccgctctacttcgccccgactgagcgaggcggcggtcacggcatggagacgcacattacgcaggccgtgcccgaaggcgcggtgatggtggcggcacccctgcagggaaccatcgtcaccattcaggtgaaggaaggcgaggtcgtgcgccccggccagcagcttgccgtgatcgagtccatgaagatggagcatctcgtcatggccgagcagggcggccgggtcacgaagctcgtcgccggagacggcgccactttgatgcacggcgaaccgatcctgtatctggagccgctcgacgtcgcggccgacgcgtcggcggcggaagccgatgtcgacctcgaccacatccgtcctgatctcgccgagctgatcgcgcgccaggccaacacgctcgatgcgaaccggccggcctcggtcgagcgccgtcgcaacaccgaccagcgcaccgcccgcgagaatgtcgcgcagctcgtcgacgacggctcgttcatggagtacggcagcctcgcgatcgcggcccagcgccgccggcgcaagctcgacgacctcatccagaacacgccggccgacggcctcgtcatgggcgttgcgaccgttaacgccgagaggttcggcccggagggcgcgcgctgcatcgtcgtggcctatgactacaccgtgctcgcgggcacgcagggccacatgaaccacaagaagatcgaccgcatgctgacgctggcggaagactggcgcgtgccgctggtgttctacgccgagggcggcggcggccggcccggcgataccgaccggctcggcatgaccgggctcgacggcccgtccttcgtgcagttcgcaaggctctccggcctcgtgcccgtcatcggcgtcgtctccggctattgctttgccggcaatgccgcgatgctcggttgctgcgacgtcatcatcgccaccaagaatgcctcgatcggcatgggcggcccagcgatgatcgagggcggcgggctcggcgtctaccatccggccgaggtcggcccggtctcgttccagtcgccgaacggcgtcatcgacatcctcgtcgaggacgaggaggaggcgacgcgcgtcgcgcaaaaatacctgtcctatttccagggcgcggtgaccgactggcaggccgccgaccagcgtctgctccgccgcgccattccggagaaccgcctgcgcgtctacgacatccgcagcgtgatcgatctcgtcgcggacagggacagcgtgctggagctgcgccgcgactacggcgtcggcatgatcaccgcgctgatccgcatcgagggcaagccgttcggcctgatcgccaacaacccgcgccatctcggcggcgcgatcgatgccgatgccggcgacaaggccgcgcgctttctccagctctgcgacgcgttcgatctgccgatcgtctcgctctgcgacacgcccggcttcatggtcggcccggaagccgagaagaccgcgatcgtgcggcacgtctcgcgcatgttcgtgaccggcgcgagcctcaccgtgccgctgttcggcatcgtgctgcgcaagggctacggcctcggcgcacagtcgatgatcggcggcggcttccacgcctcgttcttcactgcggcgtggcccaccggcgagttcggcggcatgggcctcgagggctatgtccgcctcggcttccgcaaggagatggaggcgatcgccgaccccgaagagcgcgagacctattaccgcaacaaggtcgccgagctctatgccaacggcaaggcggtctcgatcgcgtccgtgttcgagatcgacaacgtcatcgaccccgccgagacgcggcgctggatcatggcggggcttaggtcggtgccgaagccgcccgcgcggacggagaagaagaggccctgcatcgatacctggtga

SEQ ID NO: 4911 - protein, 1105 aa, Bradyrhizobium japonicum
MRDIMSFKKLLIANRGEIAIRIARAAADAGIATVAIHPADDALSLHVRVADEALEIPGRGARAYLDIEAVVTAAKGAGCDAVHPGYGFLSENAAFAKACGEQGITFVGPKVTALELFGDKVAARQLAKRCGVPIIAGTSGPSSLEEITAFFTSLGGNAAIVIKAMAGGGGRGMRVVENAADLAEAYARCQSEAKAAFGFDGVYAERLIRQARHIEVQIIGDRHGAVSHLWERECTIQRRHQKLVEVAPSPSLSGPLRGRIIEAARQLATAAAYDNLGTFEFLVDGTAEDSFAFIEANPRLQVEHTVTEAVLGLDLVRAQLAVAAGSTLDSLDLAQGSIPKPRGYAMQLRVNMETLDETGATHPTGGVLALFEPPSGPGVRVDSFGYAGYKTSAAFDSLLAKVIVHTPGEAWHDVVAKASRALREFRIDGVVTNIAFLQAVLAHPDFRTNRIATDFIDRNIAKLVEAADGAAKPLYFAPTERGGGHGMETHITQAVPEGAVMVAAPLQGTIVTIQVKEGEVVRPGQQLAVIESMKMEHLVMAEQGGRVTKLVAGDGATLMHGEPILYLEPLDVAADASAAEADVDLDHIRPDLAELIARQANTLDANRPASVERRRNTDQRTARENVAQLVDDGSFMEYGSLAIAAQRRRRKLDDLIQNTPADGLVMGVATVNAERFGPEGARCIVVAYDYTVLAGTQGHMNHKKIDRMLTLAEDWRVPLVFYAEGGGGRPGDTDRLGMTGLDGPSFVQFARLSGLVPVIGVVSGYCFAGNAAMLGCCDVIIATKNASIGMGGPAMIEGGGLGVYHPAEVGPVSFQSPNGVIDILVEDEEEATRVAQKYLSYFQGAVTDWQAADQRLLRRAIPENRLRVYDIRSVIDLVADRDSVLELRRDYGVGMITALIRIEGKPFGLIANNPRHLGGAIDADAGDKAARFLQLCDAFDLPIVSLCDTPGFMVGPEAEKTAIVRHVSRMFVTGASLTVPLFGIVLRKGYGLGAQSMIGGGFHASFFTAAWPTGEFGGMGLEGYVRLGFRKEMEAIADPEERETYYRNKVAELYANGKAVSIASVFEIDNVIDPAETRRWIMAGLRSVPKPPARTEKKRPCIDTW

SEQ ID NO: 4912 - DNA, 2016 bp, Bradyrhizobium japonicum
  CDS (1)..(2016)
atgttcaaacgcatcctgatcgccaatcgcggcgaaatcgcctgccgggtcatcaagactgcccgccggatgggaattgaaacggtcgcggtctattccgaggccgaccgcgatgccctccatgtcgagatggccgacgaggccgtgctgatcggcccgccggctgcggccgagagctatctggtgatcgagaagatcgtggaggcctgccgcaagacgggcgcacaggccgtgcatcccggctacggcttcctgtccgagcgcgaggcgtttccgcgcgcgctggaggcggccggcctcgtcttcatcggcccgaacccgggcgcgatcgccgcgatgggcgacaagatcgaatccaagaaggcggccgccaaggccaaggtctcgaccgtgccgggccatctcggcgtcatcgaggacgacaagcacgcggtccgcatcgccgacgagatcggctaccccgtgatgatcaaggcctccgccggcggcggcggcaagggcatgcgcatcgcgaattcgaagagcgaggtcgccgaaggcttcaacctcgccaaggccgaggccaaggcctcgttcggcgacgaccgcgtcttcgtcgagaagttcatcgtcgatccccgccacatcgagatccaggtgctgggcgacaagcacggcaacgtcatctatctcggcgagcgcgaatgctcgatccagcgccgcaaccagaaggtcatcgaggaagcgccgtcaccgctgctcgacgaggccacccgccgcaagatgggcgagcaggcggtcgcgctggccaaggccgtgaactatgattccgccggcaccgtcgagttcgtcgcaggccaggacaagagcttctacttcctggagatgaacacgcgcctccaggtcgagcatcccgtcaccgagctcgtcaccggcatcgacctcgtcgagcagatgatccgcgtcgccgcaggcgagaagctcggccttgcgcagaaggacgtcacgctgaccgggtgggccgtggaatcccgcctctacgccgaagacccgttccgcaacttcctgccctcgatcgggcgcctggtgaagtatcgtccgccggcggaagcgagccaggacggcatcaccatccgcaacgacaccggcgtgcaggaaggcggcgagatctcgatccattacgatccgatgatcgccaagctcgtcacccacgcgccgtcgcgcgcggccgcgatcgaggcacaggcgaccgcgctggactcgttctatgtcgacggcatccgtcacaacatcccgttcctgtcggcgctgatgcatcatccacgctggcgcgagggccggctctcgaccggcttcatcgccgaggaattccccaagggctttgcggtgcgcgtgcccgaaggcgaggtcgcccggcggatcgccgcggtcggcgccgccatcgaccacgtgctgggtgaacgcaagcgtcagatttccggtcagcttggtggccgcgtcgtgcagcgtgagcgccgccgcgcggtctggctcgaccgccaggagatttcgctcgaggtcggtcgcgagagcgaggcgatcgcggtgcgcttcgtcgatgtcgagggcaaggccggccacgtgcatctattgcagtcgccgtggaagccgggcgatccggtctggcagggcaccatcgacggccatttcgtcgcggtgcaggcccggccgatcgctaacggcatccgcctcgcgcatcagggcgtcgaggtgccggtctatgtctggaccgaggcggaggccgcctcggcgcggctgatgcctgtgaccacggcctccgacaccggcaagaagctgctctgcccgatgcccgggctcatcgtctcgatcgcggtgacggaagggcaggaggtcaaggccggcgagacgctcgcggtggtcgaagccatgaagatgcagaacgtgctccgcgccgagcaggacggtaccgtcaagaagatccacgccagcgccggtgcgacgctcgcggtggacgcactgattttggagtttgcgtaa

SEQ ID NO: 4913 - protein, 671 aa, Bradyrhizobium japonicum
MFKRILIANRGEIACRVIKTARRMGIETVAVYSEADRDALHVEMADEAVLIGPPAAAESYLVIEKIVEACRKTGAQAVHPGYGFLSEREAFPRALEAAGLVFIGPNPGAIAAMGDKIESKKAAAKAKVSTVPGHLGVIEDDKHAVRIADEIGYPVMIKASAGGGGKGMRIANSKSEVAEGFNLAKAEAKASFGDDRVFVEKFIVDPRHIEIQVLGDKHGNVIYLGERECSIQRRNQKVIEEAPSPLLDEATRRKMGEQAVALAKAVNYDSAGTVEFVAGQDKSFYFLEMNTRLQVEHPVTELVTGIDLVEQMIRVAAGEKLGLAQKDVTLTGWAVESRLYAEDPFRNFLPSIGRLVKYRPPAEASQDGITIRNDTGVQEGGEISIHYDPMIAKLVTHAPSRAAAIEAQATALDSFYVDGIRHNIPFLSALMHHPRWREGRLSTGFIAEEFPKGFAVRVPEGEVARRIAAVGAAIDHVLGERKRQISGQLGGRVVQRERRRAVWLDRQEISLEVGRESEAIAVRFVDVEGKAGHVHLLQSPWKPGDPVWQGTIDGHFVAVQARPIANGIRLAHQGVEVPVYVWTEAEAASARLMPVTTASDTGKKLLCPMPGLIVSIAVTEGQEVKAGETLAVVEAMKMQNVLRAEQDGTVKKIHASAGATLAVDALILEFA

SEQ ID NO: 4914 - DNA, 2064 bp, Bradyrhizobium japonicum
  CDS (1)..(2064)
atgcgccgatcgaaccgacgaaattcggcctgttcaggatgtgatgcgatggaccgctcaaagctctaccgccgttttcgcaccctcctgatcgccaaccgcggcgagatcgcctgccgcgtcattcgcaccgcccgtgccatgggcctgcgcacggtcgcggtctattccgaggccgaccgtgacgcgatgcatgtcgcgctcgccgacgaggccgtgctgctcggccccgcgcgggcgcgtgacagttatctcaatgtcgagcgtctgatcgaagccgcgcgaaagaccggggcggaggccgtgcatcccggctacggcttcctgtcggagaatgccgagtttgcgcatgcctgcctcgacgcggggctggtcttcgtggggccgaccgccgggatgatgacggcgatgggctcgaagtccggctcgaaagcgctgatggagaaggcgggcgtgccgctggtgcccggctatcacggcgaggcccaggacgaggcgacgctggcgaaggccgcgaaccagatcggcttcccgatcctggtgaaagcgtcggccggcggcggtggccgcggcatgcggatcgtgcgctcggcggccgagctcgggcccgcgatcgtcagcgccaagcgcgaggccaaggccgcgttcggcgacgaccgcatgctgatcgagaaatatgtcgacaatccccgccacatcgaggtgcagatcatcggcgacagccacggcaatctgctctcgctgttcgagcgcgaatgcacgctgcagcgccggcaccagaaggtgatcgaggaagcgccgtcgccgaccctcaatgcggcacagcgcgagacggtctgcgccgcggcgcggaaggcggcgggcgcggtgaactatgtcggcgccggcaccatcgagttcgtctccgacggcaaggacgtgttcttcatcgagatgaacacgcgtctccaggtcgagcatcccgtgaccgagctgatcaccggaatcgacctcgtcgaatggcagctgcgcgtcgccttcggcgaggcgttgccgctgcggcaggacgagatccgcctcaacggccacgcggtcgaggcgcgcgtctacgccgaaaatccgaccaagaacttcatgccctcggtcggaaagatctcgacctggcggctgcccgcagagaccggcggcctgcgcatcgacgcgggctatcgcgagggcgacagcgtctcgccgtactatgacgcgatgctcgcaaaaatgatcgcctgggcaccgacccgggatgtcgcgatcgagcggctgaaccgcggactggaggactccgacgttcgcggcatcgtcaccaatatcccgttcctgtcggcgctgatcacgcatcaaaaagtgcgggcgaatgcgatcgacaccggcttcatcgagcgcgagctggcggtgttgacgcaggctacgcctgcgcccggcgagctcgagctctgcgccgcggtcgccgcgatcgtgaacgacgaacggcaggccgcgcaggcagaggcgaattcgccctggcagacgttcggctggatgccggtcggccggcgtcagcgcagctttgccttccgcgtcggacatggtgtcggacatgggcccgagcagaagatcaccctcaactacggcagcgggccgtcgacgctggtcatcggcgagcgcgagctggcattcgcgatcgggccgcgcgatggcggcttcgatctgacgctcgacggcgtcaaatcccaggtcgccgccgtgatcgacggccatgagctctatttgcgcacgcgccacggccgcttcgacctgcattgggtcgatccgttcggcggcgagaccgaggagcaggccggcgcggacaagatcgcggcacccttgccgggcacggtcgtcgcggtgctggccgaggagggcgcaacgctggagaagggcgcgccgatcctcaccctcgaagtgatgaagatggagcagaccctgcgggcgccctatgccggcgtgctgacgtcgatcaagtgcaaggtcggcgacatcgtgcaggaaggcgtcgagctcgccgtggtcgagccttcgggagaatga

SEQ ID NO: 4915 - protein, 687 aa, Bradyrhizobium japonicum
MRRSNRRNSACSGCDAMDRSKLYRRFRTLLIANRGEIACRVIRTARAMGLRTVAVYSEADRDAMHVALADEAVLLGPARARDSYLNVERLIEAARKTGAEAVHPGYGFLSENAEFAHACLDAGLVFVGPTAGMMTAMGSKSGSKALMEKAGVPLVPGYHGEAQDEATLAKAANQIGFPILVKASAGGGGRGMRIVRSAAELGPAIVSAKREAKAAFGDDRMLIEKYVDNPRHIEVQIIGDSHGNLLSLFERECTLQRRHQKVIEEAPSPTLNAAQRETVCAAARKAAGAVNYVGAGTIEFVSDGKDVFFIEMNTRLQVEHPVTELITGIDLVEWQLRVAFGEALPLRQDEIRLNGHAVEARVYAENPTKNFMPSVGKISTWRLPAETGGLRIDAGYREGDSVSPYYDAMLAKMIAWAPTRDVAIERLNRGLEDSDVRGIVTNIPFLSALITHQKVRANAIDTGFIERELAVLTQATPAPGELELCAAVAAIVNDERQAAQAEANSPWQTFGWMPVGRRQRSFAFRVGHGVGHGPEQKITLNYGSGPSTLVIGERELAFAIGPRDGGFDLTLDGVKSQVAAVIDGHELYLRTRHGRFDLHWVDPFGGETEEQAGADKIAAPLPGTVVAVLAEEGATLEKGAPILTLEVMKMEQTLRAPYAGVLTSIKCKVGDIVQEGVELAVVEPSGE

SEQ ID NO: 4916 - DNA, 1359 bp, Bradyrhizobium japonicum
  CDS (1)..(1359)
atgttcgacaagatcctcatagccaatcgcggcgagatcgcccttcgcatcctcagggcctgcaaggagctcgggatcgcgaccgtcgccgtgcactccaccgccgacgccgacgccatgcatgtgcgcctgtcggatgagagcgtgtgcatcggaccgccgccgtccaaggacagctatctcaatgtgcccgcgctgctcgcggcctgcgagatcaccggggcggacgccgtgcatcccggctacggcttcctgtccgagaacgcgcgcttcgcggaaatcctctccgagcacaatctgcatttcatcggccccaaggccgagcatatccgcctgatgggcgacaagatcgaggccaagaagaccgccaagaaactcggcatccccgtggtgcccggctccgacggcgcggtcggtcccgacgacgatgcgctggggatcgccaggaagatcggcttcccggtgctggtgaaggcggcggcgggcggcggtggccgcggcatgaaggtcgcgcacagcgaggccgacctcctgatggcgctgtcgacggcggccaatgaggccaaatccgccttcggcgatgcgtccgtctacctcgaaaaatatctccagaagccgcgccatatcgagatccagatcctcggcgacggccgcggcggcgcgatccatctcggtgagcgcgattgctcgctgcagcgccgccaccagaaggtctgggaggaaggcccctcgcccgtcctctccgccgccgcgcgcgccaagatcggcgagacctgtgcgaaggcaatgcgcgagatgaaatatctcggcgtcggcaccatcgagttcctgttcgaggacggcgagttctacttcatcgagatgaacacccgcatccaggtcgagcatcccgtcaccgagagcatcaccgacatcgacctcgtgctggagcagatccgcatcgccgccggcggcgagctgccggcgaggcaggaggaagtccaggtcatcggccacgcgatcgaatgccgcatcaacgccgaaaatccggtgaccttccgcccctcgcccggccggatcctgcaatatcatccgcccgggggcctcggcgtccggatcgattccgccgtctaccaaggctacacgatcccgccttattacgactcgctcgtcggcaagctgatcgtgcacggcaagacgcgcgccgaatgcctgatgcggctgcgccgggcgctggacgaaatggtggtcgaaggcatcgagaccacgctgccgctgttccgcgcgctggtgcgcgaagacgacatcatcaacggcgactaccacatccactggctggagcagtacctggccggcaaggcggaacccgctgcgaaatag

SEQ ID NO: 4917 - protein, 452 aa, Bradyrhizobium japonicum
MFDKILIANRGEIALRILRACKELGIATVAVHSTADADAMHVRLSDESVCIGPPPSKDSYLNVPALLAACEITGADAVHPGYGFLSENARFAEILSEHNLHFIGPKAEHIRLMGDKIEAKKTAKKLGIPVVPGSDGAVGPDDDALGIARKIGFPVLVKAAAGGGGRGMKVAHSEADLLMALSTAANEAKSAFGDASVYLEKYLQKPRHIEIQILGDGRGGAIHLGERDCSLQRRHQKVWEEGPSPVLSAAARAKIGETCAKAMREMKYLGVGTIEFLFEDGEFYFIEMNTRIQVEHPVTESITDIDLVLEQIRIAAGGELPARQEEVQVIGHAIECRINAENPVTFRPSPGRILQYHPPGGLGVRIDSAVYQGYTIPPYYDSLVGKLIVHGKTRAECLMRLRRALDEMVVEGIETTLPLFRALVREDDIINGDYHIHWLEQYLAGKAEPAAK

SEQ ID NO: 4918 - DNA, 1356 bp, Bradyrhizobium japonicum
  CDS (1)..(1356)
atgttcgacaaggtcctgatcgccaaccggggcgagatcgcgcttcgcatccagcgcgcctgtcgggcgatgggtctcaagacggtcgtcattcactcggaggcggatcgcgacgcacgctatgtcgcactcgccgatgaggcactctgcatcgggccggcgccggcaagcagcacctatctcaacgttgcggcgatcctgctcgcagtcgaggtcagcggcgcccaggcgatccacccgggttacggattcctctcggagagtgcggagttcgccgatcgggtcgcgcgcgccggcctcgccttcatcggcccgccggcggattgtattcggaccatgggcgacaaggtcgcggccaagcgcgcgatgcggctggcgggcgtgccttgcgtgcccgggccggacagcgccctgccggaggatccgtccgaggtgcacgcgatcgcgcgggacatcggataccccgtcatcatcaaggccgccggaggcggcggcggacgcggcatgcggatcgtgcgcagcgaaggcgcgctagacgacgcgctggcgctgacccgcgcggaagccagcaaggccttcaagaacgctgcggtctacatcgagaaattcctcgaaaagccccgccatatcgagattcaagtgttgtgcgatcagcatgacaatcatctctggctcggcgaccgcgactgctcgcttcagcgcaggaaccagaaggtggtcgaggaagcccccgcgcccggcatcgatcgcgctctgatcgagcgggtgggcgcaagctgcgtcgaagcctgccggcggatcggctatcgcggcgccggcacattcgaattcctctacgagaacggccaattcttcttcatcgaaatgaacacgcgcgtccaggtggagcatcccgtcaccgaggccacgacggggatcgacatcgtcaaggcgcagatccgcatcgcgcaaggcgagccgttgggcatcgcgcaaggcgacatcgcacgtgtaggccatgccattgaattccgcatcaatgccgaagaccccaccaccttcgctccctcgcccggcatggtgacgcgctgggatgttcccggcggcatcggcatccgcgtcgattcgcatatcaccgccggcgccaccgttccccggcactatgactcgctgatcggcaagctcatcgctcatggtggcagccgcgaggaagctatggcgcgtgcgcgcgtcgccttgtccgagctacgcgccgaaggcatccgaaccaatgtgccgttgcatcaggcgatcctcgccgatcccgcgttttgccgtggcggctacgacatccaccatctcgagcactggatgaatgcgcgggcggccgcgccatga

SEQ ID NO: 4919 - protein, 451 aa, Bradyrhizobium japonicum
MFDKVLIANRGEIALRIQRACRAMGLKTVVIHSEADRDARYVALADEALCIGPAPASSTYLNVAAILLAVEVSGAQAIHPGYGFLSESAEFADRVARAGLAFIGPPADCIRTMGDKVAAKRAMRLAGVPCVPGPDSALPEDPSEVHAIARDIGYPVIIKAAGGGGGRGMRIVRSEGALDDALALTRAEASKAFKNAAVYIEKFLEKPRHIEIQVLCDQHDNHLWLGDRDCSLQRRNQKVVEEAPAPGIDRALIERVGASCVEACRRIGYRGAGTFEFLYENGQFFFIEMNTRVQVEHPVTEATTGIDIVKAQIRIAQGEPLGIAQGDIARVGHAIEFRINAEDPTTFAPSPGMVTRWDVPGGIGIRVDSHITAGATVPRHYDSLIGKLIAHGGSREEAMARARVALSELRAEGIRTNVPLHQAILADPAFCRGGYDIHHLEHWMNARAAAP

SEQ ID NO: 4920 - DNA, 1977 bp, Bradyrhizobium japonicum
  CDS (1)..(1977)
atgaggaacggatcagtgcagcaccggccgttcttcaaggtcctgatcgccaaccgcggcgagatcgcgttgcgggtgatgcgcagcgcgcgcaagcttggcctcggcgtcgtcgcggtctattccgacgcggatcgcgatgcgctccatgtgcggcaggccgatcaggccgtgcgcatcggcgaggcgctgccggcgcaatcctatctcaacatccccgcgatcattgccgcggcgaaagccagcggcgcggatgccgtccatcccggctacggtttcctcgccgagaacgaggactttgcgcaggcctgcaaggacgccggtctcgtcttcatcggcccatcgccccaggcgatcgaggcgatgggcaacaaggccggcgccaaggagatcatgcggaaggccggtgtgccctgcgtgcccggctatcagggccttgagcaaggcgacgaggtcatgctcgcggaggccaggaagatcggttttcccgtgatgatcaaggcggtggccggcggtggtggccgcggcatgcggctcgtgaccgatgctgcatccttccccgacgcgctgcgcagcgcgcggtcggaggcgaaagccgcgttcggcgatgccacggtcattctcgaacgcgcgatccagaatccacgccatatcgaaatccaggtgttcggcgacaaccacggcaacgccattcatctcggcgagcgtgactgctccgtgcagcggcggcaccagaagctgatcgaggaagcgccgtcgccggccgtcacgccggagctgcgtgcgagaatgggcgaggtcgccgtcgccgcggtgaaggcgctgcgttacgagggcgccggcacgctggaattcctgctcgatgcgagcggggagttctacttcatggagatgaacacccgtctccaggtcgagcatcccgtgaccgaggcgatcacggggctagatctcgtcgagctgcagctgcgcgtcgcgcgcggcgagcaattaccggtgaggcagcaggacatccgcttcgcaggtcacgccatcgaggtgcggctctgctcggaagatgccgcgcaggatttcatgccgcagtccggcagcatggcgcgctggcaggtgccggatggcatccgcgtcgagcacgcgctgcaatcaggctcggagatcccgccgttctacgattccatgatcgccaaggtgattagccacggcgcgacacgcgaggaggcgaggggacggctgatcgtcggcctggagcagctcaccgccttcggcgtgaccaccaaccaggccttcctgatgtcctgcctgcgtcatcccggctttgccaggggcgaggcgacgacggcgttcatcggcgcgcatcgcgacgagctgctggctcccccggcggacgcggcgttcggcacggcgctggcaggcctgctgctctacgtcacaaatccgcgcgcgccgtcatggcggggcggccggagcctgtcggcaacgtttccgcttcctgcgaaaatcgagatcgccggccaggcgcgcgaactcgaagttacgcgagagcgggatggtgggtacaccgtcgccaccgacggccggcaggacaagttcgaaattgatcagctcgatcctgacgcgatccgcttccgtaacgacggcatgatggacagcgccaaattcctgcgcgatggcgatcggctctatctccagcatcgcggctttccgctcgcggtgaccgacttcactctcgctgcgccaaaggcggcggcaaccaacggcggcgacggaaaagtccgcgccgccatgaacggccgtgtcgtcgccgtcctggtcaagccgggcgaccgcgtcgccgccggccagcctgtgctgacgctggaagcgatgaaaatggagcacgtccacaaggccggcatcgacggcgtggtcgccgcgatcgacgtcaccgagggtgagcaggtgaccacgggcaggatcgtcgcggagatcggagcggggtag

SEQ ID NO: 4921 - protein, 658 aa, Bradyrhizobium japonicum
MRNGSVQHRPFFKVLIANRGEIALRVMRSARKLGLGVVAVYSDADRDALHVRQADQAVRIGEALPAQSYLNIPAIIAAAKASGADAVHPGYGFLAENEDFAQACKDAGLVFIGPSPQAIEAMGNKAGAKEIMRKAGVPCVPGYQGLEQGDEVMLAEARKIGFPVMIKAVAGGGGRGMRLVTDAASFPDALRSARSEAKAAFGDATVILERAIQNPRHIEIQVFGDNHGNAIHLGERDCSVQRRHQKLIEEAPSPAVTPELRARMGEVAVAAVKALRYEGAGTLEFLLDASGEFYFMEMNTRLQVEHPVTEAITGLDLVELQLRVARGEQLPVRQQDIRFAGHAIEVRLCSEDAAQDFMPQSGSMARWQVPDGIRVEHALQSGSEIPPFYDSMIAKVISHGATREEARGRLIVGLEQLTAFGVTTNQAFLMSCLRHPGFARGEATTAFIGAHRDELLAPPADAAFGTALAGLLLYVTNPRAPSWRGGRSLSATFPLPAKIEIAGQARELEVTRERDGGYTVATDGRQDKFEIDQLDPDAIRFRNDGMMDSAKFLRDGDRLYLQHRGFPLAVTDFTLAAPKAAATNGGDGKVRAAMNGRVVAVLVKPGDRVAAGQPVLTLEAMKMEHVHKAGIDGVVAAIDVTEGEQVTTGRIVAEIGAG

SEQ ID NO: 4922 - DNA, 1512 bp, Bacteroides thetaiotaomicron
  CDS (1)..(1512)
atgataaaaaaaatcttagtagccaatcgcggtgaaattgccataagggtgatgcgctcctgccgggagatggagataacgagtatcgctattttctccgaagcagaccggaccgcgaagcacgtgctctatgcagacgaagcttattgcgtaggaccggcagcatccaaagagagttatctgaatatagaaaaaatcatcgaagtggcaaaggaatgccatgcagacgctattcatccgggatatggtttcctgtccgaaaacgcgactttcgcccgacgctgtcaggaagaaaatattatttttatcggaccggaccccgaaacgatggaggcaatgggcgacaagatatccgcccgtattaaaatgatcgaggcaggagtccctgtcgttcccggcacacaggagaatctgaaaagtgtggaagaagccgtagaactctgcaacaagatcggttacccggtgatgctgaaagcatctatgggcggcggcggaaaaggtatgcgccttatccacagtgcggaagaggtggaagaggcttatacgactgccaaaagcgagtcactttcttcgtttggcgacgataccgtttatctggagaagttcgtggaagaacctcatcacattgaatttcagattctgggcgacaaacacggaaacgtgattcacctgtgcgaacgcgaatgttccgtacagcgccgcaaccagaagattgtagaagagacgccatcggttttcgtgactcccgaactacgtaaagacatgggtgaaaaggcggtagccgccgccaaagcggtcaactatatcggtgcaggcacgattgagttcttggttgataagcatcgcaattattacttcctcgaaatgaacacccgtctgcaagtagaacatccgattacggaagaagtggtcggagtggacttggtgaaagagcagatcaaagttgccgacggccaagtgctccagctgaaacagaaagatatccaacagcgcggccatgccatcgaatgccgtatttgtgccgaagacacggaaatgaacttcatgccgagcccgggaatcatcaagcagattacagaaccgaacggaatcggtgttcgtatcgacagttacgtttacgaaggatatgaaatcccgatctattatgacccgatgatcggcaaactgatcgtatgggctactaaccgcgaatatgccatcgaacggatgcgccgcgtactccatgagtataaactgacaggggtaaagaacaacatcagctacctgcgtgccatcatggacactccggactttgtggaaggccattacgacacaggctttatcaccaagaacggcgagcatctgcaacaatgtatcatgcgcaccagcgaacgtgccgaaaacattgccatgattgctgcctacatggattatctgatgaatcttgaagaaaacagaggtgacgcaacggacaaccgtcccatcagcaaatggaaagaattcggtttgcacaaaggtgtacttcgtatctaa

SEQ ID NO: 4923 - protein, 503 aa, Bacteroides thetaiotaomicron
MIKKILVANRGEIAIRVMRSCREMEITSIAIFSEADRTAKHVLYADEAYCVGPAASKESYLNIEKIIEVAKECHADAIHPGYGFLSENATFARRCQEENIIFIGPDPETMEAMGDKISARIKMIEAGVPVVPGTQENLKSVEEAVELCNKIGYPVMLKASMGGGGKGMRLIHSAEEVEEAYTTAKSESLSSFGDDTVYLEKFVEEPHHIEFQILGDKHGNVIHLCERECSVQRRNQKIVEETPSVFVTPELRKDMGEKAVAAAKAVNYIGAGTIEFLVDKHRNYYFLEMNTRLQVEHPITEEVVGVDLVKEQIKVADGQVLQLKQKDIQQRGHAIECRICAEDTEMNFMPSPGIIKQITEPNGIGVRIDSYVYEGYEIPIYYDPMIGKLIVWATNREYAIERMRRVLHEYKLTGVKNNISYLRAIMDTPDFVEGHYDTGFITKNGEHLQQCIMRTSERAENIAMIAAYMDYLMNLEENRGDATDNRPISKWKEFGLHKGVLRI

SEQ ID NO: 4924 - DNA, 1512 bp, Bacteroides thetaiotaomicron
  CDS (1)..(1512)
atgataaagaaaatattagttgctaatcgtggagagatagctatgcgcatcttccgtacttgtcgggtgatggatatttcgacggtggctgtttacacgcatgtagacaggggggctttgcatgttcgctatgcggaggaggcttattgcatctccaattcgccggaggatacttcttatttgaagccggagttgatactggccattgccaaaaagaccggagccgccattcatccgggatatgggttcttgtcggagaacgctgactttgcccgtcgttgcgaagaagaaggagtgatctttatcgggcccggtgccgatattattgctaagatggggatcaagactgaggcacgcaaaatcatgcgtgaagcggggctgcccatcgttcccggaacggaaactcccgtacaggggatcgaagaagtgaagaaggttgctaaggaagtaggttatcctattatgttgaaagcgcttgccggaggaggcggaaaggggatgcgtctggtccgttccgaagaagaagcggaaacggctcttcgtttgtctcagtccgaggcgggtacttcttttggtaatgatgcggtctatatagagaaatatatcgagaatccgcaccatatcgaggtgcagattatgggagataaatatggcaatgtggttcatctgggcgagcgtgaatgttccattcagcgacgtaatcagaaggtaatcgaggagtctccgtcaccgtttgtgaaagacgaaacccgtaagaagatgctgaaagtagccgtagaggcttgcaagcggatcggttattacagtgccggcacgctggagttcatgatggataaagaccagaacttctatttccttgaaatgaatacccgtttgcaggtagaacatccggtgacggaggaatgtaccggcgtcgatctggtgcgtgacatgatcacggtggctgcgggcaatccgttgccgtataagcaggaagatataaaattcagcggagctgccatcgaatgccgtatctacgccgaagatccggagaataactttatgccttctcccggagtgataactgttcgtgaagctcccgaaggccgtaacctccgtctggacagtgccgcctatgccggattcgaagtttcactgcattatgatccgatgattgccaagctctgctgctgggggcgtacccgtgaatccgccatctccaacatggcacgtgccttgcgtgagtataagattctgggcatcaagacgacgattcctttccatcagcgtgtgttgaagaatgccgctttcctcgaaggaaaatatgatacgacttttatcgatacccgttttgacaaggaggacttgaagcgtcgtcagaatactgatccgactgttgccgtgatcgctgccgccgtaaggcattacgagagggagaaagaagctgcatcccgtgccaccacgctccctgtagtgggcgaatctctctggaagtattatggcaagttgcagatgactgccaataattattga

SEQ ID NO: 4925 - protein, 503 aa, Bacteroides thetaiotaomicron
MIKKILVANRGEIAMRIFRTCRVMDISTVAVYTHVDRGALHVRYAEEAYCISNSPEDTSYLKPELILAIAKKTGAAIHPGYGFLSENADFARRCEEEGVIFIGPGADIIAKMGIKTEARKIMREAGLPIVPGTETPVQGIEEVKKVAKEVGYPIMLKALAGGGGKGMRLVRSEEEAETALRLSQSEAGTSFGNDAVYIEKYIENPHHIEVQIMGDKYGNVVHLGERECSIQRRNQKVIEESPSPFVKDETRKKMLKVAVEACKRIGYYSAGTLEFMMDKDQNFYFLEMNTRLQVEHPVTEECTGVDLVRDMITVAAGNPLPYKQEDIKFSGAAIECRIYAEDPENNFMPSPGVITVREAPEGRNLRLDSAAYAGFEVSLHYDPMIAKLCCWGRTRESAISNMARALREYKILGIKTTIPFHQRVLKNAAFLEGKYDTTFIDTRFDKEDLKRRQNTDPTVAVIAAAVRHYEREKEAASRATTLPVVGESLWKYYGKLQMTANNY

SEQ ID NO: 4926 - DNA, 2748 bp, Pagrus major
  CDS (188)..(2341): n means a or g or c or t/u
cgacggccgggctggtatagaagtttaaggcaccaggtgtttctgtctgtatactttgaatgcgttgctgtagttaaaaaagaaccaaaccgtgtatgagctgtttagttaattaccgcttcgctttttcctcctcagcttgtcagtcagtcagttagctagcagctagcctcagtagctggtagctatggctgcagttattctgagtttcccaactctgcatggtctgaggatatgtacacaaaaattgtcatggaccaaaagaggtgtgaggcttgtttcaggaggggttggaaggatagacaaggtgctgatcgccaatcgaggagagattgcgtgtcgtgtgatgcgcacggccaagaagatgggcgtccgctctgtggccgtgtacagtgatgcagacagacactccatgcatgtggccatggcagatgaagcctaccacatcggccctccaccctcccagcagagttatctctgtatggagaaagttttagaagtggccaaaaagtctggatcacatgcggtccaccctggttacggctttctgtcagaaaacacagagtttgcagaggcgtgtaaacaggaaggtgtcatcttcatcgggccaccttcctctgccatccgagacatgggcattaaaagcacatccaaacacatcatgtcagctgctggggtgccaatcattggtggttaccatggagaggaccaatcgaatgagaggctgcaggcagaggctgccaagataggataccctgtgatgataaaggcagtccgtggaggaggagggaaggggatgcgtatcgcacggtcggactcagacttcttggagcagttggagtcggcgagacgagaagccagaaaatccttcaacgatgacgtcatgctggttgagaagtttgtggaggatcccagacatgtggaggctcaggtgttcggggacatgcacggtaacgctgtctatctgttcgagagagactgcagcgtccaaaggagacaccagaagatcatagaggaagcacccgggcctggtattagtccggaggttcggaggaaacttggagaggcagcagtcaaagcagccaaggctgtcaactatgtaggagcaggtacggtggagtttataatggacgcccagcataacttttacttcatggagatgaacacgaggctgcaggtggaacatcccgtctctgagatgatcacaggaactgatctggtggagtggcagctcagggtggcagcaggggagcgcctgcctctcctccaggatgacatcattttaagtggacattcttttgaggctcgaatctatgctgaggacccaaacaatgactttcttccaggggctgggcctctgctgcatctctccacgcctccgccagaccaacacatacgcgtagagactggagtcagggatggggacgaggtgtcggcacattatgacccaatgatcgccaagctcgttgtgtgggcagaagaccgatctgctgccttgaagaagctgcggtactgcttacgacagtacaacatcgtgggactgaacactaacatcgacttcttgctgagtctttcgggccacccagagtttgaggctggaaacgtgaccaccagcttcatcccgcagcactacgctgacctcttccccactccgaaagctccttctggggaaacgatctggcagccggcactgggtctggtgctccaggagaggagacacacacaggagttcacacagacctccacagacccgttctctccatttggctccagcagcggctggagaagcaacattcagtttaacagaaacatgacgctgcaggtgggagacaaaaaagttgatgtggtcgtcgtgtacaacaaagacggaagctacacaatgcagattggtgaggaggtgcaccatgtgaccggcgacgtggagatggaggatggagcgtcattcctgcactgttctgtcaacggtgtgaagtctcgtcccaaactggtgatcctggacagcacagtgcacctgttctccacggagggaagcgccgaggtgtctgttccagtgcccaagtatctggctgctgtgagcggctctggggctcagggtggagctgtggcccccatgactggaaccatagagaaggtgtttgtgaaggccggagacaaagtggctgtaggagacccactgatggtcatgatcgccatgaagatggagcatacgatccgggcgcccaagtccggtgtgatcaagaaggttttcttcagcgagggctctcaggccaatcgccacgctgctctggtggagctggaagaggaggcggaggtggagggggaggggagcagcagcaagtaaacactaaaccacagccacaaatacacactgacaggtagcagagagccggaactagttactgtgacgactggagggaaagagagtctgaactttgttggtttccaacacttgattgacatttctttaagtgaggacctcaatcaacaagttgggatgaagtttggctcagtctggaatggatgagacgaaaaataaatcacccacggggacccacaatgcatttagggaaggccacaatggttactggggtttgacttgtgtgacagcagtgaagagggatgcccgattgggaaatctaaaagcagattcaatngttaaaataacaatttagtttatanccgatgccaactttttattttggttttgtattaattccccttttgttccagggaaacaaaaaatcttat

SEQ ID NO: 4927 - protein, 717 aa, Pagrus major
MAAVILSFPTLHGLRICTQKLSWTKRGVRLVSGGVGRIDKVLIANRGEIACRVMRTAKKMGVRSVAVYSDADRHSMHVAMADEAYHIGPPPSQQSYLCMEKVLEVAKKSGSHAVHPGYGFLSENTEFAEACKQEGVIFIGPPSSAIRDMGIKSTSKHIMSAAGVPIIGGYHGEDQSNERLQAEAAKIGYPVMIKAVRGGGGKGMRIARSDSDFLEQLESARREARKSFNDDVMLVEKFVEDPRHVEAQVFGDMHGNAVYLFERDCSVQRRHQKIIEEAPGPGISPEVRRKLGEAAVKAAKAVNYVGAGTVEFIMDAQHNFYFMEMNTRLQVEHPVSEMITGTDLVEWQLRVAAGERLPLLQDDIILSGHSFEARIYAEDPNNDFLPGAGPLLHLSTPPPDQHIRVETGVRDGDEVSAHYDPMIAKLVVWAEDRSAALKKLRYCLRQYNIVGLNTNIDFLLSLSGHPEFEAGNVTTSFIPQHYADLFPTPKAPSGETIWQPALGLVLQERRHTQEFTQTSTDPFSPFGSSSGWRSNIQFNRNMTLQVGDKKVDVVVVYNKDGSYTMQIGEEVHHVTGDVEMEDGASFLHCSVNGVKSRPKLVILDSTVHLFSTEGSAEVSVPVPKYLAAVSGSGAQGGAVAPMTGTIEKVFVKAGDKVAVGDPLMVMIAMKMEHTIRAPKSGVIKKVFFSEGSQANRHAALVELEEEAEVEGEGSSSK

SEQ ID NO: 4928 - DNA, 4010 bp, Pagrus major
  CDS (389)..(3928): n means a or g or c or t/u
cggtgccagctgctagctaagttagctacagtagnagacagttagcaactagcttcagaggtcctagcgccttgactacatgagcgactgagcgagtgtgcttgtgcctgtgtgtgtgtgtggtgtgtgtgtgtcgacgcttttgcgcgcccgctcggccgtcccnantcactccgtctgtgtacctgtgtgcgtgagcgtgagcgagtgtgtgtgtgtgtatatataaacccccctcatacccacatcttcctcttccgagtggcagcagcgtgtgtgtgtgaggttagcaaagcaaagaagagaaggcacacacataaacacactgtgacagtcggctgtttacactcggtgtccggttacctgacagcgacacagcaccagcacgatgttgagctacgctgtggtacgaggtggcctcggcctgctggccgtgaagcgggcatgcgtcctctctcgcctcgcccacacttccccgcagaacgagtatcgaccaatcaagaaagtaatggtggccaatagaggtgagatcgccatccgtgtgttcagagcctgcactgagctgggcattcgaaccgtggccgtctactccgagcaggacactggacagatgcacaggcagaaggcagacgaggcttacctgataggaaaaggcctgccacctgttgcagcatacctggacattcctgacatcatcaaagtagccaaggacaacaatgtggatgcgatccacccaggctatggtttcctgtccgagcgctcggactttgcccaggcctgcgcggatgccgatgtcatgttcatcgggccctccccggagacggtgcgcaagatgggagacaaggtggaggctcgctccatagccatctctgcaggtgtacccgtggtcccaggaacagatgcccccatcgccagcctgcatgaggcgcaggcgttcgcccagacatacggcttccccatcatcttcaaagcggcctacggaggaggtggtcgcggcatgagggtggtcagagagtacgaggaactggaggagaattaccagcgggcctactctgaagccctggcggcttttgggaacggagccctgtttgttgagaagttcattgaaaagccgagacacattgaagtacagatcctaggcgataaatatggtaatgtcatccacctctacgagagagactgctccattcagcgcagacaccaaaaggttgtggaaatcgcaccggctttccagctggaccctcatctgagagaccgacttcacgctgattctgtgaacctcgccaaacaggtgggctacgagaacgccggcaccgtggagttcctggtggacaaacacggcaagcactacttcatcgaagtcaactctcgactccaggttgaacacacggtcaccgaggaaatcactggatgggacctggtgcatgcccagctgcatgtgtgtgagggccgcagcctgccagatctgaacctcaaacaagacaagatccgggtgaacggctgcgccatccagtgcagagtgacaactgaagacccagccagaggcttccagccagacaccggcaggatcgaggtcttccgaagcggtgaaggcatgggcatccgtctggacagcgcctctgccttccagggcgctgtcatttcgcctcactacgactccctgctggtcaaagtcatcgccagcgggaaggacctccagacagcgtcttccaagatgagccgagcgctggccgagttcagagtgcgaggggtcaagaccaacattccgttcctccagaacgttctgtccaaccaccagttcctccactccaccgtggacacccagttcatcgatgagaaccaggagctcttcaacctcaaacccactcagaacagagcccagaaactcctgcattacctgggtcatgtgatggtaaatggaccaaccacccccatcccagtcaaggctaagccttcctccacagaccccgtcatccctcccgtcaccatgggtgaccctccgctaggtttccgtgacgtgttgctgcgtgacggccctgagggattcgctaaggccgtccgtgcccatcaaggtctgctgctgatggacaccaccttcagggatgcccaccagtccctcctggccaccagggttcggacccacgacctgaagaagatctcgccattcgtcagccacaacttcagcaacctttacagcctggagaactggggaggtgctacctttgatgtggccatgcgcttcctgtctgagtgtccatggaagagactccaggagctgagagctttgatcccaaacgttcctttccagatgctgctgagaggggccaacgccgtgggctacaccaactaccctgacaatgctgtctttaagttctgcgaggtggccaaggagaacggcatggacatcttccgcgtgttcgattccctgaactacgtgccaaacatgctgctgggcatggaggctgctggagcggcaggcggcgtagtggaggccgccatctcgtacacaggcgacgtctctgacccgatgaggcagaagtactccctggactactacctgaaacttgcagctgagcttgtcaaagccgggacccacatcctgtgcatcaaggatatggccggcctgctgaagccagaggccagcaagcttctgatcggcgctctgagagaccgtttcccggatgtacccatccacgtgcacacacacgacacggccggagcgggtgtagccgccatgctggcatgcgccgaggctggagctgacgtggtggatgtggccgtggactctatggctggtatgacctctcagcccagcatgggagccattgtggcctgtgccaaggggaccaagcttgacaccggcattgccctggagaaggtgtttgattacagtgaatattgggaagtagcccgaggcctgtacgcgccgtttgactgcacagccaccatgaaatctggcaacgccgacgtctatgagaacgagatccctggagggcagtacaccaacctccacttccaggctcacagtatgggacttggaaataagttcaaggaggtgaagaaggcctacacagaagccaacaaactgctaggagacctcattaaggtgactccatcctctaagatcgtgggtgacctggcacagttcatggtgcagaacaacctgaccagggcagaagtggaggagagggcagatgagctgtccttccccctgtctgtggtcgagttcctgcagggatacatcgggataccacacggaggattccccgagcccttcagatctagggtgctgaagtcccttcctcgtatcgagggtcgtccgggcgcctctctgccatccatggactttaaggccctggaggaggggctccgagctgcacacagtgatgagatcacccccgaggatgtgatgtcagcagccatgtaccccaaggtgttccaggagtacaaggaattcacctctaactttggtccagtggactgtcacagcaccaggctgttcttggatggacccaagattgcggaggagtttgaggtggagctggagagagggaagaccctccacatcaaggcactggcgctgggtgacctgaacaaggccggccagagagaggtcttctttgaactgaacggacagctgagatctgtgctggttaaagacactgttgccatgaaggaaatgaagttccatccaaaggcacagaagtccattaagggtcaggtgggagcacccatgcctggaaaagtcctggaggtcaaagtagaagtcggatccaaggtggagaagggtcagccgctgtgtgtcctctcggccatgaagatggagaccgtggtcaactccccggtggccgggaccgttaaggcggtccatgtcacggccgatgcctccctggagggagatgacctgatactggaaatcgaggagtagagtgcgagggcagagggaggcagggaggggggagtagagcgtagcagtaatggtaggcgggagttgacaattcttatttctg

SEQ ID NO: 4929 - protein, 1179 aa, Pagrus major
MLSYAVVRGGLGLLAVKRACVLSRLAHTSPQNEYRPIKKVMVANRGEIAIRVFRACTELGIRTVAVYSEQDTGQMHRQKADEAYLIGKGLPPVAAYLDIPDIIKVAKDNNVDAIHPGYGFLSERSDFAQACADADVMFIGPSPETVRKMGDKVEARSIAISAGVPVVPGTDAPIASLHEAQAFAQTYGFPIIFKAAYGGGGRGMRVVREYEELEENYQRAYSEALAAFGNGALFVEKFIEKPRHIEVQILGDKYGNVIHLYERDCSIQRRHQKVVEIAPAFQLDPHLRDRLHADSVNLAKQVGYENAGTVEFLVDKHGKHYFIEVNSRLQVEHTVTEEITGWDLVHAQLHVCEGRSLPDLNLKQDKIRVNGCAIQCRVTTEDPARGFQPDTGRIEVFRSGEGMGIRLDSASAFQGAVISPHYDSLLVKVIASGKDLQTASSKMSRALAEFRVRGVKTNIPFLQNVLSNHQFLHSTVDTQFIDENQELFNLKPTQNRAQKLLHYLGHVMVNGPTTPIPVKAKPSSTDPVIPPVTMGDPPLGFRDVLLRDGPEGFAKAVRAHQGLLLMDTTFRDAHQSLLATRVRTHDLKKISPFVSHNFSNLYSLENWGGATFDVAMRFLSECPWKRLQELRALIPNVPFQMLLRGANAVGYTNYPDNAVFKFCEVAKENGMDIFRVFDSLNYVPNMLLGMEAAGAAGGVVEAAISYTGDVSDPMRQKYSLDYYLKLAAELVKAGTHILCIKDMAGLLKPEASKLLIGALRDRFPDVPIHVHTHDTAGAGVAAMLACAEAGADVVDVAVDSMAGMTSQPSMGAIVACAKGTKLDTGIALEKVFDYSEYWEVARGLYAPFDCTATMKSGNADVYENEIPGGQYTNLHFQAHSMGLGNKFKEVKKAYTEANKLLGDLIKVTPSSKIVGDLAQFMVQNNLTRAEVEERADELSFPLSVVEFLQGYIGIPHGGFPEPFRSRVLKSLPRIEGRPGASLPSMDFKALEEGLRAAHSDEITPEDVMSAAMYPKVFQEYKEFTSNFGPVDCHSTRLFLDGPKIAEEFEVELERGKTLHIKALALGDLNKAGQREVFFELNGQLRSVLVKDTVAMKEMKFHPKAQKSIKGQVGAPMPGKVLEVKVEVGSKVEKGQPLCVLSAMKMETVVNSPVAGTVKAVHVTADASLEGDDLILEIEE

SEQ ID NO: 4930 - DNA, 1359 bp, Staphylococcus epidermidis
  CDS (1)..(1359)
atgtatcgatgtttgattgcaaatagaggcgaaatagcagtaagaattataagagcttgtagagagcttaacatagagacagttgccatttatgcaaaaggtgatgaaaatagcttacatgtaagtttagccgatcaagcaatatgcataggtgaagcaaatccattagacagttatttaaatattgatcgtattatatctgctgcaaaagttacagaatcaaacgtaattcaccctggctatggtttcttatcggaatctacgaattttgcgaaagccgttgaagacaatcatatacattttattggacctagtaagacaactatggaaatgatgggggataaaattactgccagacaaactgttaaacaagcaggagtacctgttataccaggttctaatgatgctgttcaaagtgtagatgaaattaaattattatccaaagaaataggatttccagttgtactaaaagcagctagtggtggtggtgggaaaggcatcagaattgttaaagaagcatctcatttggatcaggctttgaaagaagctaaaagtgaaggacaaaaatattttaatgatgatcgagtgtatgtagaggcgttcataccagtagcaaaacatgtagaagtgcagattatcggagacggtaaaaataactatgttcacttaggtgaacgcgattgttctgttcaacgaaagaatcaaaaattaatagaagaagcgccttgtgctgcattaactgaagaaagaagaacaagaatatgtggcgacgcagttaaagtagctcaagcttcaagatatcgtagtgctggaacaatagaatttttagttacagaagatgcacattattttattgaaatgaatgctcgtattcaagttgaacatacagttacagaaatgcgtgctgatagagacctattacaagctcagttatatttattaacacacggtgaattaccattcactcagaaagatattttatttaatggtcatgtaattgaggcgcgtataaatgctgaaaatcctgaaaaaaactttttacccactccaggaaaagttaataaattacacttaccacaaggatttaatatacgtgtagattctttactttacacaggttatcaggtttctccttattatgattcacttgtagctaaagtgattgtaaaggattctaatagacaaactgctattaataaattaaaagttgcgttagatgaaatggtcatcgaaggttttactactacagctgactttttatatgcggttttaaattatccaatatatgcaaaaggcgatgccagtaaagtagatataaaatttcttgaaaaacatcaaatcattaaagaggtgaaatga

SEQ ID NO: 4931 - protein, 452 aa, Staphylococcus epidermidis
MYRCLIANRGEIAVRIIRACRELNIETVAIYAKGDENSLHVSLADQAICIGEANPLDSYLNIDRIISAAKVTESNVIHPGYGFLSESTNFAKAVEDNHIHFIGPSKTTMEMMGDKITARQTVKQAGVPVIPGSNDAVQSVDEIKLLSKEIGFPVVLKAASGGGGKGIRIVKEASHLDQALKEAKSEGQKYFNDDRVYVEAFIPVAKHVEVQIIGDGKNNYVHLGERDCSVQRKNQKLIEEAPCAALTEERRTRICGDAVKVAQASRYRSAGTIEFLVTEDAHYFIEMNARIQVEHTVTEMRADRDLLQAQLYLLTHGELPFTQKDILFNGHVIEARINAENPEKNFLPTPGKVNKLHLPQGFNIRVDSLLYTGYQVSPYYDSLVAKVIVKDSNRQTAINKLKVALDEMVIEGFTTTADFLYAVLNYPIYAKGDASKVDIKFLEKHQIIKEVK

SEQ ID NO: 4932 - DNA, 1359 bp, Staphylococcus epidermidis
  CDS (1)..(1359)
atgaaaaagattttaatcgctaatcgtggtgaaatcgcagtaagaataataagagcggcacacgatttaggtattcaaacagtagctatatactcagaaggtgacaaagatgcattacatactcaaattgctgatgaagcatactgcgtcggtcctactttatcaaaagattcttatttaaatataccaaatattttatctatcgctacttctacaggatgtgatggtgttcatcctggatacggctttttggctgaaaatggtgattttgctgaattgtgtgaagcatgccaattaaaatttattgggccaagctatcaatcaattcagaaaatgggaataaaagatattgctaaagctgaaatgattaaagccaatgtacctgtagtaccaggaagtgaaggacttattcaaagtatagatgacgctaaaaaaatagctaaaaaaatcggctatccagttatcatcaaagccacagcaggtggtggtggaaaaggtattcgggttgctcgtgatgagaaagaacttgaaactggttaccgtatgacacaacaagaagctgaaaccgcgttcggaaatggtggtttatacttagaaaaatttatagaaaactttagacatatagagattcaaattattggcgatacttatggaaacgttatacatttaggtgaacgtgattgtacaattcaaagaagaatgcaaaagctcgttgaagaagcaccctcaccagttttaagtgaagataaacgccaagaaatgggtaatgctgcaattagagccgcaaaagctgtaaattatgaaaacgcaggtacaattgaatttatatatgatttagatgataaccaattttatttcatggaaatgaatacacgtattcaagttgaacacccagtaactgaaatggtaacaggagtagatttagtaaaattacaactcaaagttgctatgggtgaggcgttaccttttaaacaagaagatatttccattaacggtcacgctattgaatttcgaatcaatgctgaaaatccttacaaaaactttatgccatcaccaggcaagattacccaatatcttgctccaggcggttttggagtgagaattgaatcagcatgttatactaattatacgataccaccttactatgactccatggtggcaaaacttatagttcacgaacctacacgtgaagaatcaattatgacaggcattcgtgctttaagtgaatatcttgttttaggtatcgacactacgattccattccacttaagacttctaaataatcatatttttagaagtggggaatttaatacaaaattcctagaaaagtataatattatggacgataataaccaatag

SEQ ID NO: 4933 - protein, 452 aa, Staphylococcus epidermidis
MKKILIANRGEIAVRIIRAAHDLGIQTVAIYSEGDKDALHTQIADEAYCVGPTLSKDSYLNIPNILSIATSTGCDGVHPGYGFLAENGDFAELCEACQLKFIGPSYQSIQKMGIKDIAKAEMIKANVPVVPGSEGLIQSIDDAKKIAKKIGYPVIIKATAGGGGKGIRVARDEKELETGYRMTQQEAETAFGNGGLYLEKFIENFRHIEIQIIGDTYGNVIHLGERDCTIQRRMQKLVEEAPSPVLSEDKRQEMGNAAIRAAKAVNYENAGTIEFIYDLDDNQFYFMEMNTRIQVEHPVTEMVTGVDLVKLQLKVAMGEALPFKQEDISINGHAIEFRINAENPYKNFMPSPGKITQYLAPGGFGVRIESACYTNYTIPPYYDSMVAKLIVHEPTREESIMTGIRALSEYLVLGIDTTIPFHLRLLNNHIFRSGEFNTKFLEKYNIMDDNNQ

SEQ ID NO: 4934 - DNA, 3465 bp, Staphylococcus epidermidis
  CDS (4)..(3465)
ggaatgtcttggcttttgaaacaaataaagaaattacttgttgctaaccgtggtgaaatcgccattagaatttttagagcggcagcagaattaaatatcagtacagtagcaatttattctaatgaagataaaagttcgttacatagatataaagcagatgaatcctatctagttggaagtgatttaggacctgctgaaagttatttgaatatcgaacgtatcatcgaagtagctcttcgcgcaggtgtcgatgcaattcatcctgggtatggttttttaagtgaaaatgaacaatttgcacgccgatgtgctgaggaaggcattaaatttataggtccgcatcttgaacatctagacatgtttggagataaggttaaggctagaacaactgctattaacgctaacttacctgtaatcccgggtacagatggtcctattgaaagttttgaagctgcagaacagtttgctaatgaagcaggttacccacttatgattaaggccacaagcggtggcggtggtaaaggtatgcgaatcgttcgtgaatcaagcgaattagaagacgctttccatcgtgcgaaatcagaagccgaaaagtcatttggtaatagcgaagtttatatcgaaagatatattgataatccaaagcatatagaggttcaagttattggtgatgaattcgggaatatcattcatttgtatgaaagagattgctccgtacaacgacgtcatcaaaaggttgttgaagttgcaccttcagtaggtctttctaacaaattaagagagcgaatttgtgatgccgcaattcaactgatggaaaatataaaatacgtcaacgctggaacagtagaatttttagtttctggggatgaatttttcttcattgaggttaatccacgtgttcaagttgagcatacaattactgaaatgattactggtatagacattgtgaaaacgcaaattttagttgctaatggagaatcgttatttggagataaaatctctatgccacagcaaaatgaaattcaaacattagggtatgcgatacaatgtcgtataacaactgaagatcctactaatgattttatgccagattctggcacaattattgcatatcgatcaagtggcggttttggtgtgagacttgatgcaggggatggattccaaggtgcagaaatttcaccttactacgattcactattagttaagctttctacacatgccgtttcatttaaacaagctgaagagaaaatggaacgttcattacgcgaaatgcgaattcgtggcgtaaagacgaatattccatttctcatcaatgttatgcgtaatgataaatttagaagtggtgattatactactaaatttattgaagaaacacctgaacttttcgatattgcaccgacattggacagaggtaccaagactttagagtatattggtaatgtgacgataaacggatttcctaatgtagaaaagcgtccaaaaccagaatatgaatctaccaaaatcccaaaaatttctcaaaagaaaatcaatcagttatttggaacaaaacaaattcttgagcaacatggaccaacaggtgttacaaattgggttagagaacaagaagatgttttaattaccgatactacatttagagatgcacaccaatctttacttgcaacacgtgtaagaacaaaagatatgatgaacattgcatctaaaactgctgaagtttttaaagatagtttttcattagaaatgtggggtggtgcaacatttgatgtcgcctataatttcttgaaagagaatccatgggaacgtttagaaagattgcgcaaagccattccgaatgtgttattccaaatgttattacgagcttcgaacgcagtaggttataaaaactatcctgataatgtaattaagaaattcgttcatgaaagtgcaaaagctggtgtagatgttttccgtatattcgactcattgaactgggttgatcaaatgaaagtagcgaatgaagctgttcaagaagctggaatggtatctgagggtacaatttgctatacaggtgatattttaaatgctgaacgttccaatatttatactttagattattacgttaaaatggctaaagaactggaaagagaaggattccatatattagcaattaaagatatggctggtttattgaaaccgaaagcagcttacgaattaattggtgaattacgtgaggcaacacatcttccaattcatttacatacacatgatactagtggaaatggattgttgacatataaacaagcaattgatgctggcgtagatattatagatactgctgttgcatctatgagtggtttaacgagtcaaccaagtgcaaattcattatattatgcactaaatggatttccacgtaatttaagaactgatattgatgggttagaagagttgagtcattactggtctgtagtcagaccttactatgcagactttgagagtgatatcaaatcaccaaatacagaaatttatcaacatgaaatgccaggtggccaatattcaaacttaagtcaacaagctaaaagtttaggattgggcgaacgttttgatgaagtcaaagagatgtatcgtcgtgtcaacttcctgtttggagatcttgtaaaagtaacaccatcttcaaaggtagttggagatatggcactatatatggtgcaaaatgatcttgatgaagatacggtcatcaatgatggttataaattagatttcccagaatctgttgtgtcattctttaaaggtgacattggacaacctgtcaacggattcaacaagaaattgcaagatgttattttaaaaggacagcaaccaattactgaaagaccaggtgaatacttggagccggtcgattttgaagcaatccgtcaagaattaagcgacatacaacaagacgaggtaacagaacaagatataattagttatgtactttatccgaaggtatataaacaatatattcaaacgaaagagcaatttggtaatgtatctttactggatacaccgacattcttatttggcatgcgtaatggtgaaacagttgaaattgaaattgatactggtaaacgtctaattattaaattagaaacaatcagtgaaccagatgaaaatggtaagcgtacaatttattacgctatgaatggtcaagcaagacgtatctatattcaagatgaaaatgttaaaacgaatgctaatgttaaacctaaggcggataaatcaaatccaaatcatattggtgctcaaatgcctggttctgtaactgaagtcaaagtgtctgtaggcgatgaagttcaagctaatcagccattattaatcactgaagcaatgaagatggaaacgacgattcaggcaccatttgatggaattattaaacaaatcaatgttgctaatggagatgccattgccacaggagatttattagtggaaattgaaaagcaatcataa

SEQ ID NO: 4935 - protein, 1153 aa, Staphylococcus epidermidis
MSWLLKQIKKLLVANRGEIAIRIFRAAAELNISTVAIYSNEDKSSLHRYKADESYLVGSDLGPAESYLNIERIIEVALRAGVDAIHPGYGFLSENEQFARRCAEEGIKFIGPHLEHLDMFGDKVKARTTAINANLPVIPGTDGPIESFEAAEQFANEAGYPLMIKATSGGGGKGMRIVRESSELEDAFHRAKSEAEKSFGNSEVYIERYIDNPKHIEVQVIGDEFGNIIHLYERDCSVQRRHQKVVEVAPSVGLSNKLRERICDAAIQLMENIKYVNAGTVEFLVSGDEFFFIEVNPRVQVEHTITEMITGIDIVKTQILVANGESLFGDKISMPQQNEIQTLGYAIQCRITTEDPTNDFMPDSGTIIAYRSSGGFGVRLDAGDGFQGAEISPYYDSLLVKLSTHAVSFKQAEEKMERSLREMRIRGVKTNIPFLINVMRNDKFRSGDYTTKFIEETPELFDIAPTLDRGTKTLEYIGNVTINGFPNVEKRPKPEYESTKIPKISQKKINQLFGTKQILEQHGPTGVTNWVREQEDVLITDTTFRDAHQSLLATRVRTKDMMNIASKTAEVFKDSFSLEMWGGATFDVAYNFLKENPWERLERLRKAIPNVLFQMLLRASNAVGYKNYPDNVIKKFVHESAKAGVDVFRIFDSLNWVDQMKVANEAVQEAGMVSEGTICYTGDILNAERSNIYTLDYYVKMAKELEREGFHILAIKDMAGLLKPKAAYELIGELREATHLPIHLHTHDTSGNGLLTYKQAIDAGVDIIDTAVASMSGLTSQPSANSLYYALNGFPRNLRTDIDGLEELSHYWSVVRPYYADFESDIKSPNTEIYQHEMPGGQYSNLSQQAKSLGLGERFDEVKEMYRRVNFLFGDLVKVTPSSKVVGDMALYMVQNDLDEDTVINDGYKLDFPESVVSFFKGDIGQPVNGFNKKLQDVILKGQQPITERPGEYLEPVDFEAIRQELSDIQQDEVTEQDIISYVLYPKVYKQYIQTKEQFGNVSLLDTPTFLFGMRNGETVEIEIDTGKRLIIKLETISEPDENGKRTIYYAMNGQARRIYIQDENVKTNANVKPKADKSNPNHIGAQMPGSVTEVKVSVGDEVQANQPLLITEAMKMETTIQAPFDGIIKQINVANGDAIATGDLLVEIEKQS

SEQ ID NO: 4936 - DNA, 1338 bp, Wigglesworthia glossinidia brevipalpis
  CDS (1)..(1338)
atgtttaataaagtattgattgctaacagaggagaaatagctttaagagttttgcgagcttgtaaagaattaaatataaaaacagtagctgtgtattctacttcggatagatttctaaagcatgttttattagcagatgaaactatttgtataggtccagcaaactctttagaaagttatttaaatattccatctattatatcagcagcagaaatcactggatctgatgcaatacatcccggatatggatttttatccgaaaattataattttgcagaacaagtagagaaatctggatttatatttataggtccaaattcaaatactttaaaacttatgggtgataaaatatctgctatttcagttatgaaaaaaataggaatgccatgcttgcctacatcttttaatatatctaaaaataatatcaaaaagaatacttttattgctaataaaataggatatcctattgtaataaaagcttcaaaaggaggtggcgggagagctatgaaaatagtttataaaaattccgaattggaagattctatttgcatatcaaaatcagaatctaaaatcgcatttaatgatgatagtttgtattttgaaaaatatattgaaaatgctaaacatatagagattcaggttttatctgatggacatggaaatgcagaatatttagtagaaagagattgttcaatacagcgtcgttatcaaaaaattttagaagaatcaccttctgtttatttgaataaaaaaattagaaattatttaggaaaattttgcataaaagcttgtttgcttattaattataaaggagtaggtacttttgagttcttatataaagataaaaatttttactttatagagatgaatacaagaattcaagtagaacatccagttacagaaatggtaacaggaatagatatagttaaagagcaattaaaaattgcttatggagaaaagcttaatttaaaaaacaaaattaatttttctggacatgctatagaatgcagaataaatgcagaagatcctaaaacttttttacccaattatggaaaaattagtagatttcatgcaccaggcggtcttggtgttagatgggagtctcatatatattcaggttataatgttcctgctttttatgatactttaatcggaaaacttatttgttttggagaaaatagaaaaatagcaatctcgaaaatgaaaaatgctttagaagaaattattgtagatgggataaaaactaatattaatttacatttaaaaataataaataacaaagattttttagatggagataaaattaatattaattttttatctaattttaatttttaa

SEQ ID NO: 4937 - protein, 445 aa, Wigglesworthia glossinidia brevipalpis
MFNKVLIANRGEIALRVLRACKELNIKTVAVYSTSDRFLKHVLLADETICIGPANSLESYLNIPSIISAAEITGSDAIHPGYGFLSENYNFAEQVEKSGFIFIGPNSNTLKLMGDKISAISVMKKIGMPCLPTSFNISKNNIKKNTFIANKIGYPIVIKASKGGGGRAMKIVYKNSELEDSICISKSESKIAFNDDSLYFEKYIENAKHIEIQVLSDGHGNAEYLVERDCSIQRRYQKILEESPSVYLNKKIRNYLGKFCIKACLLINYKGVGTFEFLYKDKNFYFIEMNTRIQVEHPVTEMVTGIDIVKEQLKIAYGEKLNLKNKINFSGHAIECRINAEDPKTFLPNYGKISRFHAPGGLGVRWESHIYSGYNVPAFYDTLIGKLICFGENRKIAISKMKNALEEIIVDGIKTNINLHLKIINNKDFLDGDKININFLSNFNF

SEQ ID NO: 4938 - DNA, 1362 bp, Synechococcus elongatus
  CDS (1)..(1362)
atggcctttaggaaaattttgattgccaatcgtggcgaaattgccctgcggattctgcgcacctgtgaggaactgggcattgcaacggttgctgtctattccacggtggatcgccatgcgctacacgtgcaattggccgatgaggcggtgtgcattggcgaagcccccagtagccgcagctatctcaatatccctaacattattgctgctgccctcacccgccatgtctcagcaattcaccctggctatggctttttggcggaaaatgcccgctttgccgagatctgcgccgatcacaaaattacatttattggtccgagtcccgctgccatgcgtgccatgggggataaatccaccgccaaagcaacaatgcaacgggtgggggtgccgacaattcccggcagtgatggactggtgcaggatgaggaaacggcgcgggcgatcgctcgtcaaattggctatcccctgatgatcaaagcgaccgctgggggagggggtcgcgggatgcgcttggtgcgttctgaggaggagctggggcgctcgttaagtgctgcccagggcgaagcggaagctgcctttggcaatgccggcgtctatctggagcgatttattgaaaatccccgccacattgaattccaaattctcgcggatagctatggcaatgtcattcacttaggggagcgcgattgctccgtccaaaggcgtcaccaaaagctccttgaggaagcccctagccctgccctcaccccggaactgcgcgccaagatgggggaagctgctgtcaccgctgccaaagccattaactatgtcggtgcgggcacaattgaatttctcctcgacggccaaaacaacttctactttatggagatgaatacccgcattcaggtggagcacacggtcacggaaatgattacgggtctcgatctgattgcggagcagattcgcattgctcagggggaacccctccgcttgacccaagagcaggttcagttgcagggacacgccattgagtgccgcatcaatgccgaagatccagagcgtaatttccgtccccatcccggtcgcattagtggctacttgcccccgggaggaccgggggtacgtatggattcccatgtctatactgactatgaaatccccccctactatgattccctcattgggaaattagttgtgtgggggagcgatcgccccgctgccattgcccgcatgaagcgtgccctccgggaatgtgcgattatgggggtgcccaccaccatccccttccatcagcaggtaatggacacaccggagttccgcagcggtattgtctataccaactttgtggataagctcatgactaccttgggctggaatgcttaa

SEQ ID NO: 4939 - protein, 453 aa, Synechococcus elongatus
MAFRKILIANRGEIALRILRTCEELGIATVAVYSTVDRHALHVQLADEAVCIGEAPSSRSYLNIPNIIAAALTRHVSAIHPGYGFLAENARFAEICADHKITFIGPSPAAMRAMGDKSTAKATMQRVGVPTIPGSDGLVQDEETARAIARQIGYPLMIKATAGGGGRGMRLVRSEEELGRSLSAAQGEAEAAFGNAGVYLERFIENPRHIEFQILADSYGNVIHLGERDCSVQRRHQKLLEEAPSPALTPELRAKMGEAAVTAAKAINYVGAGTIEFLLDGQNNFYFMEMNTRIQVEHTVTEMITGLDLIAEQIRIAQGEPLRLTQEQVQLQGHAIECRINAEDPERNFRPHPGRISGYLPPGGPGVRMDSHVYTDYEIPPYYDSLIGKLVVWGSDRPAAIARMKRALRECAIMGVPTTIPFHQQVMDTPEFRSGIVYTNFVDKLMTTLGWNA

SEQ ID NO: 4940 - DNA, 1371 bp, Streptococcus mutans
  CDS (1)..(1371)
atgtttaagaaaattttgattgccaatcgtggtgaaatcgctgtgcgtatcattcgagcagccagagaattaggaattgtgactgttgcagtttattcagaagcagataaagaatcgcttcacaccctcttagcagatgaggctgtatgtgttggaccggctaaatcaacggattcttaccttaatatgaatgctattttatcagcagctattgtaactggagctgaagctattcatccaggttttggttttttaagtgaaaattctaaatttgcaactatgtgtgaagagatgcgtattaagtttattggtccatctgcatctgttatggacaaaatgggtgataaaattaatgcacgttctgaaatgcttaaagccaaggttcctgttattccagggtcagatggggaagtttttactgcccaagaagcattagaaattgcccaagatattggctatcctgttatgctgaaagcttctgctggtggtggtggtaagggcatccgtaaggttgataaaaaggaagatctaacagcagcttttgagtcagcctctcaagaggctctatcagcttttggcaatggcgctatgtatctggaaaaagtcatttatcccgctcgccatatagaagttcaaatactgggggactcttttggcaatattattcatcttggtgaacgtgattgttcattgcaacgtaataatcaaaaggtcttagaagaaagcccttctatagctattgggaaaacacttcgtggtaaaatgggtgatgcagcagttcgtgccgctaaagcggttgcttatgaaaatgccggaacaattgaatttctcttggatgaggcttcagggcaattctattttatggaaatgaacacacgtgttcaggtcgaacatcctgtaacagaatttgtgactggtattgatatcgttaaagaacagattaaaattgctgctggtcaagaattgacttatcaacaaaaagatattgttatttcagggcatgctattgaatgtcggattaatgcagaaaatcctaaatttaatttcgcacctagcccaggtaaagttgaagatctctttttaccaagtggtggcgttggtttacgtgttgatagtgctatgtacaataactatactattccgccttattatgacagtatgattgccaaaatcattgttcatggagaaaaccgctttgatgctttaatgaaaatgcagcgtgctctgtatgaatttgaagtaactggtgtggttacgaatgcagagtttcaactggacttaatttctaatccaaatgttattgctggtgattatgatacttcttttttgatggaaacttttttacccgcttatgctaatgataaagaatag

SEQ ID NO: 4941 - protein, 456 aa, Streptococcus mutans
MFKKILIANRGEIAVRIIRAARELGIVTVAVYSEADKESLHTLLADEAVCVGPAKSTDSYLNMNAILSAAIVTGAEAIHPGFGFLSENSKFATMCEEMRIKFIGPSASVMDKMGDKINARSEMLKAKVPVIPGSDGEVFTAQEALEIAQDIGYPVMLKASAGGGGKGIRKVDKKEDLTAAFESASQEALSAFGNGAMYLEKVIYPARHIEVQILGDSFGNIIHLGERDCSLQRNNQKVLEESPSIAIGKTLRGKMGDAAVRAAKAVAYENAGTIEFLLDEASGQFYFMEMNTRVQVEHPVTEFVTGIDIVKEQIKIAAGQELTYQQKDIVISGHAIECRINAENPKFNFAPSPGKVEDLFLPSGGVGLRVDSAMYNNYTIPPYYDSMIAKIIVHGENRFDALMKMQRALYEFEVTGVVTNAEFQLDLISNPNVIAGDYDTSFLMETFLPAYANDKE

SEQ ID NO: 4942 - DNA, 1371 bp, Streptococcus agalactiae
  CDS (1)..(1371)
atgtttaagaaaatattgattgctaatcgcggagaaattgcagtacgtatcattcgtgcagcccgtgaaatgggaatttcgacagttgctatctattcggaggctgacaaggaatcattgcacacaattttagcagatgaagctatttgtgttggaccagccaaatcagcagaatcttatttaaacgttaatgctatattatctgctgctattgtgactggagcggaagctgttcatccaggttttgggtttttgagtgaaaattctaaatttgctactatgtgtgaagagatgaacttaaaattcattggtccatctggagaagttatggataaaatgggtgataaaatcaatgctcgtacagagatgataaaagctgatgttccggttatcccaggatcagatggtcaagttacaagtgtagaagaagctgtatcaattgctgaggaaatcggctatccattgatgttaaaagcctcagccggtggcggtggaaaaggaattaggaaggtcaaatcagcagatgaattgaagcctgcttttgagtctgcttcacaggaggctttggctgcgttcggtaatggtgctatgtatattgaaaaagttatatacccagctagacatattgaagtacaaatacttggagatagctttggtaagatagttcacctaggagaacgtgattgttctctgcagcgtaacaatcagaaggtattggaagaaagtccgtctgtggcaataggtaacactctgcgtcaacaaattggtgaagcagctgttcgtgcagctgaggctgtatcttatgaaaatgcaggaacaattgagtttttgttagatgagaatagcggacagttctatttcatggaaatgaatactcgtgttcaagtagaacaccctgttacagaatttgtaacgggtgttgacatcgttaaagagcagattcgtatcgctgctggaattcctttatcagtttctcaaaatgatattaagttaactggtcatgcgattgaatgtcgtattaacgcagagaatccacaatttaattttgcgccatgtccaggtaccattaatgggttacatctacctgctggcggtatgggcttacgtgtcgattcagcggtttacacaggctacactattcctccttattacgatagtatgattgcgaaagtaattgttcacggagaaaatcgttttgatgcacttatgaaaatgcaacgtgccttatatgagcttgaaattgatggtattgtaacaaatacagaatttcaaatggatctcatttctgataaaaaagtcttggctggggattatgatacttcattcctgatggaagactttttaccaaggtattatggtaacaatcaatag

SEQ ID NO: 4943 - protein, 456 aa, Streptococcus agalactiae
MFKKILIANRGEIAVRIIRAAREMGISTVAIYSEADKESLHTILADEAICVGPAKSAESYLNVNAILSAAIVTGAEAVHPGFGFLSENSKFATMCEEMNLKFIGPSGEVMDKMGDKINARTEMIKADVPVIPGSDGQVTSVEEAVSIAEEIGYPLMLKASAGGGGKGIRKVKSADELKPAFESASQEALAAFGNGAMYIEKVIYPARHIEVQILGDSFGKIVHLGERDCSLQRNNQKVLEESPSVAIGNTLRQQIGEAAVRAAEAVSYENAGTIEFLLDENSGQFYFMEMNTRVQVEHPVTEFVTGVDIVKEQIRIAAGIPLSVSQNDIKLTGHAIECRINAENPQFNFAPCPGTINGLHLPAGGMGLRVDSAVYTGYTIPPYYDSMIAKVIVHGENRFDALMKMQRALYELEIDGIVTNTEFQMDLISDKKVLAGDYDTSFLMEDFLPRYYGNNQ

SEQ ID NO: 4944 - DNA, 2085 bp, Shewanella oneidensis
  CDS (1)..(2085)
atgttgaccaagcagatgttgactaacagcatgttcactaagcttttaattgctaaccgtggtgaaattgcctgccgcattatcaaaaccgcgcaggccatgggcgttcgcaccgttgctttatattccgatgccgataaaaacgcgcgccatgttgccatggctgacgaatcgttttacttaggtggcagcgccccagcagattcttacctcaagggcgacttgattattgcaatcgccaaaaaagctcaggcgcaagccattcacccaggttatggcttcttatcggaaaacgccgactttgcccgcaagtgtgaggcggccggaatcgtgtttgttggcccgggcagcgatgccatcgatgccatgggcagcaagagcgcggccaaagccattatgacggcggcgcaagtgcctttagtgccaggttaccatggtgacgatcaaaccgatgccaccctcaaggccgaagccttaaaaatcggtttcccgatgctgattaaagccgcctacggtggcggtggcaaaggtatgcgtatcgttgagcatgaaggcgaaatcatggacgccatcaactctgcgcgccgtgaagcggcctcctccttcggtaacgataagttattgatggagcgttatttacgccagcctcgccatgtcgaagtccaagtgtttgccgatacctttggcaatgcaatttacttatcggatcgcgactgctcgattcaacgccgccatcaaaaagtggtcgaagaagcgccagccccaggtttaagtgatgagctgcgcgcccaaatgggtgaagctgccgtagccgccgccaaggctatcgattatgttggcgcgggaaccattgaattcctgttagataccgacaatagcttctactttatggagatgaatactcgtctgcaggtagaacacccagtgaccgaaatggtgactggccaagacttagtcaaatggcagttgatggtcgccagtggtcagcctttaccgctcaaacaggacgaagtgcgtatccacggccacgcctttgaggtacgtatttatgccgaagatccgcaaaatgagtttttacccgccagcggtaagctcaatttcctgcgcgagcccgagcaaagcaaatacgtgcgtattgattccggcatccgtgaaaacgatgtgatcagtaacttttatgatccgatgatcgccaaactgattgtgtgggatgagtcgcgtccacgtgcgctgcaacgcctagtgcatgccctcgagtcctatcaaatcagtgggcttaaacacaatattgaatttttggccaatattgccgagcatcccgcctttgccaaggccgactttagcaccgactttatcaaccgttacggcgatgcgctgattggcagtgcttcgagcgaagccgacactgcgcttgcctttgccgcgctgtatcaagtgcttgcccgtaaagaagccgccaaggcacaggcgattaatagcgccgatccagactcgccttggggccaagtcagtggctttagactcaacagtgtcagccagcattctattgctctgctcgacgatgcccacgagttacaacaattggtattgttagactttggcgatcactatcaactatcacataatcgatcgtcacagcatcaattatcccaatccgcagccgatggccaagtgagtaaatccctaagtggtgagcttaagcaggatttactgttagccgaaatcaacggccataagagtaaagtgcctgtcagcgctcagggcgatgattttacgctgtttttaccatcaggcagttatcacttcagggcggttaaaacccaagtggttgaggcagaatcgagcaatgaagataagctcaaggcaccgatgaacggcactgtcgtgactcacttggtcgatgttggtgcagaggttaaggcgggacaagggctactggtgatggaagcgatgaagatggaatacaccattgaagcccccttcgacggtatcgttaccgagttctactttaaggcaggtgagcttgtgagtgatggcgccgtgctgctccatgttgagcccaaagcccagagcgaggaagcctaa

SEQ ID NO: 4945 - protein, 694 aa, Shewanella oneidensis
MLTKQMLTNSMFTKLLIANRGEIACRIIKTAQAMGVRTVALYSDADKNARHVAMADESFYLGGSAPADSYLKGDLIIAIAKKAQAQAIHPGYGFLSENADFARKCEAAGIVFVGPGSDAIDAMGSKSAAKAIMTAAQVPLVPGYHGDDQTDATLKAEALKIGFPMLIKAAYGGGGKGMRIVEHEGEIMDAINSARREAASSFGNDKLLMERYLRQPRHVEVQVFADTFGNAIYLSDRDCSIQRRHQKVVEEAPAPGLSDELRAQMGEAAVAAAKAIDYVGAGTIEFLLDTDNSFYFMEMNTRLQVEHPVTEMVTGQDLVKWQLMVASGQPLPLKQDEVRIHGHAFEVRIYAEDPQNEFLPASGKLNFLREPEQSKYVRIDSGIRENDVISNFYDPMIAKLIVWDESRPRALQRLVHALESYQISGLKHNIEFLANIAEHPAFAKADFSTDFINRYGDALIGSASSEADTALAFAALYQVLARKEAAKAQAINSADPDSPWGQVSGFRLNSVSQHSIALLDDAHELQQLVLLDFGDHYQLSHNRSSQHQLSQSAADGQVSKSLSGELKQDLLLAEINGHKSKVPVSAQGDDFTLFLPSGSYHFRAVKTQVVEAESSNEDKLKAPMNGTVVTHLVDVGAEVKAGQGLLVMEAMKMEYTIEAPFDGIVTEFYFKAGELVSDGAVLLHVEPKAQSEEA

SEQ ID NO: 4946 - DNA, 4554 bp, Shewanella oneidensis
  CDS (1)..(4554)
atgaccagcaataatcagcccaaacacatgactcaagcccaaacgcccgatccgctttttttacaggccgagcatttggcaaaggatttttctctgtttcctaaacacagcaaacagagtttatcagaagaaattaaaggtcttttaaacgacgatgccattcaggcaaatttaaaagacttggcatcattagatgtcgacggttacgtagcaaaagtgatccagccgacccaagataaaggtcgtcctggtgcgaaacgtatcattgcagacctaaaaggtcgcttgatcacggaaacccacttgggctctttctatagcgctgaggtcgagctgaatttcggttcacgcactcgtcgtatcggctttattgcccaagagcgcacaaccgctaacggtgcgtggatgcctgagcatcactatgcggcttgcaaagcgattcgtcattttgccgaattgtctatgcctatcgtctatttaatcgatacccctggggccgatgcaggcgaagtggccaacagccaaaaccaagcacattctatttctaaggcgattgccgaaagtgccaacgttgacgtgcctaccgtgggtatcgttatcggtgcgggttactctggtggcgcgattccattagcagcggcaaacatcctgttatcgctgcgcgatggtattttcaacacgatccagccacaaggtctgcaaagtattgcccgtaagtacaacttatcttggcaagaatgtgcgaaatcagtgggtgtatcaccagaagagctatatacctcaggttgtatcgacggaatcatcgatttctcaccaggggatcgtgacgagcgtcagcacaatttacgccgtgcgataatcagtagtatcgaggcggttgagcgtgcagcggtaaactttgtgcgtgaatcaaaagatttacgcgagcattatgatcgcagtttagcgcgtttccttaatccatctaaaaatctgatggcattagagctaaatgcagaattagccgtagctactagcccaaccaaccaccataacctgtttggtagtgcctatcgttacctgcgttatctaacgctgcgtagccgtattcattcgatctctcaggagcaatacggacgtttgtcacgtgtcagtgtgcctgagggggatctgttagcacgtatccagcaggagcaagatcgtgtattccaagcgtggttagctagccccgataagctggtttacgatgaagatctcaacaagttatgggcgaactttattgctaagcgcgatgaaatctcaaccgaacgtaatatgctgacacgttttattttgggtgagccaaaagagaactataaaaaagcgcgtaaggcactgttatttaacatcagttggtctttatatcaccgttggaagagcaatgctgcgaacaactttaagggcttaattcagcatcttgaaaatctgcctaagtctgtgactcaagcaaagtggcctgagctaaatcaactgacagtgcttgacgttgttgttaacgatgagctgcgtgaagactttatttggcaatgtcataacatcctgatctttaactcactctacgacaacgttgtgggtagcttagcgtcaatcgcgaaagaagccatgatgtcaaagagcttgtctcgtaattcagtgaacaatctgctgcataagtcgattgaccatgcgctgtcgactcaagatacggctaacgacaaggcgaaattctacaagtggctcaagtattttatgggccaatctaaccgtgccgatttactggtgcgtgtagagcaatggaagagtgtgggcttcccgcagcttaacgacagtttattcgttatcctgacttacttcttcgagcgtttattacctgaatacttcgacagtgaaagcgatcacagtaaatatactggcgcgattaaccctgtacgtatcgggcgtcgtaaggacttctggaaccgcttgaccatgggttatcaggatctgttgatccaaaaagtactacgtgacgaaaaacgtactggcaagatgacgtgggaaaatgtgattaagcaattcttcacccatttcgacgaaatcaatggcgacaagatgtcggctaacttgctcaacttccctggtttccgtctatcaattgaagatgcgttagataaaggtattcgtccttgcggtctgatcactggtattgctgactttaaagaaaaaggtcaaaaagtgcgtgtgggtctggctgtgtctaacactgcattccaagccggtgccttcgatatggccagtgccgagaagttttctgcgctgctgatcgagtgtgctaagcgtaagctaccagtggtttgctttatcagctcaggcggtatgcaaaccaaagaaggtgccgcggcactgttctccatggcggtagtgaacgaccgtatcacccgttttatccgtgataacgaattgcctgtactgatgtttggttttggtgactgtaccggtggtgcgcaggcgagttttgtgactcacccattagtgcaaacttactatctgtctggtactaacatgccattcgcaggtcaaatggtggttcctgcgtacttaccatcgacgtcgacactgtcgaattacctgtcgaaagtacctggcgcaatggccggcctagtccataacccatttagcgaaaacttagacaatcaattggcgagcatcgatccattgatgccaatgccgacggctaagattaatgaggttatcattaacgccttgtcaacactggttgtagaagcgccagctgaagaagaggaaattgtacaaaacgatccgcgtaagctgatgaaaccaatcaataaagtattggttcatgcccgtggttgtaccgctgttaagttgatccgtaaagcgcatgataacaatatcaacgtagtattggtggcgtcagatcctgatatgaccgccgtacctgcggatatgttgaaagagtctgacaagctagtctgtttaggtggtaacacctctgacgaaagttacctgaacgcatactcagtactcaaagtggctgaatatgagcaagttgatgcactgcacccaggtatcggcttcctgtctgaaagcccgcaatttgcggcattgtgtgtcaacaatggcgttaactttgttggccctagcgtacattcaatgacgactatgggtaacaagtcgaacgcaattaagacatcacaagcgcaaaacgtgccagtggtaccaggttcacacggtattttgactaacgctgagcaagcggtaaacgtagctagtgaaattggttacccagtactactcaaagcggtacaaggcggtggtggtaaaggtatccaggtcgttaaacgtcctgaggatatgattggtttattccaaaaaacggctaccgaagcggctgctgcttttggtaacggcgatttgtacttagaaaaatatgtcacttcactgcgtcatatcgaagtgcagttactgcgcgacaagtttggtcacgctaaggttcttggtttacgtgactgttctgtacaacgtaacaaccagaaagtcgttgaggaatctggctcaaccatgctgccagatgaactgaaaaaacaagtgctggcttacacccgtgccttaggtgatgcgaccgattacatgggcgcaggtactgttgagttcatctacaacttagacgcaaacgaagtgtacttcatggaaatgaacacccgtctgcaggtagagcatccagtaactgaagcgacttctggtatcgatattgtgagcgcacaatttgatatcgcagcgggtcgttcaatcgagcacttagagccgaaagaaatcggttatgcgatggaagtgcgtgtaacggctgaaaaagcggcactcgacagccatggcgtacttcagttgatccctaatcctggcaagatcaccgaatgtgtattccctgatcatccagatgtggaaatcatctcgattgccgcaccgggtaaagaagtatcaccttattacgacagcttaatcgctcaggtgattatgcgcggtgaaaaccgtgaagacgttatcgcgaaacttcatgcttacctcgacagcgtagtgcttaaaggtatcgcgactaacattccattgctgaaactgatcttaagcgatggcaccttcaaagaaggcgtatacgatactaactacctgccacgctttatggctgagctagacattccagcgctgatcgctgaaatggaagccgctgccgaaactgttggtgtggatactgagtcgctccgtgtgggtgaaagtaacgaactgaaagtattagcccaaggcgcaggtatcttctatacctctccagcgccaggcgaacctgatttcgtgaaagaaggtgatatcgttactgctgaacaaacgcttgccttaactgaagcgatgaagatgttctcgcaggttaacttagccggcttcaaccgccaaggcgcagtactctatccagaagataagaagtaccgcattgagcgtattctgaacagcaatggtcagcaagtatcgcaaggtgacttactcttcgtcgtatcgccagttgaagattaa

SEQ ID NO: 4947 - protein, 1517 aa, Shewanella oneidensis
MTSNNQPKHMTQAQTPDPLFLQAEHLAKDFSLFPKHSKQSLSEEIKGLLNDDAIQANLKDLASLDVDGYVAKVIQPTQDKGRPGAKRIIADLKGRLITETHLGSFYSAEVELNFGSRTRRIGFIAQERTTANGAWMPEHHYAACKAIRHFAELSMPIVYLIDTPGADAGEVANSQNQAHSISKAIAESANVDVPTVGIVIGAGYSGGAIPLAAANILLSLRDGIFNTIQPQGLQSIARKYNLSWQECAKSVGVSPEELYTSGCIDGIIDFSPGDRDERQHNLRRAIISSIEAVERAAVNFVRESKDLREHYDRSLARFLNPSKNLMALELNAELAVATSPTNHHNLFGSAYRYLRYLTLRSRIHSISQEQYGRLSRVSVPEGDLLARIQQEQDRVFQAWLASPDKLVYDEDLNKLWANFIAKRDEISTERNMLTRFILGEPKENYKKARKALLFNISWSLYHRWKSNAANNFKGLIQHLENLPKSVTQAKWPELNQLTVLDVVVNDELREDFIWQCHNILIFNSLYDNVVGSLASIAKEAMMSKSLSRNSVNNLLHKSIDHALSTQDTANDKAKFYKWLKYFMGQSNRADLLVRVEQWKSVGFPQLNDSLFVILTYFFERLLPEYFDSESDHSKYTGAINPVRIGRRKDFWNRLTMGYQDLLIQKVLRDEKRTGKMTWENVIKQFFTHFDEINGDKMSANLLNFPGFRLSIEDALDKGIRPCGLITGIADFKEKGQKVRVGLAVSNTAFQAGAFDMASAEKFSALLIECAKRKLPVVCFISSGGMQTKEGAAALFSMAVVNDRITRFIRDNELPVLMFGFGDCTGGAQASFVTHPLVQTYYLSGTNMPFAGQMVVPAYLPSTSTLSNYLSKVPGAMAGLVHNPFSENLDNQLASIDPLMPMPTAKINEVIINALSTLVVEAPAEEEEIVQNDPRKLMKPINKVLVHARGCTAVKLIRKAHDNNINVVLVASDPDMTAVPADMLKESDKLVCLGGNTSDESYLNAYSVLKVAEYEQVDALHPGIGFLSESPQFAALCVNNGVNFVGPSVHSMTTMGNKSNAIKTSQAQNVPVVPGSHGILTNAEQAVNVASEIGYPVLLKAVQGGGGKGIQVVKRPEDMIGLFQKTATEAAAAFGNGDLYLEKYVTSLRHIEVQLLRDKFGHAKVLGLRDCSVQRNNQKVVEESGSTMLPDELKKQVLAYTRALGDATDYMGAGTVEFIYNLDANEVYFMEMNTRLQVEHPVTEATSGIDIVSAQFDIAAGRSIEHLEPKEIGYAMEVRVTAEKAALDSHGVLQLIPNPGKITECVFPDHPDVEIISIAAPGKEVSPYYDSLIAQVIMRGENREDVIAKLHAYLDSVVLKGIATNIPLLKLILSDGTFKEGVYDTNYLPRFMAELDIPALIAEMEAAAETVGVDTESLRVGESNELKVLAQGAGIFYTSPAPGEPDFVKEGDIVTAEQTLALTEAMKMFSQVNLAGFNRQGAVLYPEDKKYRIERILNSNGQQVSQGDLLFVVSPVED

SEQ ID NO: 4948 - DNA, 1368 bp, Oceanobacillus iheyensis
  CDS (1)..(1368)
atgattaagaagctattaatagctaatagaggggaaattgcggttcgtattattcgtgcttgtaaagaaatgaatatcgaaacggttgccatttactcagaagccgatagcgaatcccttcatgtacaattagccgatgaagcatactgtattgggcccaaattaagtaaagacagctacttaaacataacgaatataatgagtcttgccacactaaccgaagttgatgctatccatccagggtatggttttttagctgagaatgctgattttgctgagatatgcagagcttgtaatatcaccttcgttggccctactccaaaagcaattcaacaaatgggaataaaagatgttgcaaaagaaacaatgaaaaatgctaatgtacctgttgttccaggttctgaaggtattgtcgatacaactgaagatgctatcgaagtagctaatagtatcggttatcctgttatcatcaaagctactgctggtggcggcgggaaaggtattcgcgttgctcgcagcgaagaagagcttattaaaggaatggaaataactcaaaaagaagcagaaacagcttttggaaatccaggtgtatacctagagaaattcattgaggattttcgtcatgttgaaattcaaatacttgctgacactcacgggaatgtaatccatcttggagagagagattgctcgattcagcgtagactacagaaattgattgaagaatcaccttctcctgcacttaatgaatccattcgtgctaaaatgggagaagcctctgtaaaagcggctaaagccgtagaatatgttggtgctggtaccattgagtatattttcgatcgaaaaacgaatgagttctatttcatggaaatgaatactagaatacaagtagagcaccctgtaacagaaatggtaactggtgtagatttaattaaagaacaaattaatgttgcaaatggcgaaaagctatcagttaatcagtcagatataacgatggacgggtgggcaattgaatgtcggattaatgccgaaaatccataccaaaattttatgccatctgcgggtgagattgaaatgtatttaccacctggtggattaggagttcgtattgattctggtgcatatactggatatcgaattccaccatattatgattcgatgattgctaagctaataacatatgctccaacgagagaagaagcaattagcaagatgaagcgagcattagatgagtttgttgttgaaggagtctttacaacaattccttttcactaccaaattatgaatcaccaagtatttcaagaaggtgattttaatactaatttccttactgaatatccgattttgcaggacacagatgattccgaataa

SEQ ID NO: 4949 - protein, 455 aa, Oceanobacillus iheyensis
MIKKLLIANRGEIAVRIIRACKEMNIETVAIYSEADSESLHVQLADEAYCIGPKLSKDSYLNITNIMSLATLTEVDAIHPGYGFLAENADFAEICRACNITFVGPTPKAIQQMGIKDVAKETMKNANVPVVPGSEGIVDTTEDAIEVANSIGYPVIIKATAGGGGKGIRVARSEEELIKGMEITQKEAETAFGNPGVYLEKFIEDFRHVEIQILADTHGNVIHLGERDCSIQRRLQKLIEESPSPALNESIRAKMGEASVKAAKAVEYVGAGTIEYIFDRKTNEFYFMEMNTRIQVEHPVTEMVTGVDLIKEQINVANGEKLSVNQSDITMDGWAIECRINAENPYQNFMPSAGEIEMYLPPGGLGVRIDSGAYTGYRIPPYYDSMIAKLITYAPTREEAISKMKRALDEFVVEGVFTTIPFHYQIMNHQVFQEGDFNTNFLTEYPILQDTDDSE

SEQ ID NO: 4950 - DNA, 1341 bp, Oceanobacillus iheyensis
  CDS (1)..(1341)
atgattaagagaatgttgattgctaatcgaggtgaaattgctcggagaatcattcgtacatgtagacaattaaatattgaaacaattgccatatactcagatgccgataaagatgctttatttgtaaaagaagcagacgaatcttatttagttggtggaaatcgagtacaggaaagttatttgaatgtagataaaatctttgaaatagcgaaacaggcaaacatagatgctattcaccctggttatggattccttagcgagaatgctagttttgctaatcgttgcttgaaagaaaagattacgtttataggaccatctcctgaaataattgaactaatgggggacaaaatagcagctagaagaacgatgaaacaggcaggtgtacccattgttccgggtacagaagaagcgatttcttcggttgaagaagctgtgaagtatgcatctgagattggttatcctattatgcttaaagcagctgctggaggcggcggtatcggaatgcaaattgttcataacgatgatgaattagtgaaagcatttgatagcaattcaaaaagagcagctaatttttttggtaacggttccatgtttttagagaaaaaaatagaagaaacaagacatattgaatttcaagttttggctgaccatcatgggaatgttgttcatttattcgaaagagagtgttccattcagagaaggaatcaaaaagtaatagaagaagctccatctccattcgtatcagatagattgcgcaaagatatgggagaagcatccattcgagcaacaaaacaaataaactatacgaatgctggaacgattgaatttcttgttgataaggaagaaaactactactttttagaaatgaatacacgtatacaagtggaacaccccataacagaggaaaccacaggtatcgatattgttgaacatcaaattaaaatagcacaaggggaatcactgcaaataacacaaaatgacatacgacaaactggtcatgctattgaagctagaatctatgcagaagacccgataacatttttcccttcacccggtaaaattactcaattctctttaccaaaaggagagtgtattcgaaatgaatgtgcagttaaagaaggagatcaagtcacaccattttacgatccaatgatagcaaagctcattgttacgggcgatacaaggtctgaagcgattgctaatttaaaagttgcgatgaatcaatttatagtagaaggaattaagacaaatatcacaatgataaaagaaattatcgattaccccgcttatgtgaatggggatacgacgacaacatttatccaagattattatcaaaaataa

SEQ ID NO: 4951 - protein, 446 aa, Oceanobacillus iheyensis
MIKRMLIANRGEIARRIIRTCRQLNIETIAIYSDADKDALFVKEADESYLVGGNRVQESYLNVDKIFEIAKQANIDAIHPGYGFLSENASFANRCLKEKITFIGPSPEIIELMGDKIAARRTMKQAGVPIVPGTEEAISSVEEAVKYASEIGYPIMLKAAAGGGGIGMQIVHNDDELVKAFDSNSKRAANFFGNGSMFLEKKIEETRHIEFQVLADHHGNVVHLFERECSIQRRNQKVIEEAPSPFVSDRLRKDMGEASIRATKQINYTNAGTIEFLVDKEENYYFLEMNTRIQVEHPITEETTGIDIVEHQIKIAQGESLQITQNDIRQTGHAIEARIYAEDPITFFPSPGKITQFSLPKGECIRNECAVKEGDQVTPFYDPMIAKLIVTGDTRSEAIANLKVAMNQFIVEGIKTNITMIKEIIDYPAYVNGDTTTTFIQDYYQK

SEQ ID NO: 4952 - DNA, 3444 bp, Oceanobacillus iheyensis
  CDS (1)..(3444)
atggcagagttaaacaagattaacaaagtactagtagcaaaccgaggggaaattgcaattcgcgtcttccgagcatgtacggagttaaatatacgcactgttgctatttattccaaagaggattcatctgcttttcatcgattcaaggcagatgaagcttatttaataggtgaagggaaaaaaccgattgatgcatacttagatattgaagggattattgaacttgcaaaagaagtcaatgttgatgcaattcacccgggttatggattcctttctgaaaatatacagtttgcaagacgctgtgaagaagaaggaattatctttattggaccaactagtaaacacttaagtatgtttggtgataaggtgaaagcaagagagcaagcagtagcagctaacttaccaatcatacctggaagtgatggtccagtaagctcattagaagaagttcaagactttactcaggaacatggatatccaataattattaaagcttccttaggtggcggcggtcgtggaatgcgtgtagtgaaagatgatagtgaactagagagtgcatatgatcgggcgaaatcagaagctaaagccgcttttgggaacgatgagatatatgtagagaggttaatcgaaaatcctaaacatatcgaggttcaaatattaggagataatgcaggcaatattgttcatttatatgaaagagattgttctgtccaacgtcgacatcaaaaacttattgaaatagcaccaagtttatcattgggagataaattacgagaagatatctgtcaatctgcggtaaacttaatgaaaaatgtagattatttaaatgccggaacagttgaatttcttgttaccgatgatgagtttttctttattgaggttaaccctcgtgtacaagtagaacacactattacagaaatgattactggtattgatatcgtccagtctcaaattaagattgctgatggagctcaattacacgatgaaacagtaggaattccgacacaagaacatataaatacacagggctatgcgattcaatcaagggtaacaacggaagatccacttaatgattttatgccagatgcaggtaaaattaatgcttatcgtaccggcggtgggtttggtgtccgtctagatgcgggtaacggctatcaaggagcaatcatttctcctcactatgattcgttattagtgaaagtatctacgtgggcattaacttttgaacaagctgcaataaaaatggtcagaaatttaaaagaattccgtattagagggataaaaacaaatattccgttcctagagaatgtaatggttcatcaaaaattcttatctggtgaatatgatacaacgtttatcgataaaacaccggagctattcatattcccgataagaaaagaccgtggaacaaaaatgcttacgtatatcgcaaatactactttaaacggaggggaaggcatcgctaatattgagaagcctgactttagaccgttggatattcctgctacaaaccatattgaatcagtatctaccggaacaaaacaaatcttggataagtatggtcctgaaggtgtagcgaaatggatgaaagaacagaaggaagtattattaacagacacaactttcagagatgcacaccaatcgttatttgcgacacgtgttcgtacgaatgacttgcttcatattgctgaaccaacgtctaaactgctgccaaatcttttctctgtagaaatgtggggaggagcaacgtacgatgtagcttatcgttttcttaaggaagatccttggacaagattgttaaaattacgtgaagaaatgccgaacgtactattccaaatgttattacgtgcgagtaatgctgtagggtataaaaattatcctgataatctcattgaagaatttgtaaagaaaagcagtgaagcgggtattgatgtattccgtatattcgacagcttgaactgggtagaaggaatgaagttgacaatcgatgcggtacgcaattcaaataaaattgctgaagcagctatttgttatacaggtgatatattagacacaggtagaagtaagtatgatgtgtcttactatcaaatgatggcaaaagaattagaatctgcaggtgcacatatcttaggtattaaagatatggctggtttattaaagccagaggccgcttatcaattaattcataaattaaaagagacgattgatatacccattcatttacacactcatgatacgagtggaaatggtgtgttcacatatgctcgtgctattgaagctggcgtagatgcagtagatgttgcagttgggtcaatggcaggtatgacttctcaaccaagtgcacagtcgctttatcatgcattagagggaactccattccagccggatattaatattgaaaattatgaacgtatcgggcattattgggaagggattcgtgattactatcaagaatttgaaagtggtatgaacgcaccacataccgaaatttatcatcatgaaatgcctggaggacaatatagtaaccttcagcaacaagcaaaagccgtagggttaggtcatcgttggaatgaagttaagaaaatgttccgtacggtaaacgatatgtttggtgatattgttaaagtaacaccttcatcaaaagttattggtgatatgacactatttatggtgcaaaacgatttaacagaagaagatatctatgaaaaaggtgaatctattgattttccagattcagtaatagaatttgctcaaggttacattggacagccttatcaaggattcccagagaaacttcaaaaaatcatattaaaagataaaaaaccgataactgttcgtccaggtgaattactagaaccaattgactttaaggtgatgagagatgagttatatgataagttaaatcgtccgatcactagcttcgatttaatttcttatgcactatatccaaaagtgtttatggattaccaagcatttacagaaacgtatggcgatatttctgtccttgatactccaaccttcttctatggtatgaaattaggagaagtaatagaagttgaaatcgaaaaagggaagacgcttattgttaaattggtttctatatcagagccaaaagaagatggtactcgcgtggtttacttcgatttaaatggtcaatcaagagaaattacaatcaaggatgaaagtattgaatccttggttgctgttaaaccgcaagttgacaaaaataataaaaaccacctaggagctactatgcctgggactgttttagaagtaaattgcagtaaaggtgataaagtgacaaaaggtcagcacttgatgacaaatgaagcgatgaagatggaaacttcggttcaagcaccatttgatggtgttataaaagagattcatgtatcgaatggcgatacaatagcagttaatgatttattaatagaatttgaataa

SEQ ID NO: 4953 - protein, 1147 aa, Oceanobacillus iheyensis
MAELNKINKVLVANRGEIAIRVFRACTELNIRTVAIYSKEDSSAFHRFKADEAYLIGEGKKPIDAYLDIEGIIELAKEVNVDAIHPGYGFLSENIQFARRCEEEGIIFIGPTSKHLSMFGDKVKAREQAVAANLPIIPGSDGPVSSLEEVQDFTQEHGYPIIIKASLGGGGRGMRVVKDDSELESAYDRAKSEAKAAFGNDEIYVERLIENPKHIEVQILGDNAGNIVHLYERDCSVQRRHQKLIEIAPSLSLGDKLREDICQSAVNLMKNVDYLNAGTVEFLVTDDEFFFIEVNPRVQVEHTITEMITGIDIVQSQIKIADGAQLHDETVGIPTQEHINTQGYAIQSRVTTEDPLNDFMPDAGKINAYRTGGGFGVRLDAGNGYQGAIISPHYDSLLVKVSTWALTFEQAAIKMVRNLKEFRIRGIKTNIPFLENVMVHQKFLSGEYDTTFIDKTPELFIFPIRKDRGTKMLTYIANTTLNGGEGIANIEKPDFRPLDIPATNHIESVSTGTKQILDKYGPEGVAKWMKEQKEVLLTDTTFRDAHQSLFATRVRTNDLLHIAEPTSKLLPNLFSVEMWGGATYDVAYRFLKEDPWTRLLKLREEMPNVLFQMLLRASNAVGYKNYPDNLIEEFVKKSSEAGIDVFRIFDSLNWVEGMKLTIDAVRNSNKIAEAAICYTGDILDTGRSKYDVSYYQMMAKELESAGAHILGIKDMAGLLKPEAAYQLIHKLKETIDIPIHLHTHDTSGNGVFTYARAIEAGVDAVDVAVGSMAGMTSQPSAQSLYHALEGTPFQPDINIENYERIGHYWEGIRDYYQEFESGMNAPHTEIYHHEMPGGQYSNLQQQAKAVGLGHRWNEVKKMFRTVNDMFGDIVKVTPSSKVIGDMTLFMVQNDLTEEDIYEKGESIDFPDSVIEFAQGYIGQPYQGFPEKLQKIILKDKKPITVRPGELLEPIDFKVMRDELYDKLNRPITSFDLISYALYPKVFMDYQAFTETYGDISVLDTPTFFYGMKLGEVIEVEIEKGKTLIVKLVSISEPKEDGTRVVYFDLNGQSREITIKDESIESLVAVKPQVDKNNKNHLGATMPGTVLEVNCSKGDKVTKGQHLMTNEAMKMETSVQAPFDGVIKEIHVSNGDTIAVNDLLIEFE

SEQ ID NO: 4954 - DNA, 1464 bp, Leptospira interrogans
  CDS (1)..(1464)
atgatttctaaacttctgattgcgaaccgtggagaaattgcggttcgagtgatccgtacttgtaaaaagctgggaatcaaaaccgttgcgatttattcggatgcggatagagattctccacacgtaaaacttgcggacgaatcagtatatgtaggagagcctagtcctgcttcttcttatttaaatatttctaatattctcgaagcgattaaaaagacaaagacggatgcggttcatccaggttatggatttttatcggaaaaaagtgaatttgcaaaagcattagaaaaagagaatgtgttatttttaggtcctagtccggaatcgatggaactcatgggggataagatcaattccaggattaaaatggaagcgtctggagttccggttgttccaggttacaacggacaaaatcaggatcctaaaatacttcaaaaggaagccgagaaaatcggttatcctttgatgattaaggcgaccgccggaggaggtggaaagggaatgaaacgggtttataaatccgaagaatttcttttcgcacttgaatcggcgcaaagagaagcgcaaaaagcttttggagatgggaccgtttttttagaaaaatacgtagaaactcctaggcatattgaagtgcaggtttttggagataaacacggaaacgttatgcatctttttgaacgagaatgttcgattcaaagaagacaccaaaaggtaattgaagaatctcctgctccaaatttgccaatttctcttcgggatgaaatttgtagggtagctgttaaagccgcacagtctattggttatgtgggagcaggaaccgtagaatttattttaggaaaagataataagttttattttctagaaatgaacacaaggcttcaagtggaacatccggtaacggaatatattaccggtcaggatcttgtagaatggcagatccaagtggcggaaggcaaaaaactttccgaactcacaaaaggaaaaaccgtcattcaaaatggacatgcaattgaagctcgtatctatgcggaagatcctgaaaataactttttaccttctacgggtatattagaatatattgaatttccggatcgtgagtttttacgtgtagatactggggtggaaactggttctgagattacagtttattacgatcctatgatcgctaagatgatcgcttggggaaaaaccagagaagagtgtactgctcgtcttaaagaatctatagattcgacagtgatcttcggacctgtaaccaataccttttatttatctggaattctttctcatgaagaatttaaaaaagggaatacccatactcattttttggaagaacaaacgattttatttactcctgaaaaggacgttcaagcagatgcgttttcctttgcggcagctgcactttctgaaaagaaaaaatcccagggaatttgggaggcggtaggtccgggaggtttctggtga

SEQ ID NO: 4955 - protein, 487 aa, Leptospira interrogans
MISKLLIANRGEIAVRVIRTCKKLGIKTVAIYSDADRDSPHVKLADESVYVGEPSPASSYLNISNILEAIKKTKTDAVHPGYGFLSEKSEFAKALEKENVLFLGPSPESMELMGDKINSRIKMEASGVPVVPGYNGQNQDPKILQKEAEKIGYPLMIKATAGGGGKGMKRVYKSEEFLFALESAQREAQKAFGDGTVFLEKYVETPRHIEVQVFGDKHGNVMHLFERECSIQRRHQKVIEESPAPNLPISLRDEICRVAVKAAQSIGYVGAGTVEFILGKDNKFYFLEMNTRLQVEHPVTEYITGQDLVEWQIQVAEGKKLSELTKGKTVIQNGHAIEARIYAEDPENNFLPSTGILEYIEFPDREFLRVDTGVETGSEITVYYDPMIAKMIAWGKTREECTARLKESIDSTVIFGPVTNTFYLSGILSHEEFKKGNTHTHFLEEQTILFTPEKDVQADAFSFAAAALSEKKKSQGIWEAVGPGGFW

SEQ ID NO: 4956 - DNA, 2381 bp, Corynebacterium efficiens
  CDS (982)..(2352)
agcaggccgtgttgccgaacggcaacttccgcagccgcaaggagatcgaggaggtgtactcgcacctcaaccctgccgaggacaccgtggtgtactgccgcgtgggtgaccgcgcggcccacacctggttcgtgttgaagtacctgctggggtttgaaaacgtccgcaactatgacggttcctggtccgagtggggcaacatggtgcgcatgcccatcgtccagggtgatgagccgggctcactctagtcaccccggggtcacctccctggtcacccccgtaccctcccgggtacaccccggggacggggtgtgacctggatctcccctgcatgtggacaccgggaaactttgcctgggaaatgaccatccagtaccgtaatgcgggtatgttaacgcggtcacagggtacaccagaatccggatcgtctaacccccttagcgggattcgctaaaagatcaccgagttagtgtgcaagaataatgctgatcgcaggggcactgtcatacgctgtcatgcagtcaatgaacagtgcggtgctctgtcgtgaagaaaatcaaaaccaggagggttttagtgtcagtcgagaccaggaagatcaccaaggtacttgtcgccaaccgtggtgaaatcgcaatccgtgttttccgcgcagcacgggatgaaggcatcgcctctgtcgccgtctacgcggagccggacgcagatgcccctttcgtcgagtatgccgatgaggccttcgcactcggtggccagacttccgcagagtcctacctcgtcattgacaagatcattgacgcagcacgcaagtccggtgcagacgctgtccaccccggctacggcttcctcgccgagaacgccgatttcgctgaagctgtcatcaacgagggcctgatctggatcggaccatcccctgagtccatccgttccctcggtgacaaggtcaccgcacgccacatcgccaacaacgccaacgcaccgatggcaccgggcaccaaggagcctgtcaaggacgccgctgaggttgtcgccttcgccgaggagttcggtctccccatcgccatcaaggctgccttcggtggcggcggacgtggcatgaaggtcgcctacgagatggacgaggtcgccgacctcttcgaatccgccacccgtgaggccaccgccgccttcggtcgtggtgagtgcttcgtggagcgctacctggacaaggcccgccacgtcgaggcacaggtcatcgccgacaagcacggcaacgttgtggtcgccggtacccgtgactgctccctgcagcgtcgtttccagaagctcgtcgaggaggcaccggcaccgttcctcaccgatgagcagcgtgaccgcatccactcctccgccaaggctatctgccgcgaggccggttactacggtgccggcaccgtggagtacctggtcggttccgacggactgatctccttcctggaggtcaacacccgcctgcaggtggagcaccccgtcaccgaggagaccaccggcatcgacctggtgcgcgagatgttccgcatcgccgagggcgccgagctctccatcaaggaggacccgaccccacgcggccacgccttcgagttccgcatcaacggcgaggacgcaggctccaacttcatgcccgcaccgggcaagatcacccgctaccgtgagcccgccggcccgggtgtccgcatggactccggcgttgtcgagggttccgagatctccggccagttcgactccatgctggccaagctgatcgtctggggccagacccgtgagcaggccctggagcgttcccgtcgtgcgctcggcgagtacatcgtcgagggcatgccgaccgtcatcccgttccactcccacatcgtctccaacccggcattcgtcggtgacggcgagggcttcgaggtctacaccaagtggatcgaggaggtctgggacaacccgatcgagccgttcgtcgatgcagccgacctcgacgacgaggagaagaccccgtcgcagaaggtcatcgtcgagatcgacggccgccgcgtcgaggtggctctcccgggcgacctcgctctcggcggtggcgcaggtgccgccaagaagaagccgaagaagcgtcgcgcaggtggcgccaaggccggtgtctccggtgactccgtcgcagccccgatgcagggcaccgtcatcaaggtcaacgttgaggacggcgccgaggtctccgagggtgacaccgtcgtggttctcgaggccatgaagatggagaacccggtcaaggcccacaagtccggtaccgtctccggtctgaccatcgccgcgggtgagggcgtgaccaagggtcaggttctcctggagatcaagtaatcccttcagggaacagacagccctgttct

SEQ ID NO: 4957 - protein, 456 aa, Corynebacterium efficiens
MAPGTKEPVKDAAEVVAFAEEFGLPIAIKAAFGGGGRGMKVAYEMDEVADLFESATREATAAFGRGECFVERYLDKARHVEAQVIADKHGNVVVAGTRDCSLQRRFQKLVEEAPAPFLTDEQRDRIHSSAKAICREAGYYGAGTVEYLVGSDGLISFLEVNTRLQVEHPVTEETTGIDLVREMFRIAEGAELSIKEDPTPRGHAFEFRINGEDAGSNFMPAPGKITRYREPAGPGVRMDSGVVEGSEISGQFDSMLAKLIVWGQTREQALERSRRALGEYIVEGMPTVIPFHSHIVSNPAFVGDGEGFEVYTKWIEEVWDNPIEPFVDAADLDDEEKTPSQKVIVEIDGRRVEVALPGDLALGGGAGAAKKKPKKRRAGGAKAGVSGDSVAAPMQGTVIKVNVEDGAEVSEGDTVVVLEAMKMENPVKAHKSGTVSGLTIAAGEGVTKGQVLLEIK

SEQ ID NO: 4958 - DNA, 3609 bp, Corynebacterium efficiens
  CDS (1)..(3609)
atgtttgacagcattctgatcgcaaaccgcggcgagatcgcgcgccgcatcatccgcaccgcccgccgcatgggacttagaacgatcgccatttattccgaggctgatgccgcggccccacacgtccgtgaggctgacgaagcccacctcctgggcccggcaccagctgcccagtcctacctcgacatcgaccgtgtactcgatatcgccgtgaagtccggtgccggtgctatccacccgggttacggctttctgtcggaaaacgcagagttcgcccgtcttgtcgaagctgcaggcatcgcctttgtcggaccgacccccgaacagttggacaagttcggcatcaagcacacggcccggcagctggcggaggcagccggcgttccgcttctgcccggtaccggcctgctttcctctgctgacgaggccgtggcaaaagctcaggagatcggcctgccggtgatggtcaaggccagtaacggcggtggtggcatcggtatgcagtcctgcacgggcctggatcaggtccgtgaggcattcacccgggtgcagcgtctggcggaacagaacttcggctccggaggggtgttcctggaacgtctggtgcgcccggcccggcacatcgaggtacaggttttcggtgatggtgctggcgccgttgctgtattcggcgaccgtgactgttccctccagcgccgaaaccagaaggtggtggaagaagcccccgcaccggatctgcccccggtagtccgccagaccatccaccaggcatcccgggcgttggctgcctccgttgattaccgctcagccggcacggtggaattcatctacgatccccatcgcgaggaagcctacttcctggagatgaacacccgattgcaggtggagcatccggtcactgaggcggttttcgacgtcgatctggttgagctcatgctgcgtcaggcgggtgcacgtgacgagggggaagctggtgtcaaccggtccatctttgaagctaatctcacgccccgcggtgtggccgtggaagcccgtgtctacgcagaagaccccgccaaggaatgcgcgcccagctcaggtgttgtcacccgggctgtctttcccggtcagggtggggacccgatggagaacgtgcgtatcgacggatggatcgaaaccggcctggaggtatccccccattacgatccgatgctcgccaagatcatcacccatgccgccacgagaaacgatgcgctggatctgcttcacggtgcgctagcggtcagtcgtgtcgatggcatcgtcaccaacctgcccctgctccgggcactcgtcatggagcccacgctgcgggccgcggaccactccacctcgacattggaggtcaccagcgatccggaaccacgcatcgatgtcctcgaacccggcatgctgaccaccgtgcaggactggcccggtcgccgcggattctggaaggtcggggtcccgccatcaggccccatggattcggtgtccttccgcctggccaatgaggccctcggcaacgatgccagcgcccccggtctggaatgcacatccaccgggccggtgctgagattctcgcacgccacccgcatctgcatcactggtgccccggccctgtgcatgctctcgggtcagcccattccccagtgggttcccattgatgtccgctccggtgatgaactgcacatcggagagaccagcagtgttggcctgcgcacctacctcgctgttgaaggcgggttagatgtcccggactacctggggtcggcctcaaccttcaccctcggtcaattcggtgggcacgccggacgcgcgctgctcagcggtgatgtccttcgtccggtgggggcggatccacatcaggccgtgcgcgcccgccccatccccgaggatcaacggccggtgttctcccaccattggcgcatcgccgtcacggaaggaccccacgaggcaccggactttttcaccccggaggatatcgaggtcttctacagttccgattatgtcgtgcacctgaactcggcgcgctcgggtgtgcggcttgacgggccgaatccgacctgggcgcgaaccgacggtggcgaggcaggcatgcatccctccaatatccacgacaacgcctatgccatcggcgcaatcgacttcaccggggacacccctatcatcctggggcccgacggccccagcctcggcggatttgtctgtccggctgtggtgaccagtggcgatctgtggaagctgggtcagttacggccgggtgacacggtacgcttcgtcccggtccgggaggcggatgcagccgacaccatcgacttgcgggccaccccggagctgttgactccgtcgggggacggagaccacggggtgctcgctcgggtcccggaagacggtgatcgaccgtctgtaacctaccgtcgtgcgggagacaccaacctgctcattgaatacggtgagcaggtgctcgacatcgggttacgcatgcgtgtccatgtgcttcacacggagattgagaaacgggagattcccggagtcaccgacctgacgcccggcatccgttcactgcagctccaggtggatccggctgtcatccgcccctcgcaattggtggaactcatgatgtccatcgaggaggatctacccgccaccgaggaactagcggtcccttcacggacagtgcgtttgcccctgtcgtgggatgacccccagacgcgcctggcaatcgaacggtatatgaatggtgtccgcgatgacgccccctggtgcccgtggaacatcgagttcatccgccgggttaacggcctggacaccgtagatgatgtgtaccgcacggtcttcaacgcctcttacctcgtgctgggtctgggtgatgtctacctgggtgcaccggtagcaactccccttgatccccgccaccgtctggtgacaaccaaatacaacccggcgcgtacctggacaccggaaaacgccgtgggcatcggtggcgcctacctctgcgtatacggaatggaggggcccggtggctaccagttcgtcggtcgcaccacccagatgtggaacaggtaccggacggggggcctcttccaggatgccccctgggccctgcgtttcttcgaccgcatcgagtggtacccggtcagtgcggaagaacttttggagatgcgtaccgagaccgatgccggtcggggccgcgtcgaggtcgaggagggaacattctccttcgctgagtaccgggagttcctggacacccacgccgattccatccgggagttccaggagagtcagaccgcggcattcgacgaggagaagcaacggtggcgggaatccggtgaattcgacatcaaaccggaaccagcagccaataccgaagaggcggtcatacctgaggggtccatcggtgtcagcgccccgttgatgtccacactgtggcagttctccgtcaccctgggggacagggtatccaccggtgaccagttgttgtccctggaggccatgaagatggagaccgcggtatcgtccccggtcgacggtgtggtcaccgcaatccatgccagcccgggtgatcaggttacccaggggcagatcctcatcagtgtggcatccgagtag

SEQ ID NO: 4959 - protein, 1202 aa, Corynebacterium efficiens
MFDSILIANRGEIARRIIRTARRMGLRTIAIYSEADAAAPHVREADEAHLLGPAPAAQSYLDIDRVLDIAVKSGAGAIHPGYGFLSENAEFARLVEAAGIAFVGPTPEQLDKFGIKHTARQLAEAAGVPLLPGTGLLSSADEAVAKAQEIGLPVMVKASNGGGGIGMQSCTGLDQVREAFTRVQRLAEQNFGSGGVFLERLVRPARHIEVQVFGDGAGAVAVFGDRDCSLQRRNQKVVEEAPAPDLPPVVRQTIHQASRALAASVDYRSAGTVEFIYDPHREEAYFLEMNTRLQVEHPVTEAVFDVDLVELMLRQAGARDEGEAGVNRSIFEANLTPRGVAVEARVYAEDPAKECAPSSGVVTRAVFPGQGGDPMENVRIDGWIETGLEVSPHYDPMLAKIITHAATRNDALDLLHGALAVSRVDGIVTNLPLLRALVMEPTLRAADHSTSTLEVTSDPEPRIDVLEPGMLTTVQDWPGRRGFWKVGVPPSGPMDSVSFRLANEALGNDASAPGLECTSTGPVLRFSHATRICITGAPALCMLSGQPIPQWVPIDVRSGDELHIGETSSVGLRTYLAVEGGLDVPDYLGSASTFTLGQFGGHAGRALLSGDVLRPVGADPHQAVRARPIPEDQRPVFSHHWRIAVTEGPHEAPDFFTPEDIEVFYSSDYVVHLNSARSGVRLDGPNPTWARTDGGEAGMHPSNIHDNAYAIGAIDFTGDTPIILGPDGPSLGGFVCPAVVTSGDLWKLGQLRPGDTVRFVPVREADAADTIDLRATPELLTPSGDGDHGVLARVPEDGDRPSVTYRRAGDTNLLIEYGEQVLDIGLRMRVHVLHTEIEKREIPGVTDLTPGIRSLQLQVDPAVIRPSQLVELMMSIEEDLPATEELAVPSRTVRLPLSWDDPQTRLAIERYMNGVRDDAPWCPWNIEFIRRVNGLDTVDDVYRTVFNASYLVLGLGDVYLGAPVATPLDPRHRLVTTKYNPARTWTPENAVGIGGAYLCVYGMEGPGGYQFVGRTTQMWNRYRTGGLFQDAPWALRFFDRIEWYPVSAEELLEMRTETDAGRGRVEVEEGTFSFAEYREFLDTHADSIREFQESQTAAFDEEKQRWRESGEFDIKPEPAANTEEAVIPEGSIGVSAPLMSTLWQFSVTLGDRVSTGDQLLSLEAMKMETAVSSPVDGVVTAIHASPGDQVTQGQILISVASE

SEQ ID NO: 4960 - DNA, 3507 bp, Corynebacterium efficiens
  CDS (1)..(3507)
atggttttccggactggccgttacgatgttctgaagagtgactgccatcacccaacaggctggtcctcgtcgaaaggaacaaaaactgtggttacaacaacaccctccacgctgccggcgttcaaaaagatcctggtggccaaccgaggtgaaatcgcggtgcgagcattccgcgccgcctacgagaccggggccgcaaccgtggccatctacccccgggaggaccgtggctccttccaccgctccttcgcctccgaggcggtgaggatcggaaccgagggctcacccgtcaaggcgtacctcgatattgatgagatcatcaacgccgccaagaaggtgaaagcggacgcggtctacccggggtatggtttcctttcggaaaatgcccagctcgcgcgtgaatgcgcggagaacggcattaccttcatcggtcccaccccggaggtgctcgacctcacgggcgacaagtccaaggctgtgtccgccgcgaagaaggccgggctgccggtgctggcggaatccacccccagcaccgacatcgatgagatcgtcaagagtgccgaggggcagacctacccgatcttcgtcaaggccgtcgcaggtggtggcgggcgtggtatgcggttcgtcgagaagcccgaggacctgcgtgagctggccagggaggcctcccgcgaggcggaggccgctttcggtgacggatccgtctacgtcgaacgggccgtgatcaaaccccagcacatcgaggtgcagatcctcggtgatcacaccggcgatgtcatccacctgtatgaacgcgactgttccctgcagcgccgccaccagaaggtcgtggagatcgcacctgcccagcacctcgacccggagctgcgcgaccgcatctgtgccgatgccgtgaagttctgcaaatccatcggataccagggcgccggcaccgtggagttcctcgtcgacgaggcgggcaaccacgtcttcattgagatgaacccccgcatccaggtggaacacaccgtgaccgaggaggtcacctccgtcgacctggtcaaggcgcagatgcacctggccgccggtgccaccctgaaggaactgggcctgacccaggacaagatcaccacccacggtgccgccctgcagtgccgcatcaccacggaggacccgtccaacaacttccggcccgacaccggtgtgatcaccgcctaccgctccccgggtggtgcgggtgtgcgtctcgacggcgcagcccagctcggcggcgagatcaccgcacatttcgattccatgctggtcaagatgacctgccgcggttccgatttcgagaccgccgtgtcccgagcccagcgcgccctggcggagttcaacgtctccggcgtggccaccaacatcggcttcctgcgtgcgctgctgcgcgaggaagacttcaccaagaggcgcatcgacaccggcttcatcggctcccaccagcacctgctccaggccccaccggccgacgatgagcaggggcggatcctggaatacctggcggatgtcaccgtgaacaaaccccacggtgaacgccccgagacagcccgtccgatagagaagctgcccgaggtggagaacatcccgctgccacgcggctcccgcgaccgcctgaagcagctcggcccggagggtttcgcccgcgatctgcgcgaacaggatgccctggccgtcaccgacaccaccttccgcgatgcccaccagtccctcctggccacccgcgtgcgctccttcgcgctgaccccggcggcgcgcgccgtcgcaaagctcacccccgagctgctgtcggtggaggcctggggcggtgccacctacgacgtggccatgcgcttcctcttcgaggatccgtgggcacgcctggatgagctgcgtgaggcgatgccgaatgtgaacatccagatgctgctgcgtggtcgcaacaccgtcgggtacaccccgtaccccgattcggtgtgccgcgcgtttgtgcaggaggccgccaagtccggtgtggacatcttccgcatcttcgacgcgctcaacgacatctcccagatgcgcccggccatcgacgccgtcctggagaccggcaccagtgttgccgaggtcgccatggcgtactccggtgacctgtccaatccgggggagaagctctacaccctggactactacctgaacctggccgagcagatcgtcgactccggtgcacacatcctggccatcaaggacatggccggcctgctgcgcccggccgcggcgaccaaactggtcaccgccctgcgccgtgaattcgacctgcccgtgcatgtccacacccacgacaccgccggcggtcagctggccacctacctggccgccgccaacgccggggccgatgccgtcgacgccgcctccgcacccctgtccggtaccacctcccagccgtcgatgtccgctctggttgccgcgtttgcgcacacccgacgcgacaccggcctcaacctgcaggccgtctccgacctggaaccgtactgggaggcggtccgcggactgtacctgccgtttgaatccggcaccccgggcccgaccggacgcgtttaccgccacgagatccccggcggtcagctgtccaacctgcgtgcccaggccgttgcactgggtctggccgaccgcttcgagctcatcgaggactactacgcggccgtcaacgagatgctgggtcgtccgaccaaggtcaccccgtcctccaaggttgtcggtgacctcgcactgcacctcgtcggtgccggtgtgagcccggaggatttcgccgccgatccgcagaagtacgacatccccgattcggtcatcgccttcctccgcggcgaactgggtacccctcccggtggctggcccgaaccgctgcgcacccgtgcactcgagggtcgctcccagggtaaggccccgctggcggagatccccgccgaggagcaggcccacctggattccgatgattccgcggagcgtcgcggcaccctcaaccgcctgctgttcccgaagccgaccgaggagttccttgagcaccgtcgccgcttcggcaacacctccgccctggatgaccgcgagttcttctacggcttgaaggagggacgtgaggagctgatccgactgaccggtgtgtccaccccgatggtggtccgcctggatgcggtgtccgaaccggatgacaaaggcatgcgcaacgtggtggtcaacgtcaacggccagatccgcccgatcaaggtgcgcgaccgttccgtggagtccgtcaccgccaccgcggagaaggccgatgccaccaacaagggccatgtcgccgcaccattcgccggtgtggtcaccgtgaccgtcgccgagggtgatgagatcaaggctggcgacgccgtggccatcattgaggccatgaagatggaggccaccatcaccgcgcctgtcgacggtgtcatcgaccgcgtcgtggtgcccgccgccaccaaggtcgagggcggcgacctcatcgtggtcgtgtcctag

SEQ ID NO: 4961 - protein, 1168 aa, Corynebacterium efficiens
MVFRTGRYDVLKSDCHHPTGWSSSKGTKTVVTTTPSTLPAFKKILVANRGEIAVRAFRAAYETGAATVAIYPREDRGSFHRSFASEAVRIGTEGSPVKAYLDIDEIINAAKKVKADAVYPGYGFLSENAQLARECAENGITFIGPTPEVLDLTGDKSKAVSAAKKAGLPVLAESTPSTDIDEIVKSAEGQTYPIFVKAVAGGGGRGMRFVEKPEDLRELAREASREAEAAFGDGSVYVERAVIKPQHIEVQILGDHTGDVIHLYERDCSLQRRHQKVVEIAPAQHLDPELRDRICADAVKFCKSIGYQGAGTVEFLVDEAGNHVFIEMNPRIQVEHTVTEEVTSVDLVKAQMHLAAGATLKELGLTQDKITTHGAALQCRITTEDPSNNFRPDTGVITAYRSPGGAGVRLDGAAQLGGEITAHFDSMLVKMTCRGSDFETAVSRAQRALAEFNVSGVATNIGFLRALLREEDFTKRRIDTGFIGSHQHLLQAPPADDEQGRILEYLADVTVNKPHGERPETARPIEKLPEVENIPLPRGSRDRLKQLGPEGFARDLREQDALAVTDTTFRDAHQSLLATRVRSFALTPAARAVAKLTPELLSVEAWGGATYDVAMRFLFEDPWARLDELREAMPNVNIQMLLRGRNTVGYTPYPDSVCRAFVQEAAKSGVDIFRIFDALNDISQMRPAIDAVLETGTSVAEVAMAYSGDLSNPGEKLYTLDYYLNLAEQIVDSGAHILAIKDMAGLLRPAAATKLVTALRREFDLPVHVHTHDTAGGQLATYLAAANAGADAVDAASAPLSGTTSQPSMSALVAAFAHTRRDTGLNLQAVSDLEPYWEAVRGLYLPFESGTPGPTGRVYRHEIPGGQLSNLRAQAVALGLADRFELIEDYYAAVNEMLGRPTKVTPSSKVVGDLALHLVGAGVSPEDFAADPQKYDIPDSVIAFLRGELGTPPGGWPEPLRTRALEGRSQGKAPLAEIPAEEQAHLDSDDSAERRGTLNRLLFPKPTEEFLEHRRRFGNTSALDDREFFYGLKEGREELIRLTGVSTPMVVRLDAVSEPDDKGMRNVVVNVNGQIRPIKVRDRSVESVTATAEKADATNKGHVAAPFAGVVTVTVAEGDEIKAGDAVAIIEAMKMEATITAPVDGVIDRVVVPAATKVEGGDLIVVVS

SEQ ID NO: 4962 - DNA, 3477 bp, Brucella suis
  CDS (1)..(3477)
atgtctttcgctccaaagcctatctcgaaaattctggtcgccaaccgatctgaaatcgcaattcgcgtattccgcgccgccaatgagctggggctcaaaacggtggccatatgggctgaggaagacaagctttccctgcatcgcttcaaggcggatgaaagctatcaggtcggtcgcggaccgcatctggatcgcgatcttggccccattgaaagctatctttccattgacgaaatcatccgcgttgccaagctttcgggcgccgatgcgatccatccaggttacggtctcctgtcggaaagcccggaatttgccgaagcctgcgcggaaaacggtatcgtcttcatcgggccgaagccggaaaccatgcgccgcctcggcaacaaggtcgccgcgcgcaatctcgctatcgagattggcgtgccggtggtgcctgccaccgatccgctgccggatgatatggatgaggtgaagaagcttgccgcccagatcggctatccgctgatgctgaaagcaagctggggcggcggcggccgcggtatgcgcgccatccgggctgaagccgatcttgcccgcgaggtgatggaagccaagcgcgaggccaaggcggcctttggcaaggatgaagtttatctcgaaaagctggtggagcgtgcccgccatgtcgaagtgcagatattgggcgatacgtacggcaatgcggtccatctttttgagcgtgactgctccatccagcgccgtaaccagaaggtcgtggagcgcgcgcctgcaccctatctcaacgatgcgcagcgccgcgagctggccgattatggcctgaagatcgcgcatgccaccgattatatcggtgctggcacggttgagttcctcatggatgccgataccggcaagttctatttcatcgaggtcaatccacgcattcaggtggagcatacggtcacggaagaagtgaccggcatcgatatcgtcaaggcgcagatccatattctggaaggctttgccatcggcacgccggaatcgggcgtgccgcgccaggaggatatccgcctcaatggccacgcgctgcaatgccgcatcacaacggaagacccggaacagaatttcatccccgattacgggcgcattcaggcctatcgttcggcggcgggcttcggcatccgtctcgatggcggcacggcctattcgggcgcattcatcacccgttattacgacccgcttctggtaaaggtgacggcatccggcgcgacgccgcttgaagccattcaccgcatggaccgcgccttgcgcgagttccgcattcgcggcgtggcaacgaacctcaccttcctcgaagcgatcatcaatcatccgaaattccagtcgaacgattatacgacccgtttcatcgatacgacgccggaattgttcgagcagatgaagcggcaggatcgcgccaccaagcttttgacctatattgccgatgtgaccgtcaacggccatcccgaaaccaagggccgcgcgaaacccgccagggatgctgccaagccgcgcgtgccgtggtttggcgacaagctggtcgctgacggcaccaaacagcttctggaccagcttgggccgaagaagtttgccgaatggatgcgcaatgaaaagcgcgcgctgattactgataccaccatgcgcgatggccaccagtcattgcttgccacgcgcgtgcgcacctatgatattgcgcggatcgccaatgcttacgcgcaggcgctgccaaacctgttctcgctggaatgctggggcggggctactttcgacgtctccatgcgcttcctgaccgaagacccgtgggagcgtctggcactggtgcgcgaaggcgcgcccaacctcctgttgcagatgcttctgcgcggtgcgaacggggttggctacaaatcctatccggacaatgtggtgaaatatttcgtgcgcgaggcagcgcgcgcaggcattgacctgttccgcgttttcgacagcctcaactgggttgagaacatgcgcgtgtcgatggatgcggtgctggaggaaaacaagctctgtgaagcggcgatctgctatacgggcgatattttgaacccggatcgcgccaaatacgaccttaattattacgtcaatctggcgaaggaagtggaaaaggctggcgcgcatattattgcggtcaaggatatggcgggcttgctgaagcctgccgccgcgcgcgtgctgttcaaggcgctgcgcgaggaaaccgatctgccgatccatttccacacacatgatacgtcgggcatttcggcggcgaccgtgcttgctgcaatcgatgcgggcgtggatgtcgtggatgcagcgatggacgcactttcgggcaatacatcgcagccctgcctcggttccatcgttgaagcgctgcatggttccgagcgtgattcggggctcgacccggattcgatccgccgtatttccttttattgggaagcggtgcgccatcaatatgcagcttttgaaagcgacctcaagggaccggcttcggaagtctatcttcacgaaatgccgggtggccagttcaccaatctgaaggaacaggcgcgctcgctggggcttgaaacgcgctggcatgaagtggcgcaggcctatgccgatgtgaaccgcatgttcggcgatatcgtcaaggtcacgccatcctccaaggtggtgggcgacatggcgctgatgatggttgcccaagacctcaccgttgccgatgtcgagaaccctgccaaggatattgccttcccggattcggtggtttccatgatgcgtggcgatctcggccagccgccatccggctggccggaagccttgcagaaaaaggttctgaaaggtgaaaagcctttcaccgtgcgccccggctcgcttctgcctgccgccgatctcgatgcggaacgcaagagctttgaggacagtgtcggccgcaagctttccgatcaggaatttgcttcggcgctgatgtatccgaaggtcttcaccgattatgctacggcgcatgaaacctatggtccgacgagcgtgctgccgacgccggtttatttctacggcctcaagccggaagaagaagtttttgtcgatctggagcgtggcaagacgctggtgatcgtcaatcaggctatgagcgagaccgacgagaagggcatggtgacggtgttcttcgagctgaacggccagccgcgccgcatcaaggtgccaaaccgtgccaagggtgcttccggtggtgtccgccgcaaggtggaggcgggcaatgacaaacaggtcggtgcgccgatgccgggcgttatctccaccgttgcggttgtggcaggccagaaggttacgcagggcgacgtgcttctatccatcgaggcgatgaagatggaaaccgccatccatgccgaacgcgatggcactatcgcggaagtgctggtccgccccggcgagcagatcgacgcgaaggatttgctcatcgtttacgccgagtaa

SEQ ID NO: 4963 - protein, 1158 aa, Brucella suis
MSFAPKPISKILVANRSEIAIRVFRAANELGLKTVAIWAEEDKLSLHRFKADESYQVGRGPHLDRDLGPIESYLSIDEIIRVAKLSGADAIHPGYGLLSESPEFAEACAENGIVFIGPKPETMRRLGNKVAARNLAIEIGVPVVPATDPLPDDMDEVKKLAAQIGYPLMLKASWGGGGRGMRAIRAEADLAREVMEAKREAKAAFGKDEVYLEKLVERARHVEVQILGDTYGNAVHLFERDCSIQRRNQKVVERAPAPYLNDAQRRELADYGLKIAHATDYIGAGTVEFLMDADTGKFYFIEVNPRIQVEHTVTEEVTGIDIVKAQIHILEGFAIGTPESGVPRQEDIRLNGHALQCRITTEDPEQNFIPDYGRIQAYRSAAGFGIRLDGGTAYSGAFITRYYDPLLVKVTASGATPLEAIHRMDRALREFRIRGVATNLTFLEAIINHPKFQSNDYTTRFIDTTPELFEQMKRQDRATKLLTYIADVTVNGHPETKGRAKPARDAAKPRVPWFGDKLVADGTKQLLDQLGPKKFAEWMRNEKRALITDTTMRDGHQSLLATRVRTYDIARIANAYAQALPNLFSLECWGGATFDVSMRFLTEDPWERLALVREGAPNLLLQMLLRGANGVGYKSYPDNVVKYFVREAARAGIDLFRVFDSLNWVENMRVSMDAVLEENKLCEAAICYTGDILNPDRAKYDLNYYVNLAKEVEKAGAHIIAVKDMAGLLKPAAARVLFKALREETDLPIHFHTHDTSGISAATVLAAIDAGVDVVDAAMDALSGNTSQPCLGSIVEALHGSERDSGLDPDSIRRISFYWEAVRHQYAAFESDLKGPASEVYLHEMPGGQFTNLKEQARSLGLETRWHEVAQAYADVNRMFGDIVKVTPSSKVVGDMALMMVAQDLTVADVENPAKDIAFPDSVVSMMRGDLGQPPSGWPEALQKKVLKGEKPFTVRPGSLLPAADLDAERKSFEDSVGRKLSDQEFASALMYPKVFTDYATAHETYGPTSVLPTPVYFYGLKPEEEVFVDLERGKTLVIVNQAMSETDEKGMVTVFFELNGQPRRIKVPNRAKGASGGVRRKVEAGNDKQVGAPMPGVISTVAVVAGQKVTQGDVLLSIEAMKMETAIHAERDGTIAEVLVRPGEQIDAKDLLIVYAE

SEQ ID NO: 4964 - DNA, 2004 bp, Brucella suis
  CDS (1)..(2004)
atgatcaagaaaatcctgattgccaatcgcggtgaaatcgcgtgtcgggtcatcaagtcggccaagaaaaagggcattgccacggtggcggtctattccgacgccgaccgcaacgcactgcatgtcaaaatggccgacgaagcagtccatatcggcccggccccatccaaccagtcctatatcgtcatcgacaagattctggccgccatcaaggaaaccggcgcggatgccgttcatccgggctatggcttcctgtcggaaaacccgcgctttgccgaagcgttgaaggccgccaatgtcaccttcatcggaccgccggtgaacgccattgacgcgatgggcgacaagatcacctccaagaagcttgcagccgaagccggtgtttccaccgtgcccggccatatgggattgatcgaggatgccgacgaggcggtcaggatcgcaggcagcatcggctatccggtgatgatcaaggcttccgccggtggcggcggcaagggcatgcgcatcgcgtggaacgacgaggaggcccgcgaaggcttccagctttcccgcaatgaggcaaagtcttccttcggcgatgaccgcatcttcatcgaaaaattcgtcacccagccgcgccatatcgaaattcaggttctgggcgaccagcacggtaatgtcgtctatctgggcgagcgtgaatgctccatccagcgccgcaaccagaaggtcattgaagaagcgccgtcacccttcctcgacgaagcaacccgcaaggccatgggcgagcaggctgtcgctcttgccaaggcggtcggctattattccgctggcacggtggaattcatcgtcgatggcaaccgtaacttctatttccttgaaatgaatacgcgtttgcaggtggagcatccggtgacggaactcatcaccggcatcgatctcgtggaagaaatgatccgcgtcgcatccggcgaaaagctgcgtttcgctcaggccgatgtgaagctgaacggctgggccatcgaaagccggctttatgcggaagacccttatcgcaacttcctgccctccatcggcaggctgacgcgctatcgcccgccggtcgaaggccgcaacccggacggcacggttatccgtaatgataccggcgtgttcgagggcggcgagatttcgatgtattacgaccctatgatcgcaaagctttgcacatggggcccggaccgcatcagcgccatcgacgccatgggccatgcgcttgacgctttcgaggtggaaggcatcggccacaacctgcccttcctttccgccgtgatggaccatccccgtttccgcgaaggcgcactcaccacggccttcatcgcagaagaatatccggatggcttttcgggtgtgaaatgctcggaagatgatgcgcgcacgctggcagccgtggcggctgagatcaatctcgtggcgcaacgccgcgatacgcagatttccggcaggctttcgccgcagaaacattccatcgccaatgactgggtggtgacactcgacggctattccctgccggtccgcattgctgagggcgaaggcggcacgacgatcaatttcattgatggtggcagcctgccaatcgccagcgactggcatccgggcagccagctcggttcgttcaccgtcggcggcaagccgattgcggtgaaggtttcgcgctccggcaccggctggcggcttcgctggcgcggcatggacgtggtggcgcatgtgcgcaaaccgcgcgtggcagaacttgcaaaactcatgccggtgaagctgccgccggatacgtcgaagatgctgctctgcccgatgcccggcgtcatcacctccattcttgtaaaggatggcgagacggtggaagcgggccagccgctcgccaccgtggaagccatgaagatggaaaacgtattgcgtgcagagcgccgtgccacggtcaagcgcatcaccgcagaggctggttccagcttggccgttgatgagctgataatggaatttgagtaa

SEQ ID NO: 4965 - protein, 667 aa, Brucella suis
MIKKILIANRGEIACRVIKSAKKKGIATVAVYSDADRNALHVKMADEAVHIGPAPSNQSYIVIDKILAAIKETGADAVHPGYGFLSENPRFAEALKAANVTFIGPPVNAIDAMGDKITSKKLAAEAGVSTVPGHMGLIEDADEAVRIAGSIGYPVMIKASAGGGGKGMRIAWNDEEAREGFQLSRNEAKSSFGDDRIFIEKFVTQPRHIEIQVLGDQHGNVVYLGERECSIQRRNQKVIEEAPSPFLDEATRKAMGEQAVALAKAVGYYSAGTVEFIVDGNRNFYFLEMNTRLQVEHPVTELITGIDLVEEMIRVASGEKLRFAQADVKLNGWAIESRLYAEDPYRNFLPSIGRLTRYRPPVEGRNPDGTVIRNDTGVFEGGEISMYYDPMIAKLCTWGPDRISAIDAMGHALDAFEVEGIGHNLPFLSAVMDHPRFREGALTTAFIAEEYPDGFSGVKCSEDDARTLAAVAAEINLVAQRRDTQISGRLSPQKHSIANDWVVTLDGYSLPVRIAEGEGGTTINFIDGGSLPIASDWHPGSQLGSFTVGGKPIAVKVSRSGTGWRLRWRGMDVVAHVRKPRVAELAKLMPVKLPPDTSKMLLCPMPGVITSILVKDGETVEAGQPLATVEAMKMENVLRAERRATVKRITAEAGSSLAVDELIMEFE

SEQ ID NO: 4966 - DNA, 1359 bp, Brucella suis
  CDS (1)..(1359)
atgtttcaaaagatactcatagccaatcgtggcgaaatcgctcttcgcgtgctcagggcttgcaaggagctgggcataaagacggtcgccgttcattccacggcagatgccgacgcaatgcatgtgcgcctggcagatgagagcgtatgcatcggaccgccgccctcacgcgacagctatctgaacatccatcagatcgtggccgcctgcgaaatcaccggcgcggatgcaattcaccccggctacggcttcctttcggaaaatgcaaaattcgccgaaatccttgaagcccatgacattaccttcatcggccccactgcttcgcatatccgcatcatgggcgacaagatcgaagccaagcgcaccgcaaagcgcctcggcatcccggtcgttccgggttcggacggcggcgtgacggatgaagtcgaagcagcccgtatcgccaaggaaatcggctatccggtcatcatcaaggcttcggccggcggcggtggtcgtggcatgaaggtcgcccgcagcgcggaagagcttccgatcgcacttgcgacggcacgttctgaagctggcgcggcctttggcgacgatgcggtctacatcgaaaaatatctcgaaaaaccgcgccatatcgaagttcaggtcatgggggacggtgcgggcaatgccgtccatctgggcgaacgcgactgctcgctgcaacgccgtcaccagaaggtctgggaagagggcaactcccccgccctcaatgcggaagcgcgcgaaaagatcggcatgatctgcgccaatgcctgcgcagagcttggctatcgcggcgcaggcacgatcgaatttctctatgaagatggagaattctatttcatcgaaatgaatacgcgccttcaggtggaacatccggttacggaagcgatcaccggcatcgatcttgtgcatgagcagattcgcgttgccgcaggccttggtctttcggtgaagcagaaggatatccgcttttccggccatgccatcgagtgccgtatcaatgcggaagatccgctgaccttcgcaccgtcaccgggcctcatcacgcattatcatacgccgggcgggcttggcgtacgcgtcgattccggcgtttattccggctatcgcattccaccctactatgacagcctgatcggcaagctcatcgtgcatggacgtaaccgcgtcgaatgcatgatgcgtctgcgccgcgcgctggatgagttcgtggtggatggggtaaagaccaccctgcccctgtttcaggatctgatttccaatcaggatatcgccaatggcgattatgacatccactggttggaaaagtacctggccaacaagagcaagaacgaaagcgcctga

SEQ ID NO: 4967 - protein, 452 aa, Brucella suis
MFQKILIANRGEIALRVLRACKELGIKTVAVHSTADADAMHVRLADESVCIGPPPSRDSYLNIHQIVAACEITGADAIHPGYGFLSENAKFAEILEAHDITFIGPTASHIRIMGDKIEAKRTAKRLGIPVVPGSDGGVTDEVEAARIAKEIGYPVIIKASAGGGGRGMKVARSAEELPIALATARSEAGAAFGDDAVYIEKYLEKPRHIEVQVMGDGAGNAVHLGERDCSLQRRHQKVWEEGNSPALNAEAREKIGMICANACAELGYRGAGTIEFLYEDGEFYFIEMNTRLQVEHPVTEAITGIDLVHEQIRVAAGLGLSVKQKDIRFSGHAIECRINAEDPLTFAPSPGLITHYHTPGGLGVRVDSGVYSGYRIPPYYDSLIGKLIVHGRNRVECMMRLRRALDEFVVDGVKTTLPLFQDLISNQDIANGDYDIHWLEKYLANKSKNESA

SEQ ID NO: 4968 - DNA, 1965 bp, Bifidobacterium longum
  CDS (1)..(1965)
atggcttctatcgtcaaaaaactgctgattgcgaaccgaggcgagattgcgcttcgcgtggtgcgcacggccaaggagatgggtatctccaccgtggccgtctactccgaacaggaccgcaatagccgctatgtggacatggccgacgaggcatacctgctctccggcgacacctacaaggacacgtacctcaacgaagatctgctgattgacatcctgcacaagaccggtgcgaatgccgtgcaccccggctacggattcctttccgaagtgccgagcttcgcgcagaaggtcgaggatgccggtgccatctgggtgggcccgcaccacaccgcgctggtggatttgggcgacaagattaccgcccgccgcgtggccctacgcgccaaagtgccgccagtgcccggcctgtccgaaccggtgaccgacgtgcgcacgctgctcgacttcgcacacacccacggctacccgatcatgatgaagcgcactgatggcggtggcggccacggcatcaccgtggtgcatgacgacgaggagctgcgccgcttctacatgaaccacgacgcgctgcaaggcggcgatctgaaggaatacttcatcgagaagttcgtggacaaggcacgccacgtcgagacccagtccgggcgcgactcgcacggcaacttcaccgtgtactccacccgtgactgctcgctgcagcgccgcaaccagaaactcgtggaagaggcacccgcgcccttcctgtccgaggaaatcatcagcacgctcgaggaatactcccgccgcctgttcaccacggtcggctacgtgggcctgggcacctgcgaattcatggtgaccccgaacggcaaggtgtacttcctggaagtcaacccgcgcttgcaggtggagcacaccgtctccgaagaggtcagcggcctcgacctggtgcgcgaacagctcaatatcgccgccggtggcgagctcacccgcgcccccgaactgcgcggccacagcttcgaactgcgcatcaccagcgaagacccggccaccaacctgacccccggctccggcaccttggagaagatccagtggccggccggccccggcgtgcgcatcgataccggtgtggaacagggcgacaccatctccccgaagttcgattcgatgatgggcaaggtcatcgtcaccgcccagaaccgtctcgacgccgtggcccgtgtgcgccgcgtgctcgatgagcttgtgatcgaaggcgtgcccacgccgattccgctgttcaaggaaatcttccgcaacgacgacttcaccgccgagcatggccacccgttcgctgtgtccaccaagtggctggagcgcacgtacctgaaccgcacaccggcttccgccgcctccggccagccggcctccttggccgccgccccgggtgccgctgccccggccgcgcccgacaagtccaagtcggagacgttcgtcatcgagatgaacaaccgccgcgtcaagctcaccgtgccactcgacatcgtggagaacatcaccggctcggcccgcgcccgcggtgccaagcgacccacccagccgttgcgcggtgcgggactgcacaacgtggcctccagtgccgctgcggccaacgacggcgccaaatccggcgtcatcgcctccccgatgcaggccgtggtcacgcgcatcaacgtgtccgaaggccagcaagtggccaagggcgaccttctggtggtgctcgaatccatgaagatggagaactacgtgtacgcgccggccgccggcgaagtgaagaagattttcgttggcccggccgacggcgtggaggccggcgacacgctggtcacgctggacgtgaacgccggcaaggccaaggctgctgcggctgcgccgggatctctccctcaggcggctgcgtcgacagctccctcgtcagaaggagccgataaggccaccgacgccaagaaggagggtggcaatgactga

SEQ ID NO: 4969 - protein, 654 aa, Bifidobacterium longum
MASIVKKLLIANRGEIALRVVRTAKEMGISTVAVYSEQDRNSRYVDMADEAYLLSGDTYKDTYLNEDLLIDILHKTGANAVHPGYGFLSEVPSFAQKVEDAGAIWVGPHHTALVDLGDKITARRVALRAKVPPVPGLSEPVTDVRTLLDFAHTHGYPIMMKRTDGGGGHGITVVHDDEELRRFYMNHDALQGGDLKEYFIEKFVDKARHVETQSGRDSHGNFTVYSTRDCSLQRRNQKLVEEAPAPFLSEEIISTLEEYSRRLFTTVGYVGLGTCEFMVTPNGKVYFLEVNPRLQVEHTVSEEVSGLDLVREQLNIAAGGELTRAPELRGHSFELRITSEDPATNLTPGSGTLEKIQWPAGPGVRIDTGVEQGDTISPKFDSMMGKVIVTAQNRLDAVARVRRVLDELVIEGVPTPIPLFKEIFRNDDFTAEHGHPFAVSTKWLERTYLNRTPASAASGQPASLAAAPGAAAPAAPDKSKSETFVIEMNNRRVKLTVPLDIVENITGSARARGAKRPTQPLRGAGLHNVASSAAAANDGAKSGVIASPMQAVVTRINVSEGQQVAKGDLLVVLESMKMENYVYAPAAGEVKKIFVGPADGVEAGDTLVTLDVNAGKAKAAAAAPGSLPQAAASTAPSSEGADKATDAKKEGGND

SEQ ID NO: 4970 - DNA, 10011 bp, Plasmodium falciparum
  CDS (1)..(10011)
atgcctaacaatgctcataataaaaactttaatgaaaaagaaaacagagaaatatatcataatgtaaatatatcaggaggtaatacaatatatgaagaacctaaaaataagtatattactttgtttttatctaatggaaaaaaaatcctacattccatttttcgaaataataataataataatataaccatatgtaatgaaaatacggggaaaaattcaaacatcaacttgaaaaataattctgagaacaatactaagagcaattctaagaattattctaggggttcttcatcgtgcttaaatatacagaatgtatccaatacatattatgataagagaagaattaaaaaggatattatgaataagaaggttgaggaaaatttgatacatgatgaaaatgaaaataatattattaatgataaaatatgttgtgatgaaaaacaagatttggataaagaaattcatgtagatgaacaaaatgaaaagaaatcaaacagtactttaaataatgaaagttttataagtatattatcaaatgataattccgagaaaaaaaaagatatggaagaaagtaataattattctaataatttttatctcaattctttagaggaaaacataatatatcctactcaacatgttgactgtgattttaatggaaaatggaaaagtcatgtagatgatattctagagaatgattcctactatagtaatatgaatgataatagtaataaatcttgtataagcgattatgagttattaaaaacgtctattttattgaataatacaaaggatgattttcctctatatgaaaattcaagaaaaaatatattaactacaagtggtaaaataaacaagaataaaaacttaaaagaaagaaaaaagaagaatttaaatagattattttacactttaaagttaacaaataatttttcatttaaaaatagtaagaatagaagaaaatacacaaatagttataatagtggatcctctacacattctcgttatgtcatggataataaggaatatataatttaccataataataataataataataataataattacaatagttatagtaataattgtaataatatgtatattcaaggtaataagaaaaagtataatagactatattgtaaaaaaagtgcgaattcacaagaaaaggattatgataaggatattaatttaattgcttcagataaaattaatagtgaattgtcacaagatgatttaaaatataattcacagataattaatatgcctaatgaccatttcaatattattacttctgatgaaaaagaaaatataaaaaaaaatgcatataaaaattatgttaattatataaatgaaagaagatatggttattttgatttattagaaaaaaagaatgaaaaaattatacgcaaattattaatagctaataatgggatggcagccttaaaatgtatattatcattaaaagattggttatttaaaaaattttatgatgagaatttaattaaaattatagttatggcaactgacgaagatattaaaagtaatgcaaaatatatatcattagcagataaagtaataaaagttccaggaggtaaaaatattcataattatgcaaatgttcctttaattgttgagctagccaaaagtgagaatgttgatgcagtatggcctggatggggacatagttcagaaaatcccttattgtctactttgttagaaaaagaaaatataatatttataggtccaactggtaatgttatggaagctttaggtgataaaatatctgcgaatatattagctcaaagtgttgaagtacctgtggtaaaatggagtggagataatataagaattgataaatttgagaacaataaaataaatgacgaactatataataatgctacaattcattcattagatgattgtataaaagaatgtaagcgtattggttttcctgttatgataaaagcatcacaaggtggtggtgggaaaggtattcgaaaagtggagaatgaatatgaaataaaaaaagcatatgaacaagtacaaaatgaattacctaattctcctatatttttgatgaaggtttgtaataatgtaagacatattgaaatacaagttgttggtgatatgtatggaaatgtgtgttctttaagtggtcgtgattgtactacacaaagaagatttcaaaaaatttttgaagaaggaccaccatctgttgtaccatatcctatatttcgagaaatggaaaaatcatctatacgattaactaaaatgattaaatatagaggtgctggaactattgaatatttgtatgatcaaataaataaaaaatattttttcttagaattaaatccaagattacaagtagaacatccagtttctgaaggtataacaaattgtaatttaatatctatccaattacaagtagctatgggaattccccttcaaaatatagatgacattcgaaatttatatcaaattgataaaatagaaaaaataaaaaaaaaagatgaacaaaaaaaagaattcgaattaaccgataatttgtgtaatgatactataaataaggataatataaataatgataatatatataaagataatataaataatgataatatatataaagataatatatataaagataatataaataatgataatatatataaagataatatatataaagataatataaataatgataatatatataaagataatatatataaagataatatatataatgataatatatataaagataatataaataatgataatatacatcatatagataatacaacaaatgaacaaaataataagaacttgttacattataataattatagaaatcaaaatttatgtaataataattcgatcaaatccttattaaattatgatacaaatgaaaatgttaatagaaagtataatttattgaatgaacactttgatttttataataataaaccatatattaaaaatcatgttattgctgcaaggattacagcagaaaatagtaatgatagctttaagcccacctctggtaatgtaagaagaataaattttcaaaactggaaagatgtgtggggatatttttctattaatgatggttttgtacatgagttttcagattctcaaatcggacatatttttgctaaaggagaaacaagagaagtagcaagaaaaaatttaattttagcattaagaaagttacatattgatggtgatataaaaacaggtacaaaatatttagcaaagattttagaatctaaagcatttattgacaataatattacaacaaattggctagatataataatagaaaagaaaaaacatgtattttataatacatgtcatataatattattatgtgctaccatatttaaactattaatatattttatgaatgagaagggaaaagtggaagaaaatttggatagagatgatatagctataaaaagagataaaaattatggaaatgtaataaataaaaataataaccatagtggtaatataaataataatggggaacatatgtgtaaaatgaaaagtgcatatatatttgatatgatatttcaaaatataaaatatccttttaaaggatataatataggggaaaatctatatcaattagagataaatggacaagaaatagaaatatctgctgaatatgataaaaataataataaagtattttctacatttaataatcaaacatatatatatgcatgttctgaggataccttaggtatacatatgcaactagagaaagataatattttcatacctaatgttaggaatccatatcatttaatatctaatactaatgggaaaattgttaagtatttaataaatgatggagaagaagttaaaaaaaatgatgattatattgaagtggaagctatgaaaatgattatgacatttaaatcaaccgagagtggaatattaagacataaattgtctgaagggacaattattaaaataggagatttattaggaataatagaaaaaaaagataatgataaaaaacatataaaacaagataatgaaattcaatattttaatggtcatttagatttgtcaaataaatatacatatgaattgatagataatcgtacaatatttccaaatattttagatgataattataataaatcttgtgataattcgtatgcctttacagataatatgtctttacaaaactctgaagaacattatttggtaaaagatgaacaaaaaaaaaaaaaaaaaaaaaatatttcttccattttaaataataatatggtaagcataaaaacggtatcaaatgatttaacagataatataaatgtgttaagagctgaaacattgagtgaagagggcttaaaggatgaaatatatcatggtcaaatgtgtgatgatcgaatgtgtgatgatcaaatgtgtgatgatcaaatgtgtgatgatgaaaatgttgtgaagaaaaatgataaagaacagaataaatcacataaaaatttaaaagaaaataatatggatgaatgtacttatgaagatgataattatatatatatgaaagaaaatcaaaagaaaaaattatttatgaaacaaaatagaaagaaaatctttcgtttattttcaaatgataatgaaaaaataacaacggctttaaattatttaaatgataaatttcattgtgtaaaaaattatttgtcaaatttaaatttttctagtgcaaattctgtatcagattctagtaattcatcctatcaaaataataaaaacaataataataataatgacaacaacaacaataattataataataataataataataatagtaagaataagaagaaaaataatagtgtgcaatacaattattccaatgctaaatattcaaatgttaatatgatacataagtatgataagaaaccatttgataaaagttatttaatgaatgaagttaacagtaataatgttaatgtgttaatgatgaaaaataaaaataatagtacgttccccttgattgaaaatttagaaaataatatatctacagaaattatgtcttctcgaaatacgtctaatgaaaaaatattacataataatatatcaaaggataatacaataagcgaaccaatttttaataataattcttctgatgagagtaatataaataatattacattttttaataacttatcaaataatggtagcataagaaaaagaaacaacaataataatagtagtagtagcaataataataataataataataataataataaaaataataattttaaacattcctattatatggattataataatgataatatctattggaatcatgtaaagaatgaaaaaagcaaatatttgcttgacattccaattatgaaaagaatagaatttttgctaaagggatatgaacaggattatgaaaagtgttttgatgaattaataaacaagaaagatattaaaaatgtatcaaattggtctgcatatataataaacaatataaatgacatattagatacattcatacaatataatattttattttccaaaaaagaatttatttcagaaatagatttatatgatatattatataataatataagggataagaaaaagcaatatgaaattatacacgcatatacatacaacgatttaagtataaagtttatagaaaaaatattaaaatatatattaaataatataaatagtaatttagccttcgatataattttggataagttaaaaatattagcagaattcaaaggaaaaatctttagaaatataattgtattatcaagacatattttatttttattagaaggattagaattaattgaatatataaaaattgcattaaattataatgataataaaaatatgaagaatggtggtaagttatcaaataatatgttacttttgtctaattatatgaaaaaaaataatttagatttttcaaaaatgatagaatataaaaataataaaaatgatatagaaattgtaaatatgttttttaaaggtcatagtagtaatatacatatgtttgttccatcattaattaaatcaaataaaaattctatgtttttaaaattttatttaaataatttatataaatattgtaatattaaatctataatggtaacaaataatataatcaagttttctataaataattcagaatatactaatctattaatatggaatgaaaatgataccattgatataaataaaattcttgagtcagatataaaaataaataatgatagatatttgaatactgttcatataataaatacaaataacgaattatgtttacatccttctcattcgtttgaaggaaatataataaaaaataagattttacaaaaatgtaaaaaattatatatatataattatgcaaataataaatatggagatatatatgaatggaaaaatgaagacctatcaaaaggattagtaggaaaatatagtaaagatggaagtattaataatattttaccttatgaagaatatatatttggtaatgaaaaagaaatattggaatattatgaattaaaaaatattaatcaagcgatatatgaaaaaacaaagatattttttggtatatataaaaataataaaaatgataataatatacgtaataatgttaataataattatacatctttatttggacaccgtgtaatagattttaatgaaataaaaaacacatcaaatgagtataataattttgaggaacataattatcaagatgataaatttatatttaataaagatatacataatattcttttagaattaaaggaatcattaaatgacatatcacgtggaagactaaatacattgataagagataataaaataagtagttgtataatatatcatattattgttgatgatatgatggatattgaaactataaaagaggcatataaggtgttcatgattaaatataatgaaatgatattagaaaattatgtcaataatatatttataaaaatataccgtactaataaaaagtcatgtactgaaaatgcacctcaaattcaattggaaagaatgtttaagcttaacgtgcttttaaataaaggaggtgtaaagaaagaaaggacggatagatataatgtggaagatgataataataaaaaggataatgataacaaatataattgtaataataataataatgatgataacaaatatgattgtaataataatttttattatgataacaaatatgattgtaataacaatttttatcatgataacaaatttaattgtaataataattattatcataattaccattttgttgaagagattaaccaatttccttctttccaaattgacaccctatatatgaagagaaaacgcgctagagaagtagacacattatatgcctatgattttattaatcttataaatatatcattaaacagatcaaataaaaacagagaaagtcataaaatatgtaattatattaatagtattaaggagtttaaactaaaaagtgatatgatttgttataatagtaatagtgataatttaaagaatcatgcaatgaatataaaaagtgcacatattcctttggaaaaaaaagaagaatacctatttgaacattttgacaatttaagtaattatgaaataaaaataaggaagtcattatatttgtctgataaactagatataggacagaacaaaaggagtgtggttggtttgttgttaaacataagaacagatgaatatgaagaagggagagatgtaatattcattattaatgatataagtacacaaggtggatcatttagtatatttgaagatgagctattttatggtatttctagttatgcaagagaaaagaaaattccacgtatatatatatcatgtaattctggcgctcgtataggattatataattttttaatggataaaataagaattgaatggaaagacgaacagaaaaaagaactaggttataaatatatatatataacacaagatgtaaaagaacaaatagataaagaagatattatatttttaactgaaattatagaaaataatgaaaaaagatatattattgatgctattgttgggaatttaaaaaatccagtaggtgtagagaatctcagaggaagtggattaatagcaggagaaacttcaaaagcgtatgaagaaatttttacattatcttatgttactggtcgcagtgttggtattggtgcttatttagttagacttggtaaaaggacaattcaaaaaaaaggctcttcgcttttgcttacaggttttaatgcattgaataaaatattaggtgaaaatgtatatgtaagtaatgaacagttaggtggtgttaatattatgatgaggaatggtatatctcaagttcaggttgaaagtgatcaagaaggtatggataaaattatacaatggttatcttatgttcccagaactagtaatgattattatgatttaatacaaaatatatataaagaaaataatagaaaatttctacaaaataataactttttaataacaaataagcaaaagactatgaatacatataacaacctttttatacataacaataaaaatgtaagtaattctgtcgatataaaggataacataaagaaccagatagatacaaatataaatacggaaactaatattaatgtgcaagatttaaatattattaaaaaaaatgggattaatacaaaatcaaaacaagatgaaaatgtgtatgaaaagaaagataaagtagaagaaatatataaagatcaaaacacatatagtacaaataatagcaagacctctaaaccaaatgataattctatgagttcatacaattttgaacttttacatataaatgatatggattacgatcatatagatgattctaatattatcgatttgatcaagggtactcaagaagaacagggtttcttagataaaaatacctattttgaatatatgaatgaatggggaaaaggtattataactggtagaggaaaattaggttctatacctgttggatttattgctgttaataaaaatttagttacgcaatctattccatgtgatccagcattaaaaacaaaagctcaaaaattaatacaagctccatgtgttttttttcctgataattcttttaaaacagcacaatcaattgaagattttaataaggagaatttgcctttatttatttttgcaaattggagaggattttcaggtggatctatggatatgttttatggtatcttaaaatttggatctatgattgtaaatcagctagttaattataaacaccctgtatttgtatatatacctatatctgctgaattgagaggtggatcatgggtagttgtcgatgaaacattgaatagccaaattatagaaatgtatgccgatgtcaatagtaaagggggaatattagaaccaccaggaattgttgaagttaagtttagatatcctgatattcgaaaattaatgcacagtattgatactaccataattgctttgaatgaaaaaatggctagatgtgaaaatgatgaagagaagaacaatataaagaaagatatagaaattaaggaaaaagagttgttgccatattatttacaagtgtgtcataaatatgcagatttacatgacatgtctacatgtatgaaagcaaagggtgtaattcgaaaaattgtcccatggaataaggcacgttcgtttttttattatcgtctaatgaggagattattaattaacatattgagtcgaaagtatgacaacgctttaatcaaaaatgaagagatagaaaatattttaaatgaccttaataattcagaagatgatgattatattgtatgcaatagagttttcaataataatattttacgaaatttaaaatacgataccaaggatataatatataacaaaacattaaatgactttttaaaaatttttaaaatgctatcacaggaacaaaggacagaatttctaaataaaataaattcttatgaaaattaa

SEQ ID NO: 4971 - protein, 3336 aa, Plasmodium falciparum
MPNNAHNKNFNEKENREIYHNVNISGGNTIYEEPKNKYITLFLSNGKKILHSIFRNNNNNNITICNENTGKNSNINLKNNSENNTKSNSKNYSRGSSSCLNIQNVSNTYYDKRRIKKDIMNKKVEENLIHDENENNIINDKICCDEKQDLDKEIHVDEQNEKKSNSTLNNESFISILSNDNSEKKKDMEESNNYSNNFYLNSLEENIIYPTQHVDCDFNGKWKSHVDDILENDSYYSNMNDNSNKSCISDYELLKTSILLNNTKDDFPLYENSRKNILTTSGKINKNKNLKERKKKNLNRLFYTLKLTNNFSFKNSKNRRKYTNSYNSGSSTHSRYVMDNKEYIIYHNNNNNNNNNYNSYSNNCNNMYIQGNKKKYNRLYCKKSANSQEKDYDKDINLIASDKINSELSQDDLKYNSQIINMPNDHFNIITSDEKENIKKNAYKNYVNYINERRYGYFDLLEKKNEKIIRKLLIANNGMAALKCILSLKDWLFKKFYDENLIKIIVMATDEDIKSNAKYISLADKVIKVPGGKNIHNYANVPLIVELAKSENVDAVWPGWGHSSENPLLSTLLEKENIIFIGPTGNVMEALGDKISANILAQSVEVPVVKWSGDNIRIDKFENNKINDELYNNATIHSLDDCIKECKRIGFPVMIKASQGGGGKGIRKVENEYEIKKAYEQVQNELPNSPIFLMKVCNNVRHIEIQVVGDMYGNVCSLSGRDCTTQRRFQKIFEEGPPSVVPYPIFREMEKSSIRLTKMIKYRGAGTIEYLYDQINKKYFFLELNPRLQVEHPVSEGITNCNLISIQLQVAMGIPLQNIDDIRNLYQIDKIEKIKKKDEQKKEFELTDNLCNDTINKDNINNDNIYKDNINNDNIYKDNIYKDNINNDNIYKDNIYKDNINNDNIYKDNIYKDNIYNDNIYKDNINNDNIHHIDNTTNEQNNKNLLHYNNYRNQNLCNNNSIKSLLNYDTNENVNRKYNLLNEHFDFYNNKPYIKNHVIAARITAENSNDSFKPTSGNVRRINFQNWKDVWGYFSINDGFVHEFSDSQIGHIFAKGETREVARKNLILALRKLHIDGDIKTGTKYLAKILESKAFIDNNITTNWLDIIIEKKKHVFYNTCHIILLCATIFKLLIYFMNEKGKVEENLDRDDIAIKRDKNYGNVINKNNNHSGNINNNGEHMCKMKSAYIFDMIFQNIKYPFKGYNIGENLYQLEINGQEIEISAEYDKNNNKVFSTFNNQTYIYACSEDTLGIHMQLEKDNIFIPNVRNPYHLISNTNGKIVKYLINDGEEVKKNDDYIEVEAMKMIMTFKSTESGILRHKLSEGTIIKIGDLLGIIEKKDNDKKHIKQDNEIQYFNGHLDLSNKYTYELIDNRTIFPNILDDNYNKSCDNSYAFTDNMSLQNSEEHYLVKDEQKKKKKKNISSILNNNMVSIKTVSNDLTDNINVLRAETLSEEGLKDEIYHGQMCDDRMCDDQMCDDQMCDDENVVKKNDKEQNKSHKNLKENNMDECTYEDDNYIYMKENQKKKLFMKQNRKKIFRLFSNDNEKITTALNYLNDKFHCVKNYLSNLNFSSANSVSDSSNSSYQNNKNNNNNNDNNNNNYNNNNNNNSKNKKKNNSVQYNYSNAKYSNVNMIHKYDKKPFDKSYLMNEVNSNNVNVLMMKNKNNSTFPLIENLENNISTEIMSSRNTSNEKILHNNISKDNTISEPIFNNNSSDESNINNITFFNNLSNNGSIRKRNNNNNSSSSNNNNNNNNNNKNNNFKHSYYMDYNNDNIYWNHVKNEKSKYLLDIPIMKRIEFLLKGYEQDYEKCFDELINKKDIKNVSNWSAYIINNINDILDTFIQYNILFSKKEFISEIDLYDILYNNIRDKKKQYEIIHAYTYNDLSIKFIEKILKYILNNINSNLAFDIILDKLKILAEFKGKIFRNIIVLSRHILFLLEGLELIEYIKIALNYNDNKNMKNGGKLSNNMLLLSNYMKKNNLDFSKMIEYKNNKNDIEIVNMFFKGHSSNIHMFVPSLIKSNKNSMFLKFYLNNLYKYCNIKSIMVTNNIIKFSINNSEYTNLLIWNENDTIDINKILESDIKINNDRYLNTVHIINTNNELCLHPSHSFEGNIIKNKILQKCKKLYIYNYANNKYGDIYEWKNEDLSKGLVGKYSKDGSINNILPYEEYIFGNEKEILEYYELKNINQAIYEKTKIFFGIYKNNKNDNNIRNNVNNNYTSLFGHRVIDFNEIKNTSNEYNNFEEHNYQDDKFIFNKDIHNILLELKESLNDISRGRLNTLIRDNKISSCIIYHIIVDDMMDIETIKEAYKVFMIKYNEMILENYVNNIFIKIYRTNKKSCTENAPQIQLERMFKLNVLLNKGGVKKERTDRYNVEDDNNKKDNDNKYNCNNNNNDDNKYDCNNNFYYDNKYDCNNNFYHDNKFNCNNNYYHNYHFVEEINQFPSFQIDTLYMKRKRAREVDTLYAYDFINLINISLNRSNKNRESHKICNYINSIKEFKLKSDMICYNSNSDNLKNHAMNIKSAHIPLEKKEEYLFEHFDNLSNYEIKIRKSLYLSDKLDIGQNKRSVVGLLLNIRTDEYEEGRDVIFIINDISTQGGSFSIFEDELFYGISSYAREKKIPRIYISCNSGARIGLYNFLMDKIRIEWKDEQKKELGYKYIYITQDVKEQIDKEDIIFLTEIIENNEKRYIIDAIVGNLKNPVGVENLRGSGLIAGETSKAYEEIFTLSYVTGRSVGIGAYLVRLGKRTIQKKGSSLLLTGFNALNKILGENVYVSNEQLGGVNIMMRNGISQVQVESDQEGMDKIIQWLSYVPRTSNDYYDLIQNIYKENNRKFLQNNNFLITNKQKTMNTYNNLFIHNNKNVSNSVDIKDNIKNQIDTNINTETNINVQDLNIIKKNGINTKSKQDENVYEKKDKVEEIYKDQNTYSTNNSKTSKPNDNSMSSYNFELLHINDMDYDHIDDSNIIDLIKGTQEEQGFLDKNTYFEYMNEWGKGIITGRGKLGSIPVGFIAVNKNLVTQSIPCDPALKTKAQKLIQAPCVFFPDNSFKTAQSIEDFNKENLPLFIFANWRGFSGGSMDMFYGILKFGSMIVNQLVNYKHPVFVYIPISAELRGGSWVVVDETLNSQIIEMYADVNSKGGILEPPGIVEVKFRYPDIRKLMHSIDTTIIALNEKMARCENDEEKNNIKKDIEIKEKELLPYYLQVCHKYADLHDMSTCMKAKGVIRKIVPWNKARSFFYYRLMRRLLINILSRKYDNALIKNEEIENILNDLNNSEDDDYIVCNRVFNNNILRNLKYDTKDIIYNKTLNDFLKIFKMLSQEQRTEFLNKINSYEN

SEQ ID NO: 4972 - DNA, 1533 bp, Metallosphaera sedula
  CDS (1)..(1533)
atgccaccctttagtagagttttggttgcaaacaggggagaaattgcagtaagggtaatgaaggcaataaaggaaatgggaatgacagcaatagctgtttactctgaggctgacaagtacgcagtccacgttaagtatgccgatgaagcttattatattggaccctcgccggccttggaaagttacctcaacataccccacatcattgacgcagcggagaaggctcacgctgacgctgttcatcctggatatggattcttgtcggagaatgctgacttcgtggaggcagttgaaaaggcaggaatgacttacataggtccctctgctgaggtcatgagaaagataaaggataagctggatgggaaaaggatagcccagttatctggtgtccccattgcccctggctcggatggccccgtagaatccattgacgaggctcttaagttggctgagaagataggataccccatcatggttaaggccgctagcgggggtggtggagtaggtataacaaagatagatacacctgaccagctcattgacgcatgggaaagaaacaagaggttagctacacaagccttcggacgatctgatctatacatagaaaaagccgccgtaaaccctaggcacattgagtttcagttaattggcgataagtacggcaactatgtcgttgcttgggagagggaatgtactattcagagaagaaaccagaagttgatagaggaggcaccatctccagcaatcacaatggaagaaaggtcacgaatgttcgagcctatatacaaatatgggaagttaattaattactttaccctgggtactttcgagacagttttctctgatgccacaagggagttctacttccttgagctgaacaaaaggcttcaggtagaacacccagttactgagttaatattcagaattgatctggtaaagctacagataaggctagctgcaggagaacatttgccattcacgcaggaggaactcaacaagagggcgagaggtgcagcaatagagttcaggataaatgccgaggatccaataaataatttcagcggaagctcaggtttcattacgtactacagggagcccacgggtcctggagtgagaatggatagcggtgtaacggagggaagctgggtacctcctttctacgactctctagtatcgaagttgattgtgtatggagaagacaggcaatacgcaatacaaactgccatgagggcactagacgattacaagattggcggagtcaaaacgactataccgctatacaagctcatcatgagggatcccgactttcaggaaggaaggttcagtactgcctatatttcccagaagattgactcaatggttaagaaactgaaggccgaagaggagatgatggcttcagtggccgcagttcttcagagcaggggactccttagaaagaaggcttcagctcctcaggagcaggcgaaaccaggctcaggatggaagagttacggtatcatgatgcagagcactcctagggtgatgtggggatga

SEQ ID NO: 4973 - protein, 510 aa, Metallosphaera sedula
MPPFSRVLVANRGEIAVRVMKAIKEMGMTAIAVYSEADKYAVHVKYADEAYYIGPSPALESYLNIPHIIDAAEKAHADAVHPGYGFLSENADFVEAVEKAGMTYIGPSAEVMRKIKDKLDGKRIAQLSGVPIAPGSDGPVESIDEALKLAEKIGYPIMVKAASGGGGVGITKIDTPDQLIDAWERNKRLATQAFGRSDLYIEKAAVNPRHIEFQLIGDKYGNYVVAWERECTIQRRNQKLIEEAPSPAITMEERSRMFEPIYKYGKLINYFTLGTFETVFSDATREFYFLELNKRLQVEHPVTELIFRIDLVKLQIRLAAGEHLPFTQEELNKRARGAAIEFRINAEDPINNFSGSSGFITYYREPTGPGVRMDSGVTEGSWVPPFYDSLVSKLIVYGEDRQYAIQTAMRALDDYKIGGVKTTIPLYKLIMRDPDFQEGRFSTAYISQKIDSMVKKLKAEEEMMASVAAVLQSRGLLRKKASAPQEQAKPGSGWKSYGIMMQSTPRVMWG

SEQ ID NO: 4974 - DNA, 3559 bp, Gallus gallus
  CDS (1)..(3537): s means g or c
atgtcgcagctgtgtgtcccccgtgggggccgggccctcctgggggcatggaggctccctttgctgcgccccccccccggatccgtgcgctctgccagctgccaacccatccgcaaggtgttggtggccaaccgtggtgagatcgccatccgcgtcttccgtgcctgcacggagctggggctgcgcacggtggccgtgtactcggagcaggacacggggcagatgcaccggcagaaggcagacgaggcctacctggtggggagggggctgccccccgtccaggcctacctgcacgtccccgacatcatccgcgtggccagggagaacgcagtggacgccatccaccccggctacggcttcctgtcagagcgcgctgactttgcccaagcctgcgtggatgcgggggtccgcttcgtcggcccccccccggaggtggtccgcaagatgggggacaaagtggaggcgcgcagcattgccatcgctgccggtgtccccgtagtgccggggacgtcggcgccggtggcgacgttgggggaggctcaggacttcgctgcccgcgttgggttccccatcatcttcaaagcagcccacggggggggggggcgtggaatgagagccgtgcgtggcccccaggagctggaggagagcttctcccgcgcctcctcggaggctttggctgcgtttggggatggggctctttttgtggagaaactcatggaacgcccgcggcacatcgaaggtcagatcctgggggacaaacacggcaatgtggtgcacctctatgagcgcgactgctccatccaacggcgccatcagaaggtggtggaaatcgcccccgccgcccgcctcgacccgcagctcagagcacagctcgcctccgacgccgtgaggatcgcgcagcaggtgggctacgagaatgcggggacagtggagttcctggtggaccgggatgggaagcattacttcatcgaggtgaactcgaggctgcaggtggagcacacggtgaccgaggagatcacgggggtggacctggtgcaggcgcagctgttggtggccgccgggcgctccctgtccgagctggggctgcagcaggacagcgtgagggtgaacggctgcgccattcagtgccgggtgaccacggaggacccggccaggggcttccagcccgacaccgggcgcatcgaggtgttccggagcggggaaggaatggggatccgcttggatggagcttcggcctttcagggcgctctcatctccccccattacgactcgctgctggtgaaggtgatcgcccacggccccgaccagccctctgcagcagccaagatgagccgagcgctgggcgagttccgcatccgtggtgtaaagacgaacatcccgttcctgcagaacgtcctggcccacccgcagttcctggggggggccgtggacacgcagttcatcgatgagaaccccgaactgttccacctgcggcccagccagaaccgggcccagaagctgctgcattacctgggccacgtgatggtgaatggccccagcacccccctccctgtgaaggccaaagcagcggtggtggagcccgtaccccccccagtgcccatggggtcccccccggagggtctgagggcggtgctgcagcgcgaaggcccggcggggttcgctcgggcgctgcgggggcaccgggggctgctgctgsccgacacgaccttccgggacgcccaccaatccctgctggccacccgagtgcgcacgcgggacctggcccgcatcgcacccttcgtggcgcattcgctcagcccgctctgcagcatggagacgtggggaggtgccaccttcgacgtggccatgcgcttcctgcacgagtgcccctgggagcggctgcgggagctgcgccggttggtccccaacatccctttccagatgctgctgaggggggccaacgctgtcggttacaccaactaccccgataacgtcatctaccgattctgcgaggtggctgcagccaacgggatggacatcttccgtatcttcgacgccctcaactacctgcccaacctgctgctgggggtggaggcggtgggccgggcgggggctgtggtggaggctgccctgtcctacaccggggacgtggctgaccctacacgcaccaaatacagcctcgactactacctggggctggccaaagagctggtggctgctggcacccacatcctgtgcattaaggacatggcggggctgctgaccccggcggccgcccgtttgctggtgagctctttgagggatcgcttccccgacgtccccatccacgtccacacccacgacacggccggggctgccatcgccaccctcctggcggccgccaacgccgacgccgacgtggtggatgtggccgtggacgccatgtctgggatgacctcccagcccagcatgggggctttggtggcctgcgctcgaggcaccccgctggatacgggcattgccttggagagggtctttgagtacagtgagtactgggagggggcgcgggggctctacgccgcctttgactgcacggccaccatgaagtccggcaacgccgacgtctatgagaacgagataccgggggggcaatacaccaacctgcacttccaggcccacgctatggggctggggcataaattcaaggaggtcaagaaggcctatgctgaagccaacaagctcctcggggacctcatcaaggtgacgccgtcatcgaaggtggtgggagacctggcccagttcatggtgcagaacgggctgtcccgggaggaagcagaggcgcgggcagatgagctctcctttcctctctccgtggtcgaattcctgcaaggctacatcgggacccccccggggggcttccctgagcccttccgctccaaggtgctgaaggaccttccacgcgtggaggggcgcccgggggcttcactgccccccctggacttcgaggctctgagccaggagctgggggcacgcgatgggaccccccccagccctgaggatctactctcggcagctctgtaccccaaagtttacgccgaattccgtgacttcacctccacttttggccccgtctcctgcctgggcacacggctcttcctggagggtcccactatcgctgaggagtttgaggtggagctggagagggggaagacgctgcacatcaaagcgttggcgctgggggatctgaatgcagccgggcagcgcgaggctttctttgagctcaatgggcagctgcgctccatcctcgtgagagacacccaggccttgaaggagatgcacgtgcaccccaaggcggaccggtcggccaaaggccaagtgggggcccccatgccgggggaggtggtggaggtgagggtgaaggagggggaggcggtggagaaaggagcccccctgtgcgtgctgagcgccatgaagatggagacggtggtgacagcgccgcggggggggacggtcagccgcctccacgtgagacctgggatgagcctggagggggacgacctcatcgccgagatcgagtaaaggaggggggggggggaccccc

SEQ ID NO: 4975 - protein, 1178 aa, Gallus gallus
  misc_feature (566)..(566): Xaa can be Ala or Pro
MSQLCVPRGGRALLGAWRLPLLRPPPGSVRSASCQPIRKVLVANRGEIAIRVFRACTELGLRTVAVYSEQDTGQMHRQKADEAYLVGRGLPPVQAYLHVPDIIRVARENAVDAIHPGYGFLSERADFAQACVDAGVRFVGPPPEVVRKMGDKVEARSIAIAAGVPVVPGTSAPVATLGEAQDFAARVGFPIIFKAAHGGGGRGMRAVRGPQELEESFSRASSEALAAFGDGALFVEKLMERPRHIEGQILGDKHGNVVHLYERDCSIQRRHQKVVEIAPAARLDPQLRAQLASDAVRIAQQVGYENAGTVEFLVDRDGKHYFIEVNSRLQVEHTVTEEITGVDLVQAQLLVAAGRSLSELGLQQDSVRVNGCAIQCRVTTEDPARGFQPDTGRIEVFRSGEGMGIRLDGASAFQGALISPHYDSLLVKVIAHGPDQPSAAAKMSRALGEFRIRGVKTNIPFLQNVLAHPQFLGGAVDTQFIDENPELFHLRPSQNRAQKLLHYLGHVMVNGPSTPLPVKAKAAVVEPVPPPVPMGSPPEGLRAVLQREGPAGFARALRGHRGLLLXDTTFRDAHQSLLATRVRTRDLARIAPFVAHSLSPLCSMETWGGATFDVAMRFLHECPWERLRELRRLVPNIPFQMLLRGANAVGYTNYPDNVIYRFCEVAAANGMDIFRIFDALNYLPNLLLGVEAVGRAGAVVEAALSYTGDVADPTRTKYSLDYYLGLAKELVAAGTHILCIKDMAGLLTPAAARLLVSSLRDRFPDVPIHVHTHDTAGAAIATLLAAANADADVVDVAVDAMSGMTSQPSMGALVACARGTPLDTGIALERVFEYSEYWEGARGLYAAFDCTATMKSGNADVYENEIPGGQYTNLHFQAHAMGLGHKFKEVKKAYAEANKLLGDLIKVTPSSKVVGDLAQFMVQNGLSREEAEARADELSFPLSVVEFLQGYIGTPPGGFPEPFRSKVLKDLPRVEGRPGASLPPLDFEALSQELGARDGTPPSPEDLLSAALYPKVYAEFRDFTSTFGPVSCLGTRLFLEGPTIAEEFEVELERGKTLHIKALALGDLNAAGQREAFFELNGQLRSILVRDTQALKEMHVHPKADRSAKGQVGAPMPGEVVEVRVKEGEAVEKGAPLCVLSAMKMETVVTAPRGGTVSRLHVRPGMSLEGDDLIAEIE

SEQ ID NO: 4976 - DNA, 1365 bp, Streptococcus pyogenes
  CDS (1)..(1365)
atgtttaaaaaaatcttaattgctaatcgtggtgaaattgcagtgcgtatcattcgtgctgcacgagaattagggatttccacagttgcagtttattcggaagcggataaggaagctctgcacacgatattggcggacgaggctatctgtattggccctgcccgttccaaagaatcctatcttaatatgaattccgtcttgtcagcagctattgtgacaggagcccaagcgattcacccagggtttggctttttaagtgaaaactcaaagtttgcgaccatgtgtgaagagatgaatattaaatttatcggtccatccgcatcggttatggataaaatgggtgataaaatcaatgctcgttctgaaatgattaaggcaggagtgcccgttattccagggtcagatggtgaagtttataacgctcaagaagccttagctattgccaataagattggttatcctgtcatgctaaaagcatcagcaggtggcggtggtaaagggattcgtaaagtggagacagaagcagatttggaggcggctttcaatgctgctagtcaagaagctttgggagctttcggaaatggcgccatgtatttggaaaaagtaatttacccagctagacatattgaggtgcaaattttaggagacgctcacggtaacatcattcacttgggagaacgggattgctccttgcaacggaataatcaaaaagtcttggaagaaagtccatccattgctattggtaataccctcagacacgaaatggggcaagcagcggttagagcagctaaagctgtagcctatgaaaatgcgggaaccattgagtttttgttggacgaagacagcgagaaattctatttcatggaaatgaatacccgtatccaagttgagcatcctgtcaccgaatttgtgacaggagtggatattgtcaaagagcaaatcaaaattgcagcaggtcagcctttggcgattaatcaagaagacatcactatcacgggacatgctattgaatgtcgtatcaatgctgaaaatactgcttttaactttgcaccgagtcccggaaagattacagacttgtatatgccaagtggtggtgtaggactacgagttgattcagcagtttacaatggctatgccattcctccttattatgacagcatgattgctaaaatcatcgttcatggaagcaatagatttgacgctttgatgaaaatgcaacgtgccttagttgaattggaaattgaaggcattatcaccaatacagacttccagctcgatttgatttcagataagcgagtgattgcaggagattatgatacctctttcttgatggaaacgttcctgccacattacaataaagattag

SEQ ID NO: 4977 - protein, 454 aa, Streptococcus pyogenes
MFKKILIANRGEIAVRIIRAARELGISTVAVYSEADKEALHTILADEAICIGPARSKESYLNMNSVLSAAIVTGAQAIHPGFGFLSENSKFATMCEEMNIKFIGPSASVMDKMGDKINARSEMIKAGVPVIPGSDGEVYNAQEALAIANKIGYPVMLKASAGGGGKGIRKVETEADLEAAFNAASQEALGAFGNGAMYLEKVIYPARHIEVQILGDAHGNIIHLGERDCSLQRNNQKVLEESPSIAIGNTLRHEMGQAAVRAAKAVAYENAGTIEFLLDEDSEKFYFMEMNTRIQVEHPVTEFVTGVDIVKEQIKIAAGQPLAINQEDITITGHAIECRINAENTAFNFAPSPGKITDLYMPSGGVGLRVDSAVYNGYAIPPYYDSMIAKIIVHGSNRFDALMKMQRALVELEIEGIITNTDFQLDLISDKRVIAGDYDTSFLMETFLPHYNKD

SEQ ID NO: 4978 - DNA, 1344 bp, Chlorobium tepidum
  CDS (1)..(1344)
atgtttaaaaaaatactcatagcaaaccgtggggagatcgccttgcgggtcatgcatacctgccgcgagatgggcatttgcaccgtggccgtctattcgaccgccgatgccgattcccttcatgtcaggtacgcagacgaagcggtctgcatcggaccgccgctttcgagagaaagctacctgaatattccgcgcatcatcgccgctgccgaggtcaccaacgctgacgcgattcatcctggctacggctttctggccgaaaacgccgattttgcggaagtatgcagctcctcgaacatcaagttcattggcccttccgcggagatgatcaacaagatgggcgacaaaaacaccgccaaatcgaccatgattgctgcaggcgtgccagtcgtcccgggaagtgaaggtctggtcgaagatgtggctcacgccattgagaccgccaaaaagatcggctatcccgtcatcatcaaaccgacagctgggggtggcggaaaagggatgcgggtggtacacgaagagagccagctcgaaaaaaaccttaagaccgcccagagcgaggccggcatggccttcggcaacagcggcgtctatatcgagaagttccttgaaaatccccgccacatcgaaattcagattctggccgaccagcacggcaacgtggtgcacctcggcgaacgcgactgcaccgtgcagcgccgccaccagaagctgatcgaggagactccctcaccggtagtcgatgaagccctgcgcacgaagatgggcgaagcggccgtggccgccgccaaggcgatcaactacgaaggcgccggcaccatcgagttcctgctcgacaagcacaaaaacttctacttcatggagatgaacacccgcatccaagtggagcatcccataaccgagcagcgctacgacgtcgatatcgtcagggaacagatcagcatcgccgctggaggaagcctggaagggaaaaccttcattccgagaggccactccatcgagtgccgcatcaatgccgaagaccctgagcacatgttcaggccttcgccgggagagattcaggtctttcatacgcccggaggccccggcgtcaggatcgactcgcactgctacgcaagctacgtcgtgccatcgaactacgactcgatgatcggcaagctcatcgtcactgcccacaaccgtgacgaagcgatcgcccgcatgtcgagggctctcgacgagttcatcatcatgggcatcaaaaccaccatccctttccacaagcaggtgatgcacgatccggtgttcagaagcggagagttcgacacgagcttcctcgacagcttcaggttcgagaaaccgtaa

SEQ ID NO: 4979 - protein, 447 aa, Chlorobium tepidum
MFKKILIANRGEIALRVMHTCREMGICTVAVYSTADADSLHVRYADEAVCIGPPLSRESYLNIPRIIAAAEVTNADAIHPGYGFLAENADFAEVCSSSNIKFIGPSAEMINKMGDKNTAKSTMIAAGVPVVPGSEGLVEDVAHAIETAKKIGYPVIIKPTAGGGGKGMRVVHEESQLEKNLKTAQSEAGMAFGNSGVYIEKFLENPRHIEIQILADQHGNVVHLGERDCTVQRRHQKLIEETPSPVVDEALRTKMGEAAVAAAKAINYEGAGTIEFLLDKHKNFYFMEMNTRIQVEHPITEQRYDVDIVREQISIAAGGSLEGKTFIPRGHSIECRINAEDPEHMFRPSPGEIQVFHTPGGPGVRIDSHCYASYVVPSNYDSMIGKLIVTAHNRDEAIARMSRALDEFIIMGIKTTIPFHKQVMHDPVFRSGEFDTSFLDSFRFEKP

SEQ ID NO: 4980 - DNA, 7589 bp, Alopecurus myosuroides
  CDS (157)..(7119)
tcgataaacttcctgttgcatgtctctatctctatggactaacggttcctatgtgcatgcatctgtcaggtttccagacctggggtttacaatcagtttatggcagtctgtgtttgaagaacactgcaactctgctgtctgtccaaagggaggacgatgggatccacacatctgcccattgtcgggtttaatgcatccacaacaccatcgctatccactcttcgccagataaactcagctgctgctgcattccaatcttcgtccccttcaaggtcatccaagaagaaaagccgacgtgttaagtcaataagggatgatggcgatggaagcgtgccagaccctgcaggccatggccagtctattcgccaaggtctcgctggcatcatcgacctcccaaaggagggcgcatcagctccagatgtggacatttcacatgggtctgaagaccacaaggcctcctaccaaatgaatgggatactgaatgaatcacataacgggaggcacgcctctctgtctaaagtttatgaattttgcacggaattgggtggaaaaacaccaattcacagtgtattagtcgccaacaatggaatggcagcagctaagttcatgcggagtgtccggacatgggctaatgatacatttgggtcagagaaggcgattcagttgatagctatggcaactccggaagacatgagaataaatgcagagcacattagaattgctgatcagtttgttgaagtacctggtggaacaaacaataacaactatgcaaatgtccaactcatagtggagatagcagagagaactggtgtctccgccgtttggcctggttggggccatgcatctgagaatcctgaacttccagatgcactaactgcaaaaggaattgtttttcttgggccaccagcatcatcaatgaacgcactaggcgacaaggttggttcagctctcattgctcaagcagcaggggttcccactcttgcttggagtggatcacatgtggaaattccattagaactttgtttggactcgatacctgaggagatgtataggaaagcctgtgttacaaccgctgatgaagcagttgcaagttgtcagatgattggttaccctgccatgatcaaggcatcctggggtggtggtggtaaagggattagaaaggttaataatgatgacgaggtgaaagcactgtttaagcaagtacagggtgaagttcctggctccccgatatttatcatgagacttgcatctcagagtcgtcatcttgaagtccagctgctttgtgatgaatatggcaatgtagcagcacttcacagtcgtgattgcagtgtgcaacgacgacaccaaaagattatcgaggaaggaccagttactgttgctcctcgtgaaacagtgaaagagctagagcaagcagcaaggaggcttgctaaggccgtgggttacgtcggtgctgctactgttgaatatctctacagcatggagactggtgaatactattttctggagcttaatccacggttgcaggttgagcacccagtcaccgagtcgatagctgaagtaaatttgcctgcagcccaagttgcagttgggatgggtatacccctttggcagattccagagatcagacgtttctacggaatggacaatggaggaggctatgatatttggaggaaaacagcagctctcgctactccattcaactttgatgaagtagattctcaatggccgaagggtcattgtgtggcagttaggataaccagtgagaatccagatgatggattcaagcctactggtggaaaagtaaaggagataagttttaaaagtaagccaaatgtctggggatatttctcagttaagtctggtggaggcattcatgaatttgcggattctcagtttggacacgtttttgcctatggagagactagatcagcagcaataaccagcatgtctcttgcactaaaagagattcaaattcgtggagaaattcatacaaacgttgattacacggttgatctcttgaatgccccagacttcagagaaaacacgatccataccggttggctggataccagaatagctatgcgtgttcaagctgagaggcctccctggtatatttcagtggttggaggagctctatataaaacaataaccaccaatgcggagaccgtttctgaatatgttagctatctcatcaagggtcagattccaccaaagcacatatcccttgtccattcaactatttctttgaatatagaggaaagcaaatatacaattgagattgtgaggagtggacagggtagctacagattgagactgaatggatcacttattgaagccaatgtacaaacattatgtgatggaggccttttaatgcagctggatggaaatagccatgttatttatgctgaagaagaagcgggtggtacacggcttcttattgatggaaaaacatgcttgctacagaatgaccatgatccgtcaaggttattagctgagacaccctgcaaacttcttcgtttcttgattgccgatggtgctcatgttgatgctgatgtaccatacgcggaagttgaggttatgaagatgtgcatgcccctcttgtcgcctgctgctggtgtcattaatgttttgttgtctgagggccaggcgatgcaggctggtgatcttatagcgagacttgatctcgatgacccttctgctgtgaagagagccgagccatttgaaggatcttttccagaaatgagccttcctattgctgcttctggccaagttcacaaaagatgtgctgcaagtttgaacgctgctcgaatggtccttgcaggatatgaccatgcggccaacaaagttgtgcaagatttggtatggtgccttgatacacctgctcttcctttcctacaatgggaagagcttatgtctgttttagcaactagacttccaagacgtcttaagagcgagttggagggcaaatacaatgaatacaagttaaatgttgaccatgtgaagatcaaggatttccctaccgagatgcttagagagacaatcgaggaaaatcttgcatgtgtttccgagaaggaaatggtgacaattgagaggcttgttgaccctctgatgagcctgctgaagtcatacgagggtgggagagaaagccatgcccactttattgtcaagtccctttttgaggagtatctctcggttgaggaactattcagtgatggcattcagtctgacgtgattgaacgcctgcgcctacaatatagtaaagacctccagaaggttgtagacattgttttgtctcaccagggtgtgagaaacaaaacaaagctgatactcgcgctcatggagaaactggtctatccaaaccctgctgcctacagagatcagttgattcgcttttcttccctcaaccataaaagatattataagttggctcttaaagctagtgaacttcttgaacaaaccaagctcagcgaactccgcacaagcattgcaaggaacctttcagcgctggatatgttcaccgaggaaaaggcagatttctccttgcaagacagaaaattggccattaatgagagcatgggagatttagtcactgccccactgccagttgaagatgcacttgtttctttgtttgattgtactgatcaaactcttcagcagagagtgattcagacatacatatctcgattataccagcctcaacttgtgaaggatagcatccagctgaaatatcaggattctggtgttattgctttatgggaattcactgaaggaaatcatgagaagagattgggtgctatggttatcctgaagtcactagaatctgtgtcaacagccattggagctgctctaaaggatgcatcacattatgcaagctctgcgggcaacacggtgcatattgctttgttggatgctgatacccaactgaatacaactgaagatagtggtgataatgaccaagctcaagacaagatggataaactttcttttgtactgaaacaagatgttgtcatggctgatctacgtgctgctgatgtcaaggttgttagttgcattgttcaaagagatggagcaatcatgcctatgcgccgtaccttcctcttgtcagaggaaaaactttgttacgaggaagagccgattcttcggcatgtggagcctccactttctgcacttcttgagttggataaattgaaagtgaaaggatacaatgagatgaagtatacaccgtcacgtgatcgtcagtggcatatatacacacttagaaatactgaaaatccaaaaatgctgcacagggtatttttccgaacacttgtcagacaacccagtgcaggcaacaggtttacatcagaccatatcactgatgttgaagtaggacacgcagaggaacctctttcatttacttcaagcagcatattaaaatcgttgaagattgctaaagaagaattggagcttcacgcgatcaggactggccattctcatatgtacttgtgcatattgaaagagcaaaagcttcttgaccttgttcctgtttcagggaacactgttgtggatgttggtcaagatgaagctactgcatgctctcttttgaaagaaatggctttaaagatacatgaacttgttggtgcaagaatgcatcatctttctgtatgccagtgggaagtgaaacttaagttggtgagcgatgggcctgccagtggtagctggagagttgtaacaaccaatgttactggtcacacctgcactgtggatatctaccgggaggtcgaagatacagaatcacagaaactagtataccactccaccgcattgtcatctggtcctttgcatggtgttgcactgaatacttcgtatcagcctttgagtgttattgatttaaaacgttgctctgccaggaacaacaaaactacatactgctatgattttccattgacatttgaagctgcagtgcagaagtcgtggtctaacatttccagtgaaaacaaccaatgttatgttaaagcgacagagcttgtgtttgctgaaaagaatgggtcgtggggcactcctataattcctatgcagcgtgctgctgggctgaatgacattggtatggtagcctggatcttggacatgtccactcctgaatttcccagcggcagacagatcattgttatcgcaaatgatattacatttagagctggatcatttggcccaagggaagatgcatttttcgaagctgtaaccaacctggcttgtgagaagaagcttccacttatctacttggctgcaaactctggtgctcggattggcattgctgatgaagtaaaatcttgcttccgtgttggatggactgatgatagcagccctgaacgtggatttaggtacatttatatgactgacgaagaccatgatcgtattggctcttcagttatagcacacaagatgcagctagatagtggcgagatcaggtgggttattgattctgttgtgggaaaagaggatggactaggtgtggagaacatacatggaagtgctgctattgccagtgcctattctagggcgtacgaggagacatttacacttacattcgttactggacgaactgttggaatcggagcctatcttgctcgacttggcatacggtgcatacagcgtattgaccagcccattattttgaccgggttttctgccctgaacaagcttcttgggcgggaggtgtacagctcccacatgcagttgggtggtcccaaaatcatggcgacgaatggtgttgtccatctgactgttccagatgaccttgaaggtgtttctaatatattgaggtggctcagctatgttcctgcaaacattggtggacctcttcctattacaaaatctttggacccaatagacagacccgttgcatacatccctgagaatacatgtgatcctcgtgcagccatcagtggcattgatgacagccaagggaaatggttgggtggcatgtttgacaaagacagttttgtggagacatttgaaggatgggcgaagacagtagttactggcagagcaaaacttggagggattcctgttggtgttatagctgtggagacacagaccatgatgcagctcgtccccgctgatccaggccagcctgattcccacgagcggtctgttcctcgtgctgggcaagtttggtttccagattctgctaccaagacagcgcaggcgatgttggacttcaaccgtgaaggattacctctgttcatacttgctaactggagaggcttctctggagggcaaagagatctttttgaaggaattctgcaggctgggtcaacaattgttgagaaccttaggacatacaatcagcctgcctttgtatatatccccaaggctgcagagctacgtggaggagcctgggtcgtgattgatagcaagataaacccagatcgcatcgagtgctatgctgagaggactgcaaagggtaatgttctcgaacctcaagggttgattgagatcaagttcaggtcagaggaactcaaagaatgcatgggtaggcttgatccagaattgatagatctgaaagcaagactccagggagcaaatggaagcctatctgatggagaatcccttcagaagagcatagaagctcggaagaaacagttgctgcctctgtacacccaaatcgcggtacgttttgcggaattgcacgacacttcccttagaatggctgctaaaggtgtgatcaggaaagttgtagactgggaagactctcggtctttcttctacaagagattacggaggaggctatccgaggacgttctggcaaaggagattagaggtgtaattggtgagaagtttcctcacaaatcagcgatcgagctgatcaagaaatggtacttggcttctgaggcagctgcagcaggaagcaccgactgggatgacgacgatgcttttgtcgcctggagggagaaccctgaaaactataaggagtatatcaaagagcttagggctcaaagggtatctcggttgctctcagatgttgcaggctccagttcggatttacaagccttgccgcagggtctttccatgctactagataagatggatccctctaagagagcacagtttatcgaggaggtcatgaaggtcctgaaatgatcaaatgataccaacacatccaatacagtatgtgcatgatatctgtttctcttgaagtacatatatagatggatacaaggcggctgtaactgatggtagctaatctgggccaaccattacttttgtgaacttgctggtggcctttattattcaaggcacagctcgccttcggaccccctccggctggttgatgatgagtgtaactggatgtgttagttctgctgccacagaattcgagaaggataggggcatgcgggttttgcctcctgttggcaagaacactggtgattttgagttcttgttatgtggactgtggtagtcttgtttcgctgtagttctgtgatgttctatctcctgtaattctagtcttgggagagtgattcagatgtccattcaattttgaacttgaataataatatgctttgtaggcctatgcgtaccagtatgtggaataaatgttcgttgagtta

SEQ ID NO: 4981 - protein, 2320 aa, Alopecurus myosuroides
MGSTHLPIVGFNASTTPSLSTLRQINSAAAAFQSSSPSRSSKKKSRRVKSIRDDGDGSVPDPAGHGQSIRQGLAGIIDLPKEGASAPDVDISHGSEDHKASYQMNGILNESHNGRHASLSKVYEFCTELGGKTPIHSVLVANNGMAAAKFMRSVRTWANDTFGSEKAIQLIAMATPEDMRINAEHIRIADQFVEVPGGTNNNNYANVQLIVEIAERTGVSAVWPGWGHASENPELPDALTAKGIVFLGPPASSMNALGDKVGSALIAQAAGVPTLAWSGSHVEIPLELCLDSIPEEMYRKACVTTADEAVASCQMIGYPAMIKASWGGGGKGIRKVNNDDEVKALFKQVQGEVPGSPIFIMRLASQSRHLEVQLLCDEYGNVAALHSRDCSVQRRHQKIIEEGPVTVAPRETVKELEQAARRLAKAVGYVGAATVEYLYSMETGEYYFLELNPRLQVEHPVTESIAEVNLPAAQVAVGMGIPLWQIPEIRRFYGMDNGGGYDIWRKTAALATPFNFDEVDSQWPKGHCVAVRITSENPDDGFKPTGGKVKEISFKSKPNVWGYFSVKSGGGIHEFADSQFGHVFAYGETRSAAITSMSLALKEIQIRGEIHTNVDYTVDLLNAPDFRENTIHTGWLDTRIAMRVQAERPPWYISVVGGALYKTITTNAETVSEYVSYLIKGQIPPKHISLVHSTISLNIEESKYTIEIVRSGQGSYRLRLNGSLIEANVQTLCDGGLLMQLDGNSHVIYAEEEAGGTRLLIDGKTCLLQNDHDPSRLLAETPCKLLRFLIADGAHVDADVPYAEVEVMKMCMPLLSPAAGVINVLLSEGQAMQAGDLIARLDLDDPSAVKRAEPFEGSFPEMSLPIAASGQVHKRCAASLNAARMVLAGYDHAANKVVQDLVWCLDTPALPFLQWEELMSVLATRLPRRLKSELEGKYNEYKLNVDHVKIKDFPTEMLRETIEENLACVSEKEMVTIERLVDPLMSLLKSYEGGRESHAHFIVKSLFEEYLSVEELFSDGIQSDVIERLRLQYSKDLQKVVDIVLSHQGVRNKTKLILALMEKLVYPNPAAYRDQLIRFSSLNHKRYYKLALKASELLEQTKLSELRTSIARNLSALDMFTEEKADFSLQDRKLAINESMGDLVTAPLPVEDALVSLFDCTDQTLQQRVIQTYISRLYQPQLVKDSIQLKYQDSGVIALWEFTEGNHEKRLGAMVILKSLESVSTAIGAALKDASHYASSAGNTVHIALLDADTQLNTTEDSGDNDQAQDKMDKLSFVLKQDVVMADLRAADVKVVSCIVQRDGAIMPMRRTFLLSEEKLCYEEEPILRHVEPPLSALLELDKLKVKGYNEMKYTPSRDRQWHIYTLRNTENPKMLHRVFFRTLVRQPSAGNRFTSDHITDVEVGHAEEPLSFTSSSILKSLKIAKEELELHAIRTGHSHMYLCILKEQKLLDLVPVSGNTVVDVGQDEATACSLLKEMALKIHELVGARMHHLSVCQWEVKLKLVSDGPASGSWRVVTTNVTGHTCTVDIYREVEDTESQKLVYHSTALSSGPLHGVALNTSYQPLSVIDLKRCSARNNKTTYCYDFPLTFEAAVQKSWSNISSENNQCYVKATELVFAEKNGSWGTPIIPMQRAAGLNDIGMVAWILDMSTPEFPSGRQIIVIANDITFRAGSFGPREDAFFEAVTNLACEKKLPLIYLAANSGARIGIADEVKSCFRVGWTDDSSPERGFRYIYMTDEDHDRIGSSVIAHKMQLDSGEIRWVIDSVVGKEDGLGVENIHGSAAIASAYSRAYEETFTLTFVTGRTVGIGAYLARLGIRCIQRIDQPIILTGFSALNKLLGREVYSSHMQLGGPKIMATNGVVHLTVPDDLEGVSNILRWLSYVPANIGGPLPITKSLDPIDRPVAYIPENTCDPRAAISGIDDSQGKWLGGMFDKDSFVETFEGWAKTVVTGRAKLGGIPVGVIAVETQTMMQLVPADPGQPDSHERSVPRAGQVWFPDSATKTAQAMLDFNREGLPLFILANWRGFSGGQRDLFEGILQAGSTIVENLRTYNQPAFVYIPKAAELRGGAWVVIDSKINPDRIECYAERTAKGNVLEPQGLIEIKFRSEELKECMGRLDPELIDLKARLQGANGSLSDGESLQKSIEARKKQLLPLYTQIAVRFAELHDTSLRMAAKGVIRKVVDWEDSRSFFYKRLRRRLSEDVLAKEIRGVIGEKFPHKSAIELIKKWYLASEAAAAGSTDWDDDDAFVAWRENPENYKEYIKELRAQRVSRLLSDVAGSSSDLQALPQGLSMLLDKMDPSKRAQFIEEVMKVLK

SEQ ID NO: 4982 - DNA, 4439 bp, Drosophila melanogaster
  CDS (417)..(4010)
agtccgacggacagctttgaagtgaacggttcgcgagttcctgggcagaagagagaatcagagtgcagcagagcaaccgtttgcgaattcgcgctgttctacctacatagaccaaaaccaaaccaattccaagcaaaccaaaccaaacgcaaccccgagaccaaacgcaaaaaaaagaggccggcaagttgacaaaacctcgcgcacataggatacataggaaccgtgaatttgtatgtgctgagcgcggtacataagctaaagaaaccacgttgactcacgacccgtttgaaattgttttgtagtgctggagcagcgattacccactttgcgccaggacaacgacaataggcgcagagcgctccttcggaactttcgccatcaataaatacatttaagtcctaggcgggatcagcatgttcattccggccgcccagtccgcgtacaggacgctgcgcaagacccagccacgcgtccggctcaacgccatcttcaaaaatggctactccagcaaggtggagtacaagcccatccggtcagtgctggtggctaaccgcggtgagatcgccatccgagtgttccgtgcctgcacagagttgggcatcaaatcggtggcggtctactcggagcaggataagatgcacatgcaccgacaaaaggccgacgagtcgtacatagtgggcaagggtctgcccccggtggaggcctacctcaacattccagagctaattagggtgtgcaaggagaacgatgtggatgccgtgcatcccggctacgggttcctttcagagcgcagtgacttcgcccaagcggtgattgatgctggactgcgcttcattggcccctcacccgaagtcgtccagaagatgggtgataaggtggcggctcgtgtggcggccattgaagcgggtgtgcccattgtgcccggcaccgacggtccagtgaccaccaaggaggaggcactggagttctgcaagaagcacggactgcccgttatcttcaaggccgcttacggaggcggaggtcgcggcatgcgcgtcgtccgcaaaatggaggatgtggaggagagcttccagcgagccagttccgaggccaaggccgcctttggcaatggtgcgatgttcattgagaagttcatcgagcgaccgcgtcacattgaggttcaactgctgggagacaaggccgggaatgtagtgcatctgtacgaacgtgactgctccgtgcagcgtcgccaccagaaggtggtggagatcgccccagcgccacgcctgcccatcgaaatccgggacaagatgacggaggcagcagtgcgcttggcccgccatgtgggctatgaaaacgccggaaccgtggagttcctttgcgacgagtccggcaacttctacttcatcgaagtgaacgcccgtctacaagtggagcacacggtcaccgaggagataacaggcatcgatttggtgcagtcgcaaatccgcgtggccgagggcatgaccctacccgaattgggctacacgcaggacaagatcgtgccgcgtggctatgccattcagtgccgtgtgaccaccgaagatccggccaacgattttcagcccaacaccggtcgcttggaggtcttccgatctggcgagggtatgggcattaggttggacagtgcgtccgcctacgccggagccatcatttcgccatactacgactccctgctggtcaaggtgatctcgcacgccagcgatctgcagagctccgcctccaagatgaaccgtgccctaagggaattccgcattcgcggcgtcaagaccaatatccccttcctcctaaacgtgctggagaaccagaagttcctccacggcgttctcgacacctacttcatcgacgagcacccgcaactgttcaagttcaagccctcgctcaatcgcgcccagaagctgctcaactatatgggtgaggtgctggtcaacggaccccagactcctctcgccaccactctgaagcctgccctcgtctcgccccacgttcccgaggttccgctggatctgtccccggaagctatagaacgcgaagaacgtggcgaggcaaaagttacggaaccaccgaagggactccgcgaggtcctggtgtgcgaaggtccggaggccttcgccaaggaggtgcgcaaccgtaaggaactgctactcatggacaccaccttccgcgatgcccaccagtcgctgctggccacccgcgtgcgttcccacgatctgctgaagatctccccctacgtgacgcacaagttcaacaacctgtattcgctggagaactggggcggagccaccttcgacgtggcgctgcgcttcctgcacgagtgcccgtgggagcgcctggaggagatgcgcaagcgcatcccgaacattcccttccagatgctgttgcgcggagccaacgccgtcggctacaccagctatccggacaacgtggtctacaagttctgtgagctggctgtgcagaccggcatggacatcttcagggtgttcgactcgctcaactacctgcccaacctgatcctcggcatggaagccgctggaaaggcgggcggcgtggtggaggctgccatctcctataccggagacgtcagcgatcccaagcgcaccaagtatgatctgaaatactacactaaccttgccgatgagctggtcaaggcgggcacccacgtgctctgcataaaggatatggctggtctgctcaagcccgaatccgccaggcttctgatcacagccattcgtgacaagcaccccgacatcccaatccatatccacacccacgacacctctggagcgggagtggcctccatgctggcatgcgccaatgccggagccgatgtggtggacgtggccgtcgactccatgagcggcatgacttcccagccgagcatgggtgccgtagtggcctccctgcaaggcactccgctggacacgaacttggatctgcgcacggtgtcggagtactccgcctactgggagcagacccgcaccctgtacgctcccttcgagtgcaccacaacaatgcggtcgggcaacgccgatgtctacctcaacgagattcccggcggccagtacaccaacctgcagttccaggccttctcgctgggtctgggcgacttcttcgaggacgttaagaaggcctaccgtgaggccaacctgttgttgggtgacattatcaaggtgacgccctcgtcgaaggtggtaggtgatcttgcccagttcatggtgcagaatgacctgaccgccgatcaagtgctggagcgggccgaggagctgtcgttccccaagtcggtggtggagtacttgcagggctctattggcattccgcacggcggattccccgagccgctgcgttcgcgagtgctcaaggacatgccccgcatcgagggacgtccgggagccgaactgaaggacttggactttgacaagctgaagaaggaactgcaggagtctcacacctgcgtcaccaaccgtgatgtcatgtcagctgccctctacccgcaggtgacgaatgatttcctaaacttccgcgaaaagtacggacccgtcgacaagctggacactcgcatcttcctcacgggtcccaaggtgggcgaggagttcgacgtacctctggagcgcggtaagacgctgagcgtgaaagctctggctgtgtccgccgatctcaagcccaacggtatccgcgaggtattctttgagttgaatggccagctgcgcgcggtccacatcctggacaaggaagccgttaaggagatccatgtccatcccaaagcgaacaagtcgaacaagagcgaggtgggcgcccccatgcccggaactgtcatcgatatccgcgtgaaggttggcgacaaagtggagaagggtcagcctctggtcgtgctctcggccatgaagatggagatggtggtgcagtcgccattggcgggcgttgtcaagaagctggaaattgccaacggaacgaagctggagggcgaggacctcattatgattatcgaatagacagtgccaccggatcaaaatgtccattgtctaagctgccaccgcacacacccaatgtaaaattaagtgaaaacagtgataatcttagggactctgtcagttcgattgatcataaaactgtccaaagtcgcctgtgtctatttttatatgaatcaaaatcattcatgtttccgtgtttccaggatcaatcgaccatgagtaactggtcaaattttttagctgtccctgccaaaatatatcggattgcataagttcgtgcccaagtatatttgtaaatttgtcgtagggcttttcccgcaagtcatttgaatcaaatttgtacgattatggaatttttaattcgcaaacacctgtgtcgagattccccctctagtaaatacgtaagtggttattaatgttatattaactattgtgtaataaacgttatac

SEQ ID NO: 4983 - protein, 1197 aa, Drosophila melanogaster
MFIPAAQSAYRTLRKTQPRVRLNAIFKNGYSSKVEYKPIRSVLVANRGEIAIRVFRACTELGIKSVAVYSEQDKMHMHRQKADESYIVGKGLPPVEAYLNIPELIRVCKENDVDAVHPGYGFLSERSDFAQAVIDAGLRFIGPSPEVVQKMGDKVAARVAAIEAGVPIVPGTDGPVTTKEEALEFCKKHGLPVIFKAAYGGGGRGMRVVRKMEDVEESFQRASSEAKAAFGNGAMFIEKFIERPRHIEVQLLGDKAGNVVHLYERDCSVQRRHQKVVEIAPAPRLPIEIRDKMTEAAVRLARHVGYENAGTVEFLCDESGNFYFIEVNARLQVEHTVTEEITGIDLVQSQIRVAEGMTLPELGYTQDKIVPRGYAIQCRVTTEDPANDFQPNTGRLEVFRSGEGMGIRLDSASAYAGAIISPYYDSLLVKVISHASDLQSSASKMNRALREFRIRGVKTNIPFLLNVLENQKFLHGVLDTYFIDEHPQLFKFKPSLNRAQKLLNYMGEVLVNGPQTPLATTLKPALVSPHVPEVPLDLSPEAIEREERGEAKVTEPPKGLREVLVCEGPEAFAKEVRNRKELLLMDTTFRDAHQSLLATRVRSHDLLKISPYVTHKFNNLYSLENWGGATFDVALRFLHECPWERLEEMRKRIPNIPFQMLLRGANAVGYTSYPDNVVYKFCELAVQTGMDIFRVFDSLNYLPNLILGMEAAGKAGGVVEAAISYTGDVSDPKRTKYDLKYYTNLADELVKAGTHVLCIKDMAGLLKPESARLLITAIRDKHPDIPIHIHTHDTSGAGVASMLACANAGADVVDVAVDSMSGMTSQPSMGAVVASLQGTPLDTNLDLRTVSEYSAYWEQTRTLYAPFECTTTMRSGNADVYLNEIPGGQYTNLQFQAFSLGLGDFFEDVKKAYREANLLLGDIIKVTPSSKVVGDLAQFMVQNDLTADQVLERAEELSFPKSVVEYLQGSIGIPHGGFPEPLRSRVLKDMPRIEGRPGAELKDLDFDKLKKELQESHTCVTNRDVMSAALYPQVTNDFLNFREKYGPVDKLDTRIFLTGPKVGEEFDVPLERGKTLSVKALAVSADLKPNGIREVFFELNGQLRAVHILDKEAVKEIHVHPKANKSNKSEVGAPMPGTVIDIRVKVGDKVEKGQPLVVLSAMKMEMVVQSPLAGVVKKLEIANGTKLEGEDLIMIIE

SEQ ID NO: 4984 - DNA, 1362 bp, Staphylococcus aureus
  CDS (1)..(1362)
atgcttcgttgtttaattgcgaatagaggtgaaattgctgtaaggattataagagcttgcagagaatatgggattgaaactgtagcagtttatgcaaaaggggacgagcaaagcttgcatgtacatttagcagatcaagctatatgtattggggaagctaatgctttaggtagttatttaaatattgaccgcatcatatctgctgcacaaatcactggtgctaatgcaattcacccaggatatggctttttatcagaatcaacaaaatttgctcaaaccgttgaggaacaaggcatagcgtttatagggcctactaaaaaaacgatggaaatgatgggggataaaataacagcaagacaaacagttcatcatgcaggtgttcctgtgattccaggatcaaatggtgctgtgaaccatgtgtctgaaattgagaagcttgccaaagacatcggttatccagttgttatcaaagctgccagtggcggtggtggtaaaggtatacgtattgtaaagaaagctgaagatttagaaaaggcatttaaagaagctaaaagtgaaggaaaaaaatactttgatgatgatcgtgtttatgttgaggcttttatacctgttgcaaaacatgttgaagttcaagttatgggagatgggcaggataattttgtacatttaggggaacgtgattgttctgtacaacgtaaaaatcaaaaattaatcgaagaatctccttgtgcagcattaactgaagaaagacgacaacaaatatgtaacgatgctgttaaagttgcacgtgcagcaaattatagaagtgcaggtacgattgaatttttagtaactgataccgcacattactttattgaaatgaatgctcgaatacaagttgaacatactgttacagagatgcgagcagaacgtgatttggttgcagcacaattgtatttattggaacataatcatttacctttttcacaaagcgatattcaatttaatggtcatgtgatagaagcgagaataaatgccgaaaatcctgaaaagaaatttcaaccaacaccaggtaaagtgacagcgttacatttacctcaaggctttaatgtgcgagtcgattctttactatatcacggttatcaagtttcaccatattatgattctttagtagctaaagtaattgtaaaatctcatgatagagcttcagcaattgataagttgaaagccaccttagatgaaatggtgatagatggattttctacaactgccgattttttatatgcagttttaaattatccactatatcgtgatggagatgcaaaagatgttgatattaaatttttagaaaaacatcaaattgttaaaggggtggaattataa

SEQ ID NO: 4985 - protein, 453 aa, Staphylococcus aureus
MLRCLIANRGEIAVRIIRACREYGIETVAVYAKGDEQSLHVHLADQAICIGEANALGSYLNIDRIISAAQITGANAIHPGYGFLSESTKFAQTVEEQGIAFIGPTKKTMEMMGDKITARQTVHHAGVPVIPGSNGAVNHVSEIEKLAKDIGYPVVIKAASGGGGKGIRIVKKAEDLEKAFKEAKSEGKKYFDDDRVYVEAFIPVAKHVEVQVMGDGQDNFVHLGERDCSVQRKNQKLIEESPCAALTEERRQQICNDAVKVARAANYRSAGTIEFLVTDTAHYFIEMNARIQVEHTVTEMRAERDLVAAQLYLLEHNHLPFSQSDIQFNGHVIEARINAENPEKKFQPTPGKVTALHLPQGFNVRVDSLLYHGYQVSPYYDSLVAKVIVKSHDRASAIDKLKATLDEMVIDGFSTTADFLYAVLNYPLYRDGDAKDVDIKFLEKHQIVKGVEL

SEQ ID NO: 4986 - DNA, 3453 bp, Staphylococcus aureus
  CDS (1)..(3453)
atgaaacaaataaaaaagttacttgttgctaaccgtggagaaattgcaattcgtatattcagagcggcggcagaattagacatcagcacagttgcaatttattcgaatgaagacaaaagttcattacatagatataaagcagatgaatcctatttagttggaagtgatttaggtcctgctgaaagttatttaaatattgagcgtatcattgatgtagcaaaacaagcgaatgtggatgcgattcatcctggctatggatttttaagtgaaaatgaacaatttgcgcgtcgttgtgcagaagaaggaattaaatttattggtcctcatttagaacatttagatatgtttggagataaagttaaagctcgtacaacggctatcaaggcagatttaccagttattcctggtacagacggtccaattaaatcatatgaattagcaaaagaatttgcagaagaagctggtttcccgctaatgattaaggccacaagtggtggcggcggtaaaggtatgagaatcgttcgtgaagaaagtgaattagaagatgctttccatagagcaaaatcagaagctgaaaaatcatttggtaatagtgaagtttacatagagagatacattgataatccaaagcatattgaagtacaagttataggtgacgaatatggaaatatcgtacacttatttgaacgtgattgttcagtacaacgtcgtcatcaaaaagttgtagaagttgcaccatcagttggattatcaccaacattacgtcaacgtatttgtgatgctgcaattcaattgatggaaaatattaaatatgtcaatgcaggtactgttgaatttctagtatctggtgacgaattcttctttatagaagttaaccctcgtgtacaagttgagcatacaattacagagatggtaacaggaattgatattgttaagacacaaattttagttgcagcaggtgccgatttatttggtgaagaaattaatatgccgcaacaaaaagatattacaacattgggctatgccatccaatgtcgtattacaacagaagatccgttaaatgatttcatgccggatactggaacaatcattgcttatcgttcaagcggtggctttggtgtacgtctcgatgctggagatggtttccaaggtgctgagatatcaccttattatgattcattactcgtaaaattatctacacacgcgatatcatttaaacaagcagaagaaaaaatggtacgttcattacgagaaatgcgtattcgtggtgttaaaactaatattccattcttaattaatgtaatgaagaataaaaagttcacaagtggtgattacacaactaaatttattgaagaaacaccagaacttttcgacattcagccgtctctagatagaggtactaaaacattagaatatataggtaatgtaacaattaatggtttcccaaatgttgagaaacgtccgaaaccagactatgaattagcatcaattccaactgtatcttcaagtaaaatcgcttcatttagtggtacgaaacaattgcttgatgaagtaggtccaaaaggtgtagctgaatgggttaaaaagcaggatgatgttttactaacagatacaacctttagagatgcacaccaatcattattagctacacgagttagaactaaggatatgattaatatcgcatccaaaacagcggacgtatttaaagatggtttctcacttgaaatgtggggcggtgctacatttgatgtggcatataatttcttgaaggaaaacccatgggaacgacttgaacgtctacgtaaagctattccaaatgtattattccaaatgttgttacgtgcttcaaacgcagttggttataaaaactatcctgataatgttattcataaattcgtacaagaaagtgctaaagcaggcatagatgtctttagaattttcgattctttaaactgggtagatcaaatgaaagttgccaatgaagcagtacaagaagcgggcaaaatctctgaaggtactatttgttatacaggtgacattttaaatcctgagcgatcaaacatttatactttagagtattatgtcaaactagctaaagagttagaacgtgaaggtttccatattttagcgattaaagatatggcaggcttattaaaacctaaagccgcttacgaattgattggtgagttaaaatcagctgtagatttaccaattcatcttcacactcatgatacaagtggtaatggtttattaacatacaaacaagcaatagatgctggtgtcgatatcattgatactgctgttgcttcaatgagtggtttaacaagtcagccaagcgccaattcgttatattatgcattaaatggcttcccacgccaccttagaactgatattgaaggtatggagtcacttagtcattattggtcaactgtacgtacttattattcagactttgaaagtgatatcaaatcaccgaatactgaaatttatcaacatgaaatgcctggtggacagtattcgaatttaagtcaacaagctaaaagtttaggtttaggcgaaagatttgatgaagtcaaagatatgtatcgcagagtgaatttcttatttggtgatatcgtaaaagtaactccatcgtctaaagtagttggtgatatggcactttatatggtacaaaatgatcttgatgaacaatccgtgattacagatggctataaattagatttcccagaatcagtagtgtcgttcttcaaaggcgaaataggacaacctgtaaatggttttaataaagatttacaagcggttattttaaaaggccaagaagcactaacagctcgtccaggtgaatatctagagccagttgattttgaaaaagtccgtgagttgcttgaagaagagcaacaaggtcctgttacggagcaagatattattagttatgtattatatccaaaagtatatgaacaatatattcaaactagaaatcaatacggaaacttatcgttacttgatacgcctacattcttctttggaatgcgtaatggtgaaacagtagaaatcgaaatcgataagggtaaacgattaattattaaactagaaacgattagtgaaccagatgaaaatggtaatagaacgatttactatgcgatgaatggtcaagcgagacgtatttacattaaagatgagaatgtgcatacaaatgcgaacgttaagccaaaagcagataagagtaatccaagtcatatcggtgcgcaaatgccaggttcagtaactgaagtcaaggttagtgtaggtgaatctgtgaaagctaaccagccgttgctaattactgaagctatgaaaatggaaacaacaattcaagcaccatttgacggtgtgattaaacaagtaactgtaaataatggtgacacaatagcgacaggcgatttattaatcgaaattgaaaaagcaactgactaa

SEQ ID NO: 4987 - protein, 1150 aa, Staphylococcus aureus
MKQIKKLLVANRGEIAIRIFRAAAELDISTVAIYSNEDKSSLHRYKADESYLVGSDLGPAESYLNIERIIDVAKQANVDAIHPGYGFLSENEQFARRCAEEGIKFIGPHLEHLDMFGDKVKARTTAIKADLPVIPGTDGPIKSYELAKEFAEEAGFPLMIKATSGGGGKGMRIVREESELEDAFHRAKSEAEKSFGNSEVYIERYIDNPKHIEVQVIGDEYGNIVHLFERDCSVQRRHQKVVEVAPSVGLSPTLRQRICDAAIQLMENIKYVNAGTVEFLVSGDEFFFIEVNPRVQVEHTITEMVTGIDIVKTQILVAAGADLFGEEINMPQQKDITTLGYAIQCRITTEDPLNDFMPDTGTIIAYRSSGGFGVRLDAGDGFQGAEISPYYDSLLVKLSTHAISFKQAEEKMVRSLREMRIRGVKTNIPFLINVMKNKKFTSGDYTTKFIEETPELFDIQPSLDRGTKTLEYIGNVTINGFPNVEKRPKPDYELASIPTVSSSKIASFSGTKQLLDEVGPKGVAEWVKKQDDVLLTDTTFRDAHQSLLATRVRTKDMINIASKTADVFKDGFSLEMWGGATFDVAYNFLKENPWERLERLRKAIPNVLFQMLLRASNAVGYKNYPDNVIHKFVQESAKAGIDVFRIFDSLNWVDQMKVANEAVQEAGKISEGTICYTGDILNPERSNIYTLEYYVKLAKELEREGFHILAIKDMAGLLKPKAAYELIGELKSAVDLPIHLHTHDTSGNGLLTYKQAIDAGVDIIDTAVASMSGLTSQPSANSLYYALNGFPRHLRTDIEGMESLSHYWSTVRTYYSDFESDIKSPNTEIYQHEMPGGQYSNLSQQAKSLGLGERFDEVKDMYRRVNFLFGDIVKVTPSSKVVGDMALYMVQNDLDEQSVITDGYKLDFPESVVSFFKGEIGQPVNGFNKDLQAVILKGQEALTARPGEYLEPVDFEKVRELLEEEQQGPVTEQDIISYVLYPKVYEQYIQTRNQYGNLSLLDTPTFFFGMRNGETVEIEIDKGKRLIIKLETISEPDENGNRTIYYAMNGQARRIYIKDENVHTNANVKPKADKSNPSHIGAQMPGSVTEVKVSVGESVKANQPLLITEAMKMETTIQAPFDGVIKQVTVNNGDTIATGDLLIEIEKATD

SEQ ID NO: 4988 - DNA, 2028 bp, Xanthomonas campestris
  CDS (1)..(2028)
atgccccagcacgcctccatcactggcaaaggccagccgtatttcgacaaggtgctgatcgccaaccgcggcgaaatcgcctgccgcgtcatcgccacctgccgccggctgggcatcgccaccgtggcggtgtattcggatgccgaccgcgacgcgcgccacgtgcgtctggcagatgaagcgatccatattggtgcgtcaccggcgcagcaaagctacctgcgcggcgacgccatccttgccgcggcacgcgccagcgatgcacaggcgatccatcccggctacgggtttttatcggaaaacgccgggtttgccgacgcctgcgcgcaggcaggggtggtattcatcggcccgcccgcgcaagcgatccgcgcgatgggcgacaagagtgctgccaaggcgctgatgcagcgcgccggcgtgccgctgacgccgggctaccacggcgacgagcaggcacctgcgtttctgcgcgcacaggccgatgcgatcggctacccggtgctgatcaaggccagcgccggcggcggcggcaagggcatgcgccgcgtggatgccagcgcagcattcgaagacgcgttggccagctgtcagcgcgaagcgcaatcggcgttcggcaatgcgcatgtgctggtggaaaaatacgtcgagcgcccacggcacatcgagatccaggtgttcgccgatacccatggcgcggtggtgcatctgttcgaacgcgactgctcggtgcaacgccgccatcagaaagtgctggacgaagcccccgcacccggcatgaccgaacagcgccgcgcggcgatgggcaaggcggcagtggatgccgcacgggcggtgggctacgtgggcgccggcacggtggaattcatcgccgggccggacggcgatttttatttcatggaaatgaacacccggctgcaggtggagcaccctgtcaccgagctgatcaccggcaccgatttggtggactggcagctgcgcgtggccgccggcctgccgctgcccaagcgccaggacgaattgcgcatccatggccatgccctggaagcgcgcctgtacgcagaagatgccgaccgcggcttcctgccttccaccggcaccttgcggcaactgcgcctgccggccgcgagcgcgcacgtgcgcatcgatgccggtgtggaacagggcgacaccatcagcccgtattacgacccgatgatcgccaagctgatcgtctgggatcacgaccgccccgccgcgctggcgcgcatgcgcgacgcattggcacactgccatgcgatcggggtgaccaccaacagcgcgttcctggcgcggctggtcagcacgcaggcgtttgcgactgccgacctggacactggcctgatcgaacgcgagcaggcggcgctgtttcccgcgccgcagccgccgcccatggcatggtggtgcctggccgcggtgctggtggccgaagccgcaccgcacgccgccgccgacccggccgacccgttctcgccatggcaactcgccgatggctggcgcatcggcgcacatgccgcgcgtacgctggtgctggaggccgcaggcgagcgccgcacactggcggtgcggcccaccgccgatggctggcaggtggacagtgccgatcaaacccacacgctgcgctatcacgcacacggcgagcacctgcgtgtggacatggatggccgccaatggcgcgcgcagatactgcgcgatggcactgccatcaccgtgctcagtggcgcgcagcgcgcgcatttccaacatcacgatgccctggtcgaagccgagcaaccggcgcaggccgaaggtggcctcaccgcacccatgccaggccgcgtggtcgcgctggttgcgccgctcggcgaaccggtccgccgtggccaggccctggtggtgctggaagccatgaagatggagcacaccctgcatgcgcctgccgacggcaccgtgcaggcctatctggtggccgaaggcgacctggtcgcagacggtgtcgcgttagtggaattcgtgtccgcgtctgcgtag

SEQ ID NO: 4989 - protein, 675 aa, Xanthomonas campestris
MPQHASITGKGQPYFDKVLIANRGEIACRVIATCRRLGIATVAVYSDADRDARHVRLADEAIHIGASPAQQSYLRGDAILAAARASDAQAIHPGYGFLSENAGFADACAQAGVVFIGPPAQAIRAMGDKSAAKALMQRAGVPLTPGYHGDEQAPAFLRAQADAIGYPVLIKASAGGGGKGMRRVDASAAFEDALASCQREAQSAFGNAHVLVEKYVERPRHIEIQVFADTHGAVVHLFERDCSVQRRHQKVLDEAPAPGMTEQRRAAMGKAAVDAARAVGYVGAGTVEFIAGPDGDFYFMEMNTRLQVEHPVTELITGTDLVDWQLRVAAGLPLPKRQDELRIHGHALEARLYAEDADRGFLPSTGTLRQLRLPAASAHVRIDAGVEQGDTISPYYDPMIAKLIVWDHDRPAALARMRDALAHCHAIGVTTNSAFLARLVSTQAFATADLDTGLIEREQAALFPAPQPPPMAWWCLAAVLVAEAAPHAAADPADPFSPWQLADGWRIGAHAARTLVLEAAGERRTLAVRPTADGWQVDSADQTHTLRYHAHGEHLRVDMDGRQWRAQILRDGTAITVLSGAQRAHFQHHDALVEAEQPAQAEGGLTAPMPGRVVALVAPLGEPVRRGQALVVLEAMKMEHTLHAPADGTVQAYLVAEGDLVADGVALVEFVSASA

SEQ ID NO: 4990 - DNA, 3648 bp, Xanthomonas axonopodis
  CDS (1)..(3648)
atgttcaagaaaatcctcatcgccaatcgtggggagatcgcggtgcgcatcgcgcgcacgctcaagaagatgggagtgacgtcggtcgcggtgtattccgacgctgaccatgacagcctgcacgtgagcgtcgccgacgaagctgtggcgttgaacagcggcggcagcagcagcgccgccgaaacctatttgcgtggcgatcgcatcctggagattgcccggaagaccggtgccggggccgtcatccccggttatggctttctgtccgaaaacaccacgttcgccgagcaatgtgcggaggccggcgtcgtcttcgtcggtcccacacccgagcaagtgcgccgctttggcctcaagcacaccgcgcgcgcgatcgccgaggccgctggcgtgccgctgacacctggcaccggcctgctgcaaagtctggacgatgcgaaagtcgctgcacagcacatcgggtatcccgtcatgctcaagagcacggccggcggcggtggcatcggtctctcgcgctgcgataacgcagccgaactggccacggcctacgattcggtacagcgccttggccagaacttcttcaaggacagcggcgtcttcatcgaaggcttcgttgccaatgcgcgccatgtcgaagtgcagatcttcggcgacggcaagggacgcgttgtggcgctgggcgagcgcgactgctcgctgcagcggcggcaccagaaggtggtcgaggaaacacctgcgccgcacctgccggacgcgacccgcgccgccttgctggacgccgccgtgaagctgggcgaagcggtgaactatgtctcggccggcacggtggaattcatctatgacgctgcgcgcgatgccttctactttcttgaggtcaacacgcgcctgcaggtcgagcatcccatcaccgaggcggtcaccgggctggatctggtggaatggatggtacgcattgccgctggcgagccgccatccttcgatgatctgcccacgccgcggggcactgccatcgaagtgcgcgtctatgccgagaaccccgtgcgcggctttcagcctgcgcccggcatactgaccgatgttcagttccccgaagacgtgcgcgtggacacatgggtgcagaccggcaccgaggtgtctgccaactacgacccactgatcgccaaggtcatcgcctacggggcgcaccgcgaggaagcccgccagaagttgctgatggcgctggagctgacgcgcctgcacggcagcgccaccaacctggactacctgcgcagcatcctgcaaagcagggaattttcggccgggacggtgtccactttgctgctggaccgctacgactatgtctcgcccgtggtcgaggtgctggaatcgggcacctacaccaccgtgcaggattaccctggacgtaccggatattgggacatcggcgtgccgccctccggaccgatggacgactacgcctttcgcctggccaaccgcatcgtcggcaaccacgagagcgctgccggcctggaatgcacgctgcaagggccgacactcaagttccatggcgatgcggtgatcgcgctcaccggcgcgccggcactggcgacactggacgacggtgaaccgctgccctggtggaagcccatcgcggtgcgcgccagccaggtgctgcgcatcgccaaggccagcagcggttgccgcagctacatcgcgatccggcgtggcatcgatgtgcctgagtacctgggcagcaaatccaccttcgtgctcggccagttcggcggccatgccgggcgcacgctgcgcgtgggcgacgtgctgcccatcagccggcccgagctggcggtctgcaccacgccagcgccggcctgcgtgccggccacgccaccgcacgaactggtgcccagctatggcaaacactgggacatcggcgtgctgtacggcccgcacggcgcgccggacttcttcagcgaagacagcatcgcccgctttttcacgaccgactaccaggtgcactacaactccaaccgcctgggcgtgcggctggtgggtcccaagcccaagtggacgcgcagcgacggcggcgaggccgggctgcacccatcgaatgtgcacgactgcgtgtatgccatcggcagcatcaacttcaccggcgatacgccggtgatcctgacctgcgatggccccagcctgggcggcttcgtgtgcccggcgaccatcgccaaggccgagctctggaaggtgggtcaggtcaagccgggcgacaccatccgcttcaggcgcatgggcttcgatgaagccctggcgctggagcaggcgcaggacaaggccatccgcctgctgcgcccgctgccggacctgtcagcgcgggatcttcccgctgcaccggcgacggtctcggaatgcgtgctggccgagctgcctgccgaaggccaacgcccggccgtggcctaccggcaggctggagacaagtacatcctgctcgaatacggccccaacgtgctggacctgcggctgcgcctgcgcgtccatctgctcatggaagcgctcaaggccgcgaagctggacggcgtgcatgagctttcgcccggcgtgcgctctgtgcaaattcactacgacagccgcgtcatcgcgcagtcggtgctggtcgaacgcctgatcgccttggaaacgcaattgcccggcgtggagggtcttcaggtcccgagccgcatcgtgcatctccccatggccttcgaggattcggccacgctgggtgcagtcacacgctacatcgagacggtgaaggccgacgccccctggctgcccaacaacgtggacttcatccagcgcattaacggcctgagccgccgcgaggatgttcgcacgacggttttcgaagccagttacatggtgatgggcctgggcgacgtgtacctgggcgcgccctgtgccgtgccgctggacccgcgccatcggctgctcacgtccaagtacaacccggcacgcaccttcacggctgaaggcacggtgggcattggcggcgtgtacatgtgcatctatggcatggactcgcccggcggctaccagctcgtgggccgtacggtgccgatctggaataagttcctgagaaaccgccagttcggcgcggagccctggctgctgcgcttcttcgaccgggtgcgcttctatccggtgaccgaggttgaactggatcagttccgggccgatttccgtgccggccgcacgcacatcaaagtcgaagatgccgtgtttgatctggccgagcacgagcggctgttagctcaagacgcaagcagtatcgaagcattccgggagcggcagcagaccgcctatgccactgaagtggcgctgtggcagaacgaccccaaggtcgaggcggtggaggatgccgaggaggcagtcatgcaggctgtcgacggaagcgcggtggtggccgacatgtggggcaatgtgtggaaggttcttgtcgacgtcgggcaggaagtccagatcggcgaaccgctggtgatcctggaagccatgaagatggagttccaggtagccgcaagtcaggcaggaacgatcgcggccttgcattgcaaggcgggcaagcctgtcgccgcgggagacgcgttggtggtgattcgaccgcaccctgtggctgcgactgtgccttacgcgtga

SEQ ID NO: 4991 - protein, 1215 aa, Xanthomonas axonopodis
MFKKILIANRGEIAVRIARTLKKMGVTSVAVYSDADHDSLHVSVADEAVALNSGGSSSAAETYLRGDRILEIARKTGAGAVIPGYGFLSENTTFAEQCAEAGVVFVGPTPEQVRRFGLKHTARAIAEAAGVPLTPGTGLLQSLDDAKVAAQHIGYPVMLKSTAGGGGIGLSRCDNAAELATAYDSVQRLGQNFFKDSGVFIEGFVANARHVEVQIFGDGKGRVVALGERDCSLQRRHQKVVEETPAPHLPDATRAALLDAAVKLGEAVNYVSAGTVEFIYDAARDAFYFLEVNTRLQVEHPITEAVTGLDLVEWMVRIAAGEPPSFDDLPTPRGTAIEVRVYAENPVRGFQPAPGILTDVQFPEDVRVDTWVQTGTEVSANYDPLIAKVIAYGAHREEARQKLLMALELTRLHGSATNLDYLRSILQSREFSAGTVSTLLLDRYDYVSPVVEVLESGTYTTVQDYPGRTGYWDIGVPPSGPMDDYAFRLANRIVGNHESAAGLECTLQGPTLKFHGDAVIALTGAPALATLDDGEPLPWWKPIAVRASQVLRIAKASSGCRSYIAIRRGIDVPEYLGSKSTFVLGQFGGHAGRTLRVGDVLPISRPELAVCTTPAPACVPATPPHELVPSYGKHWDIGVLYGPHGAPDFFSEDSIARFFTTDYQVHYNSNRLGVRLVGPKPKWTRSDGGEAGLHPSNVHDCVYAIGSINFTGDTPVILTCDGPSLGGFVCPATIAKAELWKVGQVKPGDTIRFRRMGFDEALALEQAQDKAIRLLRPLPDLSARDLPAAPATVSECVLAELPAEGQRPAVAYRQAGDKYILLEYGPNVLDLRLRLRVHLLMEALKAAKLDGVHELSPGVRSVQIHYDSRVIAQSVLVERLIALETQLPGVEGLQVPSRIVHLPMAFEDSATLGAVTRYIETVKADAPWLPNNVDFIQRINGLSRREDVRTTVFEASYMVMGLGDVYLGAPCAVPLDPRHRLLTSKYNPARTFTAEGTVGIGGVYMCIYGMDSPGGYQLVGRTVPIWNKFLRNRQFGAEPWLLRFFDRVRFYPVTEVELDQFRADFRAGRTHIKVEDAVFDLAEHERLLAQDASSIEAFRERQQTAYATEVALWQNDPKVEAVEDAEEAVMQAVDGSAVVADMWGNVWKVLVDVGQEVQIGEPLVILEAMKMEFQVAASQAGTIAALHCKAGKPVAAGDALVVIRPHPVAATVPYA

SEQ ID NO: 4992 - DNA, 2028 bp, Xanthomonas axonopodis
  CDS (1)..(2028)
atgacccagcgcgaccctatcgccgcagcaacgcaagcgcccttcgacaagatcctgatcgccaatcgcggcgagatcgcctgccgcgtcatcgccacctgccgcgccctgggcattgcgacggtggcggtgtactcggatgcagaccgcaatgcacggcatgtgcgcatggcggacgaggcagtgcatatcggcgccgcccccgcgcagcagagctatctgcgtggcgaagcgatcctacaagcagcacgcgccaccggtgcgcaggcgatccatcccggttatggcttcctgtcggaaaacgcggcatttgccgaggcctgcgcacatgctggcatcgtcttcatcggcccgccggcagcggcgattcgcgcgatgggcgacaagagtgcggccaaggcactgatgcaacgggccggcgtgccgctgacgccgggttaccacggtgacgaacaggcgccggcattcttgcgtgcgcaagccgatgcaatcggctatccggtgttgatcaaggccagtgctggcggtggcggcaagggcatgcgccgtgtggatgccagcgcagcgttcgacgacgcgttggccagttgccagcgtgaggcgcagtcggcattcggcaatgcgcacgtgctggtggaaaaatatgtccaacggccgcggcacatcgaaatccaggtgttcggcgatacgcatggcgaggtggtgtacctgttcgaacgcgactgctcggtgcagcgccgccaccagaaggtgctggaagaagcgccggcgcccggcatgagcgaggccaggcgcgccgcgatgggcagggcggcggtggatgcggcgcaggcggtgggctacgtgggtgccggtaccgtggaattcatcgccggcccggacggcgatttctatttcatggaaatgaacacccgtctgcaggtggagcacccggtgaccgaattgatcaccggcaccgatctggtcgagtggcaattgcgggttgccgcaggcgcgcgcttgccgcgcaggcagcacgagctgcgcatccacgggcatgcgctggaagcgcgcctgtacgccgaagatgccgagcgtggctttctaccctccaccggcacgctgcgtcagttgcagatgcctgctgccagtgcgcatgtgcgtgtggatgcgggcgtagagcaaggcgacaccatcagcccttattacgacccgatgatcgccaagctgatcgtctgggataccgatcgcccggccgcattggcacgcatgcgcgcggcgttggcgcaattccacgcgatcggtgtcaccaccaacagtgcatttctgtcgcgcctgatcgcgaccgactcgttcgcgtcggcgaatctggacaccgcgttgatcgagcgcgaacacgccgtgctgttcccagaggcgcgcagccccgacaacgcctggtggtgcctggcagcggtgttgattgccgatgcattgccggcagtggccgttgatccggccgatccgcattcgccgtggcagcacacggacggttggcgcatcggtgcgcatgcagcgcagcgcatcgtcctggaagcgaacggcgagcgccgccaactcgctgtgcgcccggatgccgatggctggcaagtcaccaacgcagaccagatgcataccttgcgctaccaccggcacgagacgggcttgcgtgtggagatggatggccggcaatggcgtgcacaggtgttgcgcgacggcgccacgctgaccctgatcggggccaggcaacgggccgtcttccgtcaccacgatgcactggcagaagccgaccagcctacccaggaggccggcggactgaccgcaccgatgcccgggcgcatcgtgtccctgcccgcaacagtgggccagccggtcgcccgtgggcaggcactggtggtgctggaagcgatgaaaatggagcacaccctgcacgcgcccagcgatggcaccgtgcaggcgtacctggtggctgagggcgatctggtggatgacggtgcggcgctggtggaatttgtgtccgcgtctgcgtag

SEQ ID NO: 4993 - protein, 675 aa, Xanthomonas axonopodis
MTQRDPIAAATQAPFDKILIANRGEIACRVIATCRALGIATVAVYSDADRNARHVRMADEAVHIGAAPAQQSYLRGEAILQAARATGAQAIHPGYGFLSENAAFAEACAHAGIVFIGPPAAAIRAMGDKSAAKALMQRAGVPLTPGYHGDEQAPAFLRAQADAIGYPVLIKASAGGGGKGMRRVDASAAFDDALASCQREAQSAFGNAHVLVEKYVQRPRHIEIQVFGDTHGEVVYLFERDCSVQRRHQKVLEEAPAPGMSEARRAAMGRAAVDAAQAVGYVGAGTVEFIAGPDGDFYFMEMNTRLQVEHPVTELITGTDLVEWQLRVAAGARLPRRQHELRIHGHALEARLYAEDAERGFLPSTGTLRQLQMPAASAHVRVDAGVEQGDTISPYYDPMIAKLIVWDTDRPAALARMRAALAQFHAIGVTTNSAFLSRLIATDSFASANLDTALIEREHAVLFPEARSPDNAWWCLAAVLIADALPAVAVDPADPHSPWQHTDGWRIGAHAAQRIVLEANGERRQLAVRPDADGWQVTNADQMHTLRYHRHETGLRVEMDGRQWRAQVLRDGATLTLIGARQRAVFRHHDALAEADQPTQEAGGLTAPMPGRIVSLPATVGQPVARGQALVVLEAMKMEHTLHAPSDGTVQAYLVAEGDLVDDGAALVEFVSASA

SEQ ID NO: 4994 - DNA, 1494 bp, Methanosarcina mazei
  CDS (1)..(1494)
atggaaggtatcatgttcaaaaaagtactcgttgcaaaccgcggtgaaatagcaatcagggttatgcgtgcctgcagggagctcgggatttcaacagttgctgtctgttccgaggctgacaaaagcgccctttttgccaagtatgctgatgaagcctatctgatagggcctgccccttcaagccagagctacctgaatatggaagctatcattgaggttgcaaaaaacaccggagctgaggcaatccaccccggctacggttttctttccgaaaaccctgcttttgcaaagcgctgtgaggaagaaggcattattttcataggccctccaagcaatgtaattgccgaaatgggaagcaaaatcagagcaaggcacctcatgatgaaagccggagtccctgtagttcccggaacaaaggacgcagttgaggaccctgaagaagccatggaaattgcagaaaagatcggctatcctgtccttatcaaagcgtctgccggaggcggtggaatagggatgaaggttgtccactccagggaagagcttgccacatccttaagctctacaaggcagatggcaggttccgctttcggggattcttccgtatttatcgaaaagtacgtggaagagccaaggcatatagagatccagatccttgctgactctcatggtaatatggtctacctctcagacagggaatgctcaatccagagaaggcaccagaagctgattgaagaagctccttcccctataatgactccggaactcaggaagcagatgggggaggctgccgtaaaggttgcaaaagcaattggttatgtaaacgcagggaccgtcgagttcctttactctaaagggaatttctatttccttgaagtcaatactcgccttcaggtggaacatggaattaccgaaatggtaaccggaattgatattgtcagggaacagatcaggatcgcctggggagacaaactcgattttgaacaggaagatatagttattgacgggcatgcaatcgaatgcagaataaatgccgaagatcccctgaatgattttgctccttcccctggaaagatccggaggtaccgttctgcaggagggcccggagtaagggtggacagcggagttcatacaggctatacaatctctccttattatgactccatgatttccaagctctgtgtctggtccagaaaaagagaagaggctatcgccaggatggacagggcactctacgagtatgtggtcgttggagtaaaaaccaatatccctttccataaagctgttatgaggaaccctgcattccgcagaggcgacatgacaaccagctttatcgaagaggagaatatccttgaggctgtggaacacgtcgttaaggctgacagtgagaaaggtgctactctggcttcggcccttgaggctaaggacaagaaagttgcagcaatcacggccgctgtacatgcctatgttaacatggcccagaaaacacagcggtga

SEQ ID NO: 4995 - protein, 497 aa, Methanosarcina mazei
MEGIMFKKVLVANRGEIAIRVMRACRELGISTVAVCSEADKSALFAKYADEAYLIGPAPSSQSYLNMEAIIEVAKNTGAEAIHPGYGFLSENPAFAKRCEEEGIIFIGPPSNVIAEMGSKIRARHLMMKAGVPVVPGTKDAVEDPEEAMEIAEKIGYPVLIKASAGGGGIGMKVVHSREELATSLSSTRQMAGSAFGDSSVFIEKYVEEPRHIEIQILADSHGNMVYLSDRECSIQRRHQKLIEEAPSPIMTPELRKQMGEAAVKVAKAIGYVNAGTVEFLYSKGNFYFLEVNTRLQVEHGITEMVTGIDIVREQIRIAWGDKLDFEQEDIVIDGHAIECRINAEDPLNDFAPSPGKIRRYRSAGGPGVRVDSGVHTGYTISPYYDSMISKLCVWSRKREEAIARMDRALYEYVVVGVKTNIPFHKAVMRNPAFRRGDMTTSFIEEENILEAVEHVVKADSEKGATLASALEAKDKKVAAITAAVHAYVNMAQKTQR

SEQ ID NO: 4996 - DNA, 1897 bp, Amycolatopsis mediterranei
  CDS (101)..(1897)
ttcacctctcactcaagagactcccgacgtcatatccgtagacttccctgatgccgcgtgggcggtcagcaatgcagctgtcggacgcaggaggtgcgggatggccgagcaggtcggcgaaaccacgggtggtccggtgaccaagatcctggtcgccaaccgtggcgaaatcgcggtacgcgtcatcagagccgcgaaggacgctggcctggccagtgtcgcggtgtacgccgacccggatcgcgacgcgccacacgtccggctggccgacgaagccttcgcgctgggcggcacgacggcggccgaaagctacctgaacttcgacaagctcctggacgccgccaagcgctcgggcgccgactcggtgcacccgggttacggcttcctctccgagaatgcggacttcgcccaagccgtcctcgacgccgggctgacctggatcgggccgagcccgcaggccatccgcgacctcggcgacaaggtcaccgcccgccacatcgccatgcgcgcgggcgcgccgctggtgccgggcaccaaggagccggtcaaggacgcctccgaaatcgtcgcgttcgccgacgagcacgggctgccggtggccatcaagaccgcgttcggcggtggtggccgcggcctcaaggtcgcgcgcacccgcgaagagatccccgagctgttcgagtcggccacgcgcgaggcggtcgccgcgttcggccgcggcgagtgcttcgtcgagcgctacctggacaagccgcgccacgtcaaggcgcaggtgctggcggacatgcacggcaccgcgatcgtcgtcggcacccgcgactgctcgctgcagcgacggcaccagaagctcgtcgaagaggcgcccgcgccgttcctgaacgacgagcagcgcaagcgcatccacgagtccgcgaaggcgatctgcaaggaagccggctactacggcgccggcacggtcgagtacctcgtcgccaccgacggcacgatctccttcctcgaggtcaacacgcggctgcaggtcgagcacccggtgtcggaagagacgaccggtctcgacctcgtccgggagatgttccggatcgcccgtggcgagaagctgcggatcaccgaggatcccgagccgcgcggccactcgatcgagttccgcatcaacggcgaggacgccggccgcggcttcctgcccgcgccgggcacggtgacgaagttcgtcgcgccgagcggcccgggcgtgcgcgtcgactccggcgtcgaatccggcagcgtcatcggcgggcagttcgactcgatgctggccaagctgatcgtcaccggctcggaccggaacaacgccctcgaacgcagccgccgcgccctggccgagatggtcgtcgaaggcatggccacggtgctgccgttcgaccgcgtgatcgtcgacgacccggcgttcatcggcgacgagaacggcttcagcgtgcacacgcgctggatcgagacggagttcgacaacaagatcgagccgttcgtggcgcccgacatcgaggccaccgaggaagagccgcggcagaacgtcgtggtcgaggtcggcggccggcggctcgaggtgtcgctgccgggcgggttcgcgctcgaaggtggcggcggtcgcggtggcggggtcactgtcaagcgaagccccgcaagcgcgccgcggcaccaaggccgcggtgagcggcgagccgtcacggcgccgatgcagggcacgatcgtgaaggtggccgtcgaagagggccagacggtggaagccggtgagctgatcgtcgtcctcgaggcgatgaagatggaaaacccggtcaccgcacacaaagcgggcaccgtcaccgggctttcggtcgaggtcgcggccgccgtgacgcagggcacgcagcttctcgagatcaagtag

SEQ ID NO: 4997 - protein, 598 aa, Amycolatopsis mediterranei
MAEQVGETTGGPVTKILVANRGEIAVRVIRAAKDAGLASVAVYADPDRDAPHVRLADEAFALGGTTAAESYLNFDKLLDAAKRSGADSVHPGYGFLSENADFAQAVLDAGLTWIGPSPQAIRDLGDKVTARHIAMRAGAPLVPGTKEPVKDASEIVAFADEHGLPVAIKTAFGGGGRGLKVARTREEIPELFESATREAVAAFGRGECFVERYLDKPRHVKAQVLADMHGTAIVVGTRDCSLQRRHQKLVEEAPAPFLNDEQRKRIHESAKAICKEAGYYGAGTVEYLVATDGTISFLEVNTRLQVEHPVSEETTGLDLVREMFRIARGEKLRITEDPEPRGHSIEFRINGEDAGRGFLPAPGTVTKFVAPSGPGVRVDSGVESGSVIGGQFDSMLAKLIVTGSDRNNALERSRRALAEMVVEGMATVLPFDRVIVDDPAFIGDENGFSVHTRWIETEFDNKIEPFVAPDIEATEEEPRQNVVVEVGGRRLEVSLPGGFALEGGGGRGGGVTVKRSPASAPRHQGRGERRAVTAPMQGTIVKVAVEEGQTVEAGELIVVLEAMKMENPVTAHKAGTVTGLSVEVAAAVTQGTQLLEIK

SEQ ID NO: 4998 - DNA, 2381 bp, Corynebacterium efficiens
  CDS (577)..(2352)
agcaggccgtgttgccgaacggcaacttccgcagccgcaaggagatcgaggaggtgtactcgcacctcaaccctgccgaggacaccgtggtgtactgccgcgtgggtgaccgcgcggcccacacctggttcgtgttgaagtacctgctggggtttgaaaacgtccgcaactatgacggttcctggtccgagtggggcaacatggtgcgcatgcccatcgtccagggtgatgagccgggctcactctagtcaccccggggtcacctccctggtcacccccgtaccctcccgggtacaccccggggacggggtgtgacctggatctcccctgcatgtggacaccgggaaactttgcctgggaaatgaccatccagtaccgtaatgcgggtatgttaacgcggtcacagggtacaccagaatccggatcgtctaacccccttagcgggattcgctaaaagatcaccgagttagtgtgcaagaataatgctgatcgcaggggcactgtcatacgctgtcatgcagtcaatgaacagtgcggtgctctgtcgtgaagaaaatcaaaaccaggagggttttaatgtcagtcgagaccaggaagatcaccaaggtacttgtcgccaaccgtggtgaaatcgcaatccgtgttttccgcgcagcacgggatgaaggcatcgcctctgtcgccgtctacgcggagccggacgcagatgcccctttcgtcgagtatgccgatgaggccttcgcactcggtggccagacttccgcagagtcctacctcgtcattgacaagatcattgacgcagcacgcaagtccggtgcagacgctgtccaccccggctacggcttcctcgccgagaacgccgatttcgctgaagctgtcatcaacgagggcctgatctggatcggaccatcccctgagtccatccgttccctcggtgacaaggtcaccgcacgccacatcgccaacaacgccaacgcaccgatggcaccgggcaccaaggagcctgtcaaggacgccgctgaggttgtcgccttcgccgaggagttcggtctccccatcgccatcaaggctgccttcggtggcggcggacgtggcatgaaggtcgcctacgagatggacgaggtcgccgacctcttcgaatccgccacccgtgaggccaccgccgccttcggtcgtggtgagtgcttcgtggagcgctacctggacaaggcccgccacgtcgaggcacaggtcatcgccgacaagcacggcaacgttgtggtcgccggtacccgtgactgctccctgcagcgtcgtttccagaagctcgtcgaggaggcaccggcaccgttcctcaccgatgagcagcgtgaccgcatccactcctccgccaaggctatctgccgcgaggccggttactacggtgccggcaccgtggagtacctggtcggttccgacggactgatctccttcctggaggtcaacacccgcctgcaggtggagcaccccgtcaccgaggagaccaccggcatcgacctggtgcgcgagatgttccgcatcgccgagggcgccgagctctccatcaaggaggacccgaccccacgcggccacgccttcgagttccgcatcaacggcgaggacgcaggctccaacttcatgcccgcaccgggcaagatcacccgctaccgtgagcccgccggcccgggtgtccgcatggactccggcgttgtcgagggttccgagatctccggccagttcgactccatgctggccaagctgatcgtctggggccagacccgtgagcaggccctggagcgttcccgtcgtgcgctcggcgagtacatcgtcgagggcatgccgaccgtcatcccgttccactcccacatcgtctccaacccggcattcgtcggtgacggcgagggcttcgaggtctacaccaagtggatcgaggaggtctgggacaacccgatcgagccgttcgtcgatgcagccgacctcgacgacgaggagaagaccccgtcgcagaaggtcatcgtcgagatcgacggccgccgcgtcgaggtggctctcccgggcgacctcgctctcggcggtggcgcaggtgccgccaagaagaagccgaagaagcgtcgcgcaggtggcgccaaggccggtgtctccggtgactccgtcgcagccccgatgcagggcaccgtcatcaaggtcaacgttgaggacggcgccgaggtctccgagggtgacaccgtcgtggttctcgaggccatgaagatggagaacccggtcaaggcccacaagtccggtaccgtctccggtctgaccatcgccgcgggtgagggcgtgaccaagggtcaggttctcctggagatcaagtaatcccttcagggaacagacagccctgttct

SEQ ID NO: 4999 - protein, 591 aa, Corynebacterium efficiens
MSVETRKITKVLVANRGEIAIRVFRAARDEGIASVAVYAEPDADAPFVEYADEAFALGGQTSAESYLVIDKIIDAARKSGADAVHPGYGFLAENADFAEAVINEGLIWIGPSPESIRSLGDKVTARHIANNANAPMAPGTKEPVKDAAEVVAFAEEFGLPIAIKAAFGGGGRGMKVAYEMDEVADLFESATREATAAFGRGECFVERYLDKARHVEAQVIADKHGNVVVAGTRDCSLQRRFQKLVEEAPAPFLTDEQRDRIHSSAKAICREAGYYGAGTVEYLVGSDGLISFLEVNTRLQVEHPVTEETTGIDLVREMFRIAEGAELSIKEDPTPRGHAFEFRINGEDAGSNFMPAPGKITRYREPAGPGVRMDSGVVEGSEISGQFDSMLAKLIVWGQTREQALERSRRALGEYIVEGMPTVIPFHSHIVSNPAFVGDGEGFEVYTKWIEEVWDNPIEPFVDAADLDDEEKTPSQKVIVEIDGRRVEVALPGDLALGGGAGAAKKKPKKRRAGGAKAGVSGDSVAAPMQGTVIKVNVEDGAEVSEGDTVVVLEAMKMENPVKAHKSGTVSGLTIAAGEGVTKGQVLLEIK

SEQ ID NO: 5000 - DNA, 7223 bp, Oryza sativa
  CDS (1)..(6804)
atggagggatcttaccaaatgaatggcatactgaacgggatgtctaattcgaggcatccgtcgtcaccctctgaggtcgatgagttctgcaaagcgctcggtggtgattcaccgatacacagtgtgctggttgccaacaatggcatggccgctgtcaagttcatgcgcagcatccgtacatgggcgctggagacctttgggacggagaaggcgattcttttggtcgccatggcaactcccgaggacttgaagataaacgcggagcacataaggatcgccgaccaattcgtagaagttcctggtggtacaaataataacaattatgcgaatgtacagctcatagtggagatagcagagagaacacatgtttctgcagtttggcctggctggggtcatgcatctgagaatcctgaacttccggacgcactgaaggagaaaggaataatttttcttgggccaccatcagccgcgatggcagcgctaggtgataagattggttcatctcttattgcacaagcagcaggagttccaactcttccatggagtggatcacatgtgaaaattccaccagaaagctgcaattcgatacctgaggagatgtacaggagtgcctgtgtctccactacagaggaagcagtagctagttgtcaggtggtgggatatcctgctatgatcaaggcatcatggggtggtggtggtaaaggaataaggaaggtacataatgatgatgaggtgagagcactgtttaagcaagttcagggagaagtccctggctcacctatatttattatgaaggtggcatctcagagccgacatctagaggttcagttgctctgtgacaaacatggcaatgtggcagctctgcacagtcgagactgtagtgttcaaagaaggcaccaaaagattattgaggaggggccaattacagttgctccttcagagacagttaaagagcttgagcaagcagcaaggcggcttgctaaatgtgtgcattatgtgggtgctgctacagtagaatatttgtacagcatggaaacaggagaatactattttctggagcttaatccacggttgcaagtagaacaccctgttaccgaatggatagctgaaataaacttgcctgcagctcaagttgttgtaggaatgggtgtgccgctctacaatattcctgagatcagacgcttttatggaatggagcatggtggtggttacgatgcgtggaggaaaatatcagctgttgcaactaagtttgatttggataatgcacagtctgtaaagccaaagggtcactgtgtagcagtcagagttaccagtgaggatccagatgatggatttaagcctactagtggaagagttgaggagctaaactttaaaagcaaaccaaatgtttgggcctatttctccgttaagtctgggggagcaattcatgaattttcagattctcaatttggacatgtgtttgcattcggggaatctagatcgttggcaatagcaaatatggtgcttgggttaaaagagatccaaatccgtggagagatacgcactaatgttgattacacagtggatctcttgaatgctgcagaatatcgggaaaataagatccacactggttggctagacagcagaattgctatgcgtgttagagctgagaggcccccatggtacctttcagttgttggaggagctctatatgaagcatcaagcaggagctcaagcgttgttacagattatgttggttatctcagcaaaggtcaaataccaccaaagcacatctctcttgttaatttgactgttaccctaaatattgagggaagcaaatacacgattgagacagtaagacgtgggccccgtagctacacattaagaatgaatgggtcagagattgaagcagagatacactcgttgcgagatggaggactcttgatgcaattggatggaaacagtcatgtaatttatgcggagacagaagctgctggtacacgccttctcatcaatgggagaacatgcttattacagaaagagcatgatccttccaaattgttggctgatacaccttgcaaacttcttcggttcttggttgcggatggctctcatgtagatgctgatacaccatatgctgaggttgaggtcatgaagatgtgtatgccgctgttactaccagcttctggtgttattcattttgtcatgcctgagggtcaagccatgcaggcggctgacctgatagcaaggttggaccttgatgacccctcttctgtgaggagagctgaaccattccatggcacctttccaaaactgggacctccaactgctgtttctggaaaagttcaccaaaagtttgctgcaagtgtcaattccgcacacatgatccttgcaggatatgaacataatatcaatgaagttgtacaagatttgttaaactgcttagatagccctgagcttccttttctacagtggcaagaacttatgtctgttttggcaactcggcttccgaaagatctcaggaatgagttggatggcaagtacaaggagtatgagttgaactctgattttcggaagaacaaggattttcctgccaagttactaaggggaattatagaggcaaatcttgcatactgttctgaaaaagatagagttactaatgagaggcttgttgagccacttatgagcctggtcaaatcatacgagggtgggagagaaagccacgctcgtgttgttgtcaagtctctatttgaggagtacctgtctgttgaggaactcttcagtgacaatattcagtctgatgtgatagaacgtctacgacttcaacatgccaaagacctcgagaaggtcgtatacattgttttctcccaccagggtgtgcggaccaaaaataaactcatactacggcttatggaagcattagtctatccaaatccatctgcttacagagaccagttgattcgtttctctgggctgaacaacacagtgtactctgagttggcacttaaagcaagccagcttcttgagcatactaaattgagtgaactccgcacaagcatagcaagaagcctctcagagctggagatgtttactgaagaaggagagcgggtgtcaacacccaggagaaagatggccattaatgagaggatggaagatttagtgggtgccccacttgcagttgaagatgcccttgtggctttgtttgatcacagtgatcctacacttcagcggagagtggtcgagacatacatacgtagattgtatcagccttatctggtcaagggcagtgttcggatgcagtggcatagatctggtctaattgctttatgggaattctcggaagagcatattaagcaaagaaatggacaagatgcgatgtctctaaagcagcaagttgaggaccccgaagagaaaagatggggtgtcatggttgtaatcaagtctctccagtatttatctagtgctattgatgctgcattgaaggagacttcacactacaaagcaggtgctggaaatgtctcgaatggcaattctgcaagttccagccatggcaatatgctgcatattgctttggttggtatcaacaatcagatgagcactcttcaagacagtggtgatgaggaccaggctcaagaaaggatcaacaaaatttcaaaaattttgaaggatagtactgtaacatcacatctcaatggtgctggcgttagggtagtcagctgcattatccaaagggatgaagggcgcccaccgatgcgtcactccttccaatggtcagttgataagatatattatgaagaggatccgatgctccgccatgttgaacctcctctatctacattccttgagttgaacaaggtgaatttggatggttacaatgaagtaaagtacactccatcacgcgatcgccagtggcatatttacacactcatcaagaacaagaaagatcagagatcaaatgaccagaggttgttccttcgtaccatagtaaggcaaccaggtgtgaccaatgggtttttgtcaggaaatgttgacaatgaagtaggccgtgctcaggcttcatcatcatacacatcaagtagtatactcagatcactgatggcagcactagaagaaatagagctacatgcacataatgagacagtgaggtcaagctattcacacatgtatctgtgcatattgagagtacaacagttgtttgatcttataccattttcaagaacgattgataatgttggtcaagatgaagcaactgcatgtacgcttttgaagaatatggctttgaatatatatgaacatgttggggtgaggatgcatcgcctttctgtgtgtcagtgggaagtgaagttatggttggattgtgatggacaagcaagcggtgcttggagagtagttgttaccaatgtaactggccacacctgcactgtcgatatttaccgagaagtggaggattctaatacacataaacttttctaccactctgttacaccatcactgggtcctttgcatggcattgtgttggatgaaccatacaagccattggatgctattgacctcaaacgttactctgctaggaagaacgaaactacgtactgctatgacttcccgctggcttttgaaacagcactgaagaggtcatggaaatcaaccctctctgttgttgctgaagctaatgagcataataagagctatgctaaagtgacagagcttatgtttgctgattcaactggatcatggggtactcctttggttccagttgagcgttctccaggtatcaatgatattggcattgtcgcttggatcatgaagctctccacaccagaatttccaagtggccgggagattattgttgtttcaaatgatgtgacatttaaagctggatcatttggtcctagggaagatgctttctttgatgcggtcaccaatcttgcttgtgagaggaaacttcctcttatctacttgtcagcaactgctggtgctaggctcggtgtagctgaggaaataaaagcatgcttcaatgttggttggtctgatgacgagagccctgaacgtggttttcattacatttacctcactgaacaagattattcgcgcctgagttcttcggttatagcccatgaactgaaactagaaagtggagaaactagatgggttgttgataccattgttggaaaagaggatggactcggttgtgagaacttgcatggaagtggtgccattgccagtgcctattctaaagcatacaaggagacctttactctgacattcgtaactggacgagctgttggaattggtgcttatcttgctcggttaggcatgaggtgtatacagcgtcttgatcagccaattattttgacaggattttctgcgctgaataagcttctggggcgggaggtatacagctctcacatgcaactaggtggccccaaaatcatggctacaaatggtgtcgtccatctgactgtgtcagatgaccttgaaggtgtttctgcaatcttgaaatggctcagctatgttcctccttatgttggtggtcctcttcctatcatgaagcctcttgacccaccggatagacctgtaacatacttccctgagaattcatgtgatgctcgtgcagctatctgcggtgtgcaggacagtcaaggcaagtggatgggtggtatgtttgacagagaaagcttcgtggagacattagaaggctgggcaaaaactgttgtcaccggaagagcaaagcttggtggaattccagttggtgtcatagctgtggaaacccagactatgatgcaagtcatccctgctgatccaggtcagcttgattctgccgagcgtgtggttcctcaagcagggcaggtgtggtttcctgattctgccaccaaaacagcccaggcattgctggatttcaaccgtgaagagcttccgctgttcatcctcgctaactggagaggcttttctggtgggcaaagggatctgtttgaaggaatccttcaggctggttctaatattgttgagaatctgaggacatataaccagcctgcttttgtgtatattccaatgggcggagagcttaggggaggtgcatgggttgtggtagatagcaaaatcaatccagaacacattgagatgtatgctgagagaactgcaaaaggtaatgtccttgaaccagaaggattggttgagatcaaattcaggccaaaggaactggaagaatgcatgctaaggcttgacccggagttgatcaagctgagtacaaggctgagagaaatgaagaaggaaaatgctggcctctcggaaatggacaccactaggaggagtattattgctcggatgaagcaactgatgcctatatatacccaggttgctacacggtttgctgaattgcatgacacctctgctagaatggctgccaaaggtgtgatcggaaaggttgtcgattgggaagaatctcggtcctttttctataggaggttgcgaaggagagttactgaagatgcacttgccaaggaaatcagagaagctgctggcgagcagctgtcccagaaatctgcattggactatatcaagaaatggtacctttcttccaatggatctgatggaaacagtgaaaagtggaataacgatgaagctttctttgcttggaaagatgatccaacaaactatgagaatcaactcgaggagttgaaggctgaaagagtatccaagtggctctcgcgtctcgctgaaagccctgatgtgaaagctttgccaaatggtctttcaattgttcttaacaagatgaatccttcaaagagggagcaggttattgatggtctcaggcagcttctgggttgaccaatgtgaattttgatatccagcatgaaccaaacagaatcatactcaaacgctaacactgaagtttaattgggctatcattgatgcaatggaagaggttttttgcacataaaatgggaggttttgagatggcatctcaagaaccatatacatacaaggatatgattgggcctctgccctactggatgtttggtgtgagttcttgcaaagagcagaataaagagcaatgcaaagattagtcaggcacggaatgttgttccatttgtagtgatgtatttagatgttttttactagcattttttttcttggcctgcctcatgccaatgtcatatagatacgatggaattcttgatcaagtaattgtttatttattttccaatccaaataatacatagcaatcctcatcttctagtgttcta

SEQ ID NO: 5001 - protein, 2267 aa, Oryza sativa
MEGSYQMNGILNGMSNSRHPSSPSEVDEFCKALGGDSPIHSVLVANNGMAAVKFMRSIRTWALETFGTEKAILLVAMATPEDLKINAEHIRIADQFVEVPGGTNNNNYANVQLIVEIAERTHVSAVWPGWGHASENPELPDALKEKGIIFLGPPSAAMAALGDKIGSSLIAQAAGVPTLPWSGSHVKIPPESCNSIPEEMYRSACVSTTEEAVASCQVVGYPAMIKASWGGGGKGIRKVHNDDEVRALFKQVQGEVPGSPIFIMKVASQSRHLEVQLLCDKHGNVAALHSRDCSVQRRHQKIIEEGPITVAPSETVKELEQAARRLAKCVHYVGAATVEYLYSMETGEYYFLELNPRLQVEHPVTEWIAEINLPAAQVVVGMGVPLYNIPEIRRFYGMEHGGGYDAWRKISAVATKFDLDNAQSVKPKGHCVAVRVTSEDPDDGFKPTSGRVEELNFKSKPNVWAYFSVKSGGAIHEFSDSQFGHVFAFGESRSLAIANMVLGLKEIQIRGEIRTNVDYTVDLLNAAEYRENKIHTGWLDSRIAMRVRAERPPWYLSVVGGALYEASSRSSSVVTDYVGYLSKGQIPPKHISLVNLTVTLNIEGSKYTIETVRRGPRSYTLRMNGSEIEAEIHSLRDGGLLMQLDGNSHVIYAETEAAGTRLLINGRTCLLQKEHDPSKLLADTPCKLLRFLVADGSHVDADTPYAEVEVMKMCMPLLLPASGVIHFVMPEGQAMQAADLIARLDLDDPSSVRRAEPFHGTFPKLGPPTAVSGKVHQKFAASVNSAHMILAGYEHNINEVVQDLLNCLDSPELPFLQWQELMSVLATRLPKDLRNELDGKYKEYELNSDFRKNKDFPAKLLRGIIEANLAYCSEKDRVTNERLVEPLMSLVKSYEGGRESHARVVVKSLFEEYLSVEELFSDNIQSDVIERLRLQHAKDLEKVVYIVFSHQGVRTKNKLILRLMEALVYPNPSAYRDQLIRFSGLNNTVYSELALKASQLLEHTKLSELRTSIARSLSELEMFTEEGERVSTPRRKMAINERMEDLVGAPLAVEDALVALFDHSDPTLQRRVVETYIRRLYQPYLVKGSVRMQWHRSGLIALWEFSEEHIKQRNGQDAMSLKQQVEDPEEKRWGVMVVIKSLQYLSSAIDAALKETSHYKAGAGNVSNGNSASSSHGNMLHIALVGINNQMSTLQDSGDEDQAQERINKISKILKDSTVTSHLNGAGVRVVSCIIQRDEGRPPMRHSFQWSVDKIYYEEDPMLRHVEPPLSTFLELNKVNLDGYNEVKYTPSRDRQWHIYTLIKNKKDQRSNDQRLFLRTIVRQPGVTNGFLSGNVDNEVGRAQASSSYTSSSILRSLMAALEEIELHAHNETVRSSYSHMYLCILRVQQLFDLIPFSRTIDNVGQDEATACTLLKNMALNIYEHVGVRMHRLSVCQWEVKLWLDCDGQASGAWRVVVTNVTGHTCTVDIYREVEDSNTHKLFYHSVTPSLGPLHGIVLDEPYKPLDAIDLKRYSARKNETTYCYDFPLAFETALKRSWKSTLSVVAEANEHNKSYAKVTELMFADSTGSWGTPLVPVERSPGINDIGIVAWIMKLSTPEFPSGREIIVVSNDVTFKAGSFGPREDAFFDAVTNLACERKLPLIYLSATAGARLGVAEEIKACFNVGWSDDESPERGFHYIYLTEQDYSRLSSSVIAHELKLESGETRWVVDTIVGKEDGLGCENLHGSGAIASAYSKAYKETFTLTFVTGRAVGIGAYLARLGMRCIQRLDQPIILTGFSALNKLLGREVYSSHMQLGGPKIMATNGVVHLTVSDDLEGVSAILKWLSYVPPYVGGPLPIMKPLDPPDRPVTYFPENSCDARAAICGVQDSQGKWMGGMFDRESFVETLEGWAKTVVTGRAKLGGIPVGVIAVETQTMMQVIPADPGQLDSAERVVPQAGQVWFPDSATKTAQALLDFNREELPLFILANWRGFSGGQRDLFEGILQAGSNIVENLRTYNQPAFVYIPMGGELRGGAWVVVDSKINPEHIEMYAERTAKGNVLEPEGLVEIKFRPKELEECMLRLDPELIKLSTRLREMKKENAGLSEMDTTRRSIIARMKQLMPIYTQVATRFAELHDTSARMAAKGVIGKVVDWEESRSFFYRRLRRRVTEDALAKEIREAAGEQLSQKSALDYIKKWYLSSNGSDGNSEKWNNDEAFFAWKDDPTNYENQLEELKAERVSKWLSRLAESPDVKALPNGLSIVLNKMNPSKREQVIDGLRQLLG

SEQ ID NO: 5002 - DNA, 1482 bp, Methanosarcina acetivorans
  CDS (1)..(1482)
atgttcaaaaaagtactagttgcaaatcgcggtgaaattgcaatcagggtcatgcgtgcctgcagagagctcggaatttccacagtcgctgtctgttcggaggctgataaaaatgccctctttgccaagtatgccgatgaggcctatctgataggccccgccccttccagccagagttacctgaacatggaagctatcattgcagttgcaaaaaataccggatccgaggcaatccatccaggctatggttttctttctgaaaatcctgcctttgcaaaacgttgcgaggaagagggtatcatcttcatcgggcctccgagtcatgtgattgctgaaatgggaagtaaaatcagggcaagaaatctgatgatgaaggccggggttcccgtagttccgggcacaaaagatgcagttgaggacgtaaacgaagctcttgaaatcgctgagaaaataggttatcccgtccttatcaaggcatctgcgggcggcggcgggatagggatgaaagtcgtgcattccatagaagaactttccacttccctgagttccacgcagcagatggcaggttcggctttcggagattcttcggtgtttattgaaaaatacgtggaagaacccaggcacatagagatccagatccttgctgacgcttctgggaataccgtttatctctcggacagggaatgttctatccagaggaggcaccagaagctgatcgaagaggctccttcccctatcatgactcccgaactcaggaagcagatgggagaagctgccgtaaaggttgcaaaagctatcggttacataaatgcaggaaccgttgagttcctctactctaaaggcaatttctatttccttgaagtcaatacccgtctgcaggtggagcacggaatcaccgaaatgatcacagggattgatattgtgagggaacagctcagtattgcctggggtgagaagctcgagtttgatcaggaagatatagttattgatgggcatgcaatcgaatgcagaatcaatgctgaagatcccttaaacgactttgccccatctccgggaaagatccggaggtaccgttcggcgggagggcccggagtaagggtggacagtggtgtgcacaccgggtatacaatctctccatattacgactccatgatttccaagctctgcgtctggtcaagaaaaagagaggatgccattgccaggatggaaagggctctttacgaatatgtggtcgtaggagtaaaaaccaatatccccttccataaagctgtcatgaggaacccggcattccgcaggggagacctgacaaccggatttatcgaagagcaggatatccttgaggctgtggaagatgtcgttaaggctgacagtgaaaaaggggctactctggcttcggctctggaggcaaaggataaaaaggtcgcagcgatcacggctgccgtacatgcctatgttaacatggcacagaaaacacagcggtga

SEQ ID NO: 5003 - protein, 493 aa, Methanosarcina acetivorans
MFKKVLVANRGEIAIRVMRACRELGISTVAVCSEADKNALFAKYADEAYLIGPAPSSQSYLNMEAIIAVAKNTGSEAIHPGYGFLSENPAFAKRCEEEGIIFIGPPSHVIAEMGSKIRARNLMMKAGVPVVPGTKDAVEDVNEALEIAEKIGYPVLIKASAGGGGIGMKVVHSIEELSTSLSSTQQMAGSAFGDSSVFIEKYVEEPRHIEIQILADASGNTVYLSDRECSIQRRHQKLIEEAPSPIMTPELRKQMGEAAVKVAKAIGYINAGTVEFLYSKGNFYFLEVNTRLQVEHGITEMITGIDIVREQLSIAWGEKLEFDQEDIVIDGHAIECRINAEDPLNDFAPSPGKIRRYRSAGGPGVRVDSGVHTGYTISPYYDSMISKLCVWSRKREDAIARMERALYEYVVVGVKTNIPFHKAVMRNPAFRRGDLTTGFIEEQDILEAVEDVVKADSEKGATLASALEAKDKKVAAITAAVHAYVNMAQKTQR

SEQ ID NO: 5004 - DNA, 2511 bp, Homo sapiens
  CDS (47)..(2233)
accggaccggaattcccgggtcgacgatttcgttgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtctaaaaaaaaaaaa

SEQ ID NO: 5005 - protein, 728 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 5006 - DNA, 4190 bp, Pichia angusta
  CDS (275)..(3802)
cgctctagaatagagttggacacaaaggtgactgctgcaaagggtgggagtcatcgcatttctattgttttaggtgcaagacacaatacggagttcactccgtgctcaatttgctgctctgtaaattttttttactcatgactaaaaaaaaaatcgctgccccctcgtcattggcggcacgtcatgtgctcccatttactagtgcagacatttttattagcatcaaattcccttttttcctaatcatcttttatcatcttttataataacttcgatggcccaggtcgaggattattcgtcgctgcacagattgcggaaaaattccgagattctgtccaatgcaaacaagatcctggtggccaatagaggcgagattcccattagaatcttcagatctgcccacgagctctccatgcagacagttgctatctactcccacgaggaccgactgtcgatgcacagattgaaggccgacgaggcctacgtcataggagctaggggccagtactcccctgttcaggcgtacttgcagattgacgagattatcaacatcgcccttgaacacaacgtctccatgattcatcccggttacggctttttgtctgaaaactcagaatttgcccggaaagttgaggacagtggcatgatttggattggcccgccccacaacgtcattgacgctgttggagacaaggtcagtgccagaaacctggccggcaagtgcaacgttcccgtggtccctggaacagacggcccaattgacagcgttgagcaggcccaggagtttgtggataagtatggctatccagtgattatcaaggccgcttttggtggaggtggacgtggtatgagagtggttcgcgagggcgagagcattgctgacgctttccaaagagccacctccgaagccaagaccgcttttggaaacggtacctgtttcattgagcggtttttggacaagccaaagcacattgaggtgcaattgctggccgacaactacggcaacgttatccacctttttgaaagagactgttccgtgcagagaagacaccagaaggtggttgagattgccccagccaagacgcttcctgtcgaggtcagagacgccattctgactgacgcagtgaaactggctaaggctgccaactacagaaacgctggtactgcagagttccttgttgacaaccaaaacagacattatttcatcgaaatcaaccctagaatccaggtcgagcacaccatcactgaggaggtcaccggagtcgacattgttgctgctcagattcagatcgctgccggtgcttcattgcagcaactgggtctgttgcaggacaaaattaccaccaggggatttgccattcagtgcagaattaccaccgaagaccctgccaagaacttccagccagacacaggaaaaatcgaggtgtacagatcttcgggtggaaatggtgtgagactggacggtggtaatggatttgcaggcgccatcatttctccccactacgattccatgttggtcaagtgctccacgtctggctcaaactacgagattgccagaagaaagatgatcagggctttggttgagttcagaattagaggtgtcaagaccaacattcctttcctgctggctcttctgacccatccaacgttcgtttctggcgactgctggacgacattcatcgacgacactccttcgttgttcgagatggtgcaatccaagaacagagctcagaagttgctctcgtaccttgccgatctctgtgtcaacggatcgtcgatcaagggccagattggtctgccaaagctgaccagagatgctgacatcccggtgatccacgacattaacggctgggatatcgatatcaagaacactcctcctccagaatcctttagacaataccttttggactacggtcctgagcaatttgccaaccaaattagggctttcgatggttgcttgatcatggacactacctggagagacgctcaccagtcgcttctggcaaccagagttagaaccatagacttgttgaacattgctccggctacggcccatgcctttagatacgccttcgccctggaatgttggggaggtgccactttcgacgttgctatgcgtttcttgcacgaggatccgtgggacagactcagaaagctgagaaaagccgtgccaaacatcccattccagatgcttctgagaggagcgaatggtgtggcgtactcgtcgctgcctgacaacgccatagaccactttgtgaagcaggctaaggacgccggagtggacattttcagagtctttgatgctctgaacgatttggagcaactgaaggtcggcgtcgacgccgtcaagaaggccggaggtgtggtcgaagccactgtttgctactctggagacatgctcaagccaggcaagaaatacaatctcaagtactacctggagaccgtcgacaagattatggagatgggcacccatttgcttggtatcaaggacatggccggtactttgaagccggccgcggcaaagctgctgatcagcagtatcagaaagaagtatccttctgttcctatccacgtccacacccacgactcggccggtaccggtgtgattacctatgttgcttgtgctcttgctggtgcggacgttgttgattgtgctgtcaactcgatgtcgggcctgacatctcagccttccatgagcgcgttcattgctgccttggacaacgagatcaacaccggcattaccgagcagaatgccagggagattgatgcttattggtccgagatgagactgctgtactcgtgcttcgaggctgacctcaagggtccagacccagaagtgtacaaccacgagattccaggaggccaattgacaaacctgttgttccaggcccagcaggttggtctgggcgagaagtggcttgaaaccaagaaagcctacgaggaggccaacatgcttttgggcgatatcgtcaaggtcactccaacttccaaggttgttggtgatctggcccagttcatggtctccaacaagctttctccaaaggatgtggagaggctggcttcggagctggacttcccagactccgtgctggacttctttgagggtttgatgggtacgccatacggcgggttcccggagcctttgagaacgaatattcttgccggaaagagaagaaagctgactcgcaggccgggattggagctcgagccattcgacctcaagaagatcaaagaggagctccagtcgaggttcggcaactccattaccgagtgcgacgtggcctcgtacaacatgtatccaaaagtgtttgagtcgttcaagaagatccaggagaagtacggcgacctttctgtgctgcctacgagattcttccttgctcctccaaagctgaacgaagagatctctgtggaaatcgagcagggtaaaacctttgtcatcaaggtgatggccattggagacctgtcgccgcaaaccggcaccagagaggtgtatttcgagttcaacggtgaaatgagaaaggtcactgtcgaggacaagctcgccgctgtggagacagtcacgcgtcctaaggccgacgcacacaacccgaacgaggtgggggctcctatggccggtgtggttatcgaggtgcgtgtccatcctggagtcgaggtcaagaagggtgacccattgtgtgttctgagtgcgatgaagatggagatggttatcagctcgcctgtttctggaagagttggcgaggtgattgtgcacgagaacgacagcgtcgacgctggcgacctgatctgcaagattacgaaataatagtaacaaagctttaaacgtttatattatacagcattatttgcgtctcgctctgcgcttttcgtcgctcttcttctcctcgacgagctgttcgtaccgcgcggccagctcctcgtactcagccattttgtccgtgcactttttcgtcctcgtggctggctccctgccacacgttgtgcgggtctgccagcaactccgcagtgtgcttgttttgcgacaggatccccctggaatacttgttgataaaaaaactacatacaaatgagtgtgaggtgtcatgaattttattgcagacgggttttcattctggagtgccggccgtaacaaggaattaactactatcctaaaaaaaaactagtgtattatgtgatagcaaagaaggaaaatg

SEQ ID NO: 5007 - protein, 1175 aa, Pichia angusta
MAQVEDYSSLHRLRKNSEILSNANKILVANRGEIPIRIFRSAHELSMQTVAIYSHEDRLSMHRLKADEAYVIGARGQYSPVQAYLQIDEIINIALEHNVSMIHPGYGFLSENSEFARKVEDSGMIWIGPPHNVIDAVGDKVSARNLAGKCNVPVVPGTDGPIDSVEQAQEFVDKYGYPVIIKAAFGGGGRGMRVVREGESIADAFQRATSEAKTAFGNGTCFIERFLDKPKHIEVQLLADNYGNVIHLFERDCSVQRRHQKVVEIAPAKTLPVEVRDAILTDAVKLAKAANYRNAGTAEFLVDNQNRHYFIEINPRIQVEHTITEEVTGVDIVAAQIQIAAGASLQQLGLLQDKITTRGFAIQCRITTEDPAKNFQPDTGKIEVYRSSGGNGVRLDGGNGFAGAIISPHYDSMLVKCSTSGSNYEIARRKMIRALVEFRIRGVKTNIPFLLALLTHPTFVSGDCWTTFIDDTPSLFEMVQSKNRAQKLLSYLADLCVNGSSIKGQIGLPKLTRDADIPVIHDINGWDIDIKNTPPPESFRQYLLDYGPEQFANQIRAFDGCLIMDTTWRDAHQSLLATRVRTIDLLNIAPATAHAFRYAFALECWGGATFDVAMRFLHEDPWDRLRKLRKAVPNIPFQMLLRGANGVAYSSLPDNAIDHFVKQAKDAGVDIFRVFDALNDLEQLKVGVDAVKKAGGVVEATVCYSGDMLKPGKKYNLKYYLETVDKIMEMGTHLLGIKDMAGTLKPAAAKLLISSIRKKYPSVPIHVHTHDSAGTGVITYVACALAGADVVDCAVNSMSGLTSQPSMSAFIAALDNEINTGITEQNAREIDAYWSEMRLLYSCFEADLKGPDPEVYNHEIPGGQLTNLLFQAQQVGLGEKWLETKKAYEEANMLLGDIVKVTPTSKVVGDLAQFMVSNKLSPKDVERLASELDFPDSVLDFFEGLMGTPYGGFPEPLRTNILAGKRRKLTRRPGLELEPFDLKKIKEELQSRFGNSITECDVASYNMYPKVFESFKKIQEKYGDLSVLPTRFFLAPPKLNEEISVEIEQGKTFVIKVMAIGDLSPQTGTREVYFEFNGEMRKVTVEDKLAAVETVTRPKADAHNPNEVGAPMAGVVIEVRVHPGVEVKKGDPLCVLSAMKMEMVISSPVSGRVGEVIVHENDSVDAGDLICKITK

SEQ ID NO: 5008 - DNA, 1353 bp, Clostridium perfringens
  CDS (1)..(1353)
atgtttaaaaagatattaatagcaaatagaggtgaaatagctgttagaataatacgtgcttgtagagaattaggaattcttactgtagctgtttattctgaaatagacaaagatgcactacatgtgcagttagctgatgaagcagtttgtataggtccatggaattctaaagaaagttacttaaatattcaaaatatattaagtgcttgtgttctaactggggctgaagctattcatcctggatttggttttttatctgagaatccaagatttgctaagatgtgtgaagagtgtaatattgagtttattggccctaattggagagctatagaacttatgggaaacaaagctatggcaagagaaataatgaaaaaggctgatgttcctgttgtacctggatatgaaggtgaaattgaaagtccagagtttgctttaaagatagctaaaaaaataggatttcctgtaatagtaaaggcttcctcaggtggtggtggaaaaggaataagaatagtttataaagaagatgattttatttcaaattacaacacagctaaatcagaggctcaagcaaactttggtgatgataaaatttacattgagagatttgttgaaaatcctaaacatatagaagtacaattattatgcgataagcatggaaatgcccttcacctttttgagcgagattgttcagctcaaagaaaaaatcaaaaagttttagaagaagctccttcatcaattttaagtgatgaacaaagggataaacttggtaagattgcagttaaagcagctaaagctgtaaactatagcaatgttggaacaattgaatttttattagataaaaatggtgaattttattttatggaaatgaacacaagaatacaagttgaacatcctataactgaaatgataacaggtgttgatcttgttaaggaacaaataaaagttgcatttggtaaggagttagaaataactcaagatgatttaaagataaatggtcattccatagaatgcagaataaatgctgaagatccaagcaaaaactttatgccatgccctggtttaataaaggaaattaatttcccaggaggatttggagttcgtttagatacagcaatttattctggatataagataccccattgttatgattcaatgattggtaagctaatagttcatggtaaagatagagaagaggcaatttctaaaatgaaaagggctttagatgaatttgctattgatggtataacaactaacatagactatcactttttaatattggatcatgaagattttaaaaatggtacttataatacttcatttttatctgaaaagttggtgaataagtatgattaa

SEQ ID NO: 5009 - protein, 450 aa, Clostridium perfringens
MFKKILIANRGEIAVRIIRACRELGILTVAVYSEIDKDALHVQLADEAVCIGPWNSKESYLNIQNILSACVLTGAEAIHPGFGFLSENPRFAKMCEECNIEFIGPNWRAIELMGNKAMAREIMKKADVPVVPGYEGEIESPEFALKIAKKIGFPVIVKASSGGGGKGIRIVYKEDDFISNYNTAKSEAQANFGDDKIYIERFVENPKHIEVQLLCDKHGNALHLFERDCSAQRKNQKVLEEAPSSILSDEQRDKLGKIAVKAAKAVNYSNVGTIEFLLDKNGEFYFMEMNTRIQVEHPITEMITGVDLVKEQIKVAFGKELEITQDDLKINGHSIECRINAEDPSKNFMPCPGLIKEINFPGGFGVRLDTAIYSGYKIPHCYDSMIGKLIVHGKDREEAISKMKRALDEFAIDGITTNIDYHFLILDHEDFKNGTYNTSFLSEKLVNKYD

SEQ ID NO: 5010 - DNA, 1368 bp, Ralstonia solanacearum
  CDS (1)..(1368)
atgttcgatacagtgctcattgccaatcgcggcgagatcgccctgagaatccagcgcgcctgccgcgggctcggcttgcgcacggtggctgtctattcggaggccgatcgcgatgccgtctatgtgcgtcaggccgaccaggcgctctgcattggtccggcatcgcccaccagcagttacctgaaccaggcggcgctgcttgcggcggcgcgtgtcagcggtgcgcaggccattcaccccggctatggattcctgtcggagaacgccggctttgtggcgcgcgtgaccgatgcagggctcacgttcatcggccccagcgccgactgcatccgcacgatgggcgacaaggtcagtgccaagcgcgccatgcgtgaagccggtgtgccgtgcgtgccggggccggatacgtcgctgcccgaggacccggccgaggtgctggcgattgcgcacgggatcggctttcccgtgatcgtcaaggcggcgggcgggggcggggggcgcggcatgcgcgtggtgcacgaagcctcggcgctggcggatgcgctggcactgacgcgcgaagaggcgcgccgcgcgttcggcaacccggaggtctatatcgagaaattcctgacccacccgcgccacgtggaaatccaggtcctggccgaccgctacggccatgccgtgtggctgggcagccgtgattgctcgctgcagcgtcggcaccagaaggtcatcgaagaggcgccggcgccgggcatcgatgcctcgctgatcgccgaggtcggagagcgctgcgccgcggcatgccggcagatcggctactgcggcgtgggcaccttcgagtttctgtatgagaacggggcgttctacttcatcgagatgaacacccgactgcaggtcgagcacccggtgaccgagatgacctcgggcatcgatatcgtccagcagcagattcgtgtggcacgcggcgagccgctcacgctgcggcagggcgacatcgcttgccggggccatgcgctggagtgccgcatcaatgccgagcacccggacacgttcatgccctcgcccggcgtcattaccggttggcagttgccgggcggctatggcgtgcgcgtggacacccatgccggtgccggctatcgcgtgccgtcgcactacgactcgatgatcgccaagctcatcgtgcatggcgcaagccgggaggatgcgctgcagcgcatgcgcctggcgctggacgaactgcaggtggacggcattgccaccaacctgccgctgcatcgcgagatcgtccgcgacgcggagtttgaaaccggtggggtcgatatccatcacctggaacgctggctgcgcgcacgcgccgagctgcgtagccaagtggcataa

SEQ ID NO: 5011 - protein, 455 aa, Ralstonia solanacearum
MFDTVLIANRGEIALRIQRACRGLGLRTVAVYSEADRDAVYVRQADQALCIGPASPTSSYLNQAALLAAARVSGAQAIHPGYGFLSENAGFVARVTDAGLTFIGPSADCIRTMGDKVSAKRAMREAGVPCVPGPDTSLPEDPAEVLAIAHGIGFPVIVKAAGGGGGRGMRVVHEASALADALALTREEARRAFGNPEVYIEKFLTHPRHVEIQVLADRYGHAVWLGSRDCSLQRRHQKVIEEAPAPGIDASLIAEVGERCAAACRQIGYCGVGTFEFLYENGAFYFIEMNTRLQVEHPVTEMTSGIDIVQQQIRVARGEPLTLRQGDIACRGHALECRINAEHPDTFMPSPGVITGWQLPGGYGVRVDTHAGAGYRVPSHYDSMIAKLIVHGASREDALQRMRLALDELQVDGIATNLPLHREIVRDAEFETGGVDIHHLERWLRARAELRSQVA

SEQ ID NO: 5012 - DNA, 1371 bp, Ralstonia solanacearum
  CDS (1)..(1371)
atgttcgacaagatcctgatcgcgaatcgcggcgagatcgcgcttcgcatccagcgagcctgccgcgaactcggcatcaagaccgtggtggtctattccgaggcggacaaggaagccaagtacgtcaagctggccgatgaggccgtctgtatcggcccggcgccgtcgccgctgtcgtacctgaacatgccggccatcatctcggccgccgaagtgaccgacgcccaggccatccaccccggctacggcttcctgtcggagaacgccgatttcgccgagcgcgtggagcagtccggcttcaccttcatcggcccgacgcccgactgcatccgcctgatgggcgacaaggtctcggccaagcaggccatgatcaagtccggcgtgccgtgcgtgccgggctcggagggcgcgctgcccgacgacccgaaggaaatcctggcgaccgcccgcaaggtcggctacccggtcatcatcaaggccgcgggcggcggcggcggccgcggcatgcgcgtggtccacaccgaggccgcgctgatcaacgccgtcaacatgacgcgtgaagaagccggccgtgccttcggcaacccggaagtctatatggagaagttcctggagaatccgcgccacgtggagatccaggtcctggccgaccagcaccgcaacgccatctggctgggcgagcgcgactgctcgatgcagcgccgccaccagaaggtgatcgaggaagcgccggcaccgcacatcccgcgccgcctgatcgagcgcatcggcgaccgctgcgccgatgcctgcaagaagatcggctaccgcggcgccggcacgttcgagttcctgtacgagaacggcgagttctacttcatcgagatgaacacgcgcgtgcaggtcgagcacccggtcacggaaatgatcaccggcatcgacatcgtgcaggagcagatccgcgtggcagccaatgaaaagttgcgcttccgccagaaggacgtcgtcctgaagggtcacgccatcgagtgccgcatcaacgccgaggatccgtacaagttcacgccgtcccccggccgcatcacgtcgtggcacgtgccgggcggccccggcatccgtgtggattcgcacgcctacaacggctatttcgtgccgcccaactacgactcgatgatcggcaaggtgatctcgtacggcaccacgcgcgagcaggccatcgcccgcatgcgcatcgccctgtcggagatggtggtcgaaggcatccagaccaacgtgcccctgcaccgcgacctgatgctcgacgccaacttcgtcgaaggcggcaccagcatccactacctggagcaccgcctggcgcagcaggaagtggccaagggcggcggcaaggcctga

SEQ ID NO: 5013 - protein, 456 aa, Ralstonia solanacearum
MFDKILIANRGEIALRIQRACRELGIKTVVVYSEADKEAKYVKLADEAVCIGPAPSPLSYLNMPAIISAAEVTDAQAIHPGYGFLSENADFAERVEQSGFTFIGPTPDCIRLMGDKVSAKQAMIKSGVPCVPGSEGALPDDPKEILATARKVGYPVIIKAAGGGGGRGMRVVHTEAALINAVNMTREEAGRAFGNPEVYMEKFLENPRHVEIQVLADQHRNAIWLGERDCSMQRRHQKVIEEAPAPHIPRRLIERIGDRCADACKKIGYRGAGTFEFLYENGEFYFIEMNTRVQVEHPVTEMITGIDIVQEQIRVAANEKLRFRQKDVVLKGHAIECRINAEDPYKFTPSPGRITSWHVPGGPGIRVDSHAYNGYFVPPNYDSMIGKVISYGTTREQAIARMRIALSEMVVEGIQTNVPLHRDLMLDANFVEGGTSIHYLEHRLAQQEVAKGGGKA

SEQ ID NO: 5014 - DNA, 2139 bp, Ralstonia solanacearum
  CDS (1)..(2139)
atgaaacaagggttgcaccacaagtgccaagccctggcggaagccaaaacaggacatgcaccaccagtgcaaaccatgccgagaaagaaaaagcacaaggagacaaacccaatgttcaccaagctgctcatcgccaaccgaggcgaaatcgcctgccgggtcgccgcgacctgccgtcgcctgggcatccgcaccgttgcggtgtattccgatgccgatgtcgatgcgcgccacgtcgccgcgtgcgatgaggccatccacatcggtgagccggccgcccgcgacagttatctgcgcgccgaccgcatcctcgaagccgcgcgcgcgacgggtgcccaggccatccacccgggctatggcttcctgtcggagaacgaggcctttgcgcgggcctgctcggaggccggcctggtcttcgtcgggccgccggcctcggccatcgaggcgatgggcagcaagagcgcggccaaggcgctgatggagacggccggtgtgccgctggtgcccggctaccacggcgacaaccaggatgccgcgttcctgcgcgcgcaggccgatcgcatcggctacccggtgctgatcaaggccagcgcgggcggcggcggcaagggcatgcgcgtggtggagacgggcgaggcattcgcggccgcgctggcctcggtcaagcgcgaggcgtcgagcagcttcggcgatgaccgcgtgctgatcgagaagtacctgacgcgcccgcgccatatcgagatccaggtattcgccgacggcttcggcgacgcggtctacctgttcgagcgcgactgctcggtgcagcgccgccaccagaaggtgctggaggaagcgcccgcgccgggcatgacgccggagcgccgccgcgccatgggcgaggccgccgtggccgcggcgcgcgcggtcggctacgtgggcgccggcacggtcgagttcatcgtcgacgaggacggcaccttctacttcatggagatgaacacgcgcctgcaggtcgagcatcccgtcaccgagatgatcaccggcgaggacctcgtcgaatggcagctgcgcgtggcctgcggcgaaccgctgccgcgcgcgcaggacgcgctgcgcatccacggccacgcgctggaggcccgcatctacgccgagaaccccgaacgcgacttcctgccctcgatcggcacgctgaaggtgctgcgcacgccggcggcggcggtggagttcaccgtcggcgcgcaggccagcggcgagccggccacggtgcgcatcgacgcgggtgtgcgcgagggcgatgccatcagcccgtattacgacccgatgatcgccaagctgatcgtctggggccgcgaccgcgaggaagcgctggcgcgcatgctgcaggcgctgggcggcttccatctggtcgggctgtcgtccaacgtggccttcctgcggcggctggtggcgtcgcagccgtttgccgcggcggacctggataccggcctgatcgcgcgtcaccacgacgcgctgttcccggccgcgccgccggtgccgcgcgaagcggtcgcactggcggccgccgcgctgctggcccgcgaggcgcgcggcctgcgcacggacacgcgcgacccgcactccccctggacacgcggcagcggctggcgcctgaacggcgaggccgagcgcacgctgcgcttcgcgcagggcgaccaggccatcgaagcgcacctggtctacggccgcgacggcacgcgcctgcgcgtggacgaccacgaaacgcccttcaccacgcagcgccacggcgacaccttcaccgtcgcgctcggctcgcgcaaggcggccggccaggtgcacgtcgacggcgacgccttccacgtcttcaccggcggcacgcactgggcactggagcgagacgacccgctcgcccatgccggcgaggccgacgacgaaggcggcaagctgaccgcgccgatgcccggcaaggtcatcgccgtgctggccacgcccggccagagcgtcgccaagggcgcgccgctggtggtcatggaagcgatgaagatggagcacaccctcaccgccccggccgatggcgtggtcgagtcggtgctgtacggcgtgggggaccaggtggccgaaggggtgcagctgctggcgttcaagccggcggcgtga

SEQ ID NO: 5015 - protein, 712 aa, Ralstonia solanacearum
MKQGLHHKCQALAEAKTGHAPPVQTMPRKKKHKETNPMFTKLLIANRGEIACRVAATCRRLGIRTVAVYSDADVDARHVAACDEAIHIGEPAARDSYLRADRILEAARATGAQAIHPGYGFLSENEAFARACSEAGLVFVGPPASAIEAMGSKSAAKALMETAGVPLVPGYHGDNQDAAFLRAQADRIGYPVLIKASAGGGGKGMRVVETGEAFAAALASVKREASSSFGDDRVLIEKYLTRPRHIEIQVFADGFGDAVYLFERDCSVQRRHQKVLEEAPAPGMTPERRRAMGEAAVAAARAVGYVGAGTVEFIVDEDGTFYFMEMNTRLQVEHPVTEMITGEDLVEWQLRVACGEPLPRAQDALRIHGHALEARIYAENPERDFLPSIGTLKVLRTPAAAVEFTVGAQASGEPATVRIDAGVREGDAISPYYDPMIAKLIVWGRDREEALARMLQALGGFHLVGLSSNVAFLRRLVASQPFAAADLDTGLIARHHDALFPAAPPVPREAVALAAAALLAREARGLRTDTRDPHSPWTRGSGWRLNGEAERTLRFAQGDQAIEAHLVYGRDGTRLRVDDHETPFTTQRHGDTFTVALGSRKAAGQVHVDGDAFHVFTGGTHWALERDDPLAHAGEADDEGGKLTAPMPGKVIAVLATPGQSVAKGAPLVVMEAMKMEHTLTAPADGVVESVLYGVGDQVAEGVQLLAFKPAA

SEQ ID NO: 5016 - DNA, 3459 bp, Rhizobium meliloti
  CDS (1)..(3459)
atgtccatttccaagatccttgttgccaaccgttccgaaatcgccatccgcgtcttccgcgcggccaatgagctggggcttaaaacggtcgcgatatgggctgaggaggataagctggcgctgcaccgcttcaaggcggacgagagttatcaggtcggacgcgggccgcaccttccccgcgacctcggaccgatcatgagctatctgtcgatcgacgaggtgatccgcgtcgccaagctctccggcgccgacgccatacatccgggctatgggctgctctccgaaagcccggaattcgccgaggcctgtgccgcaaacggcatcaccttcatcggccccaagccggagacgatgcgccagctcggcaacaaggtcgcggcccgcaacctcgcgatctcgatcggcgtgccggtcgtgccggcgaccgagcctctgccggacgacccggaagagatcaagcgactggccgaggagatcggctatccggtgatgctgaaggcctcctggggcggcggcggccgcggcatgcgggcgatccgcgaccccaaggacctgatccgcgaggtgaccgaggccaagcgcgaggccaaggccgccttcggcaaggacgaggtctatctcgaaaagctcgtcgagcgcgcccgtcacgtcgaaagccagatcctcggcgacacgcacggcaatgtcgtccatcttttcgagcgcgactgctcgatccagcgtcgcaaccagaaggtcgtggagcgggcgccggcgccctatctcaatgatgcgcagcgccaggaactcgcggattattcgctgaagatcgccagggcgaccaactatatcggcgcaggcaccgtcgagtatctgatggattccgataccggcaagttctacttcatcgaggtcaatccgcgcatccaggtcgagcatacggtcaccgaggtcgtcaccggcatcgatatcgtcaaggcgcagatccatattctcgacggcttcgccatcggtgcgccggaatcgggcgtgccgcgccaggaggacatccgcctcaacggccatgcgctgcagtgccgcatcacgacggaagacccggagcagaacttcattccggattatggccgcatcaccgcctatcgcggcgccaccggcttcggcatccgcctcgacggcggcaccgcctattccggcgcggtgatcacccgttactacgatccgctgctcgagaaggtcaccgcctgggcgccgaacccgggcgaggcgatccagcggatgattcgtgcgctgcgagaattccgcatccgcggcgtggcgaccaacctcaccttcctcgaggctatcatcagccacccgaagttccacgacaacagctatacgacgcgcttcatcgacacgacgccggaattgttccagcaggtcaagcgccaggaccgcgccaccaagcttctcacctatctcgccgacgtcaccgtcaacggccatccggaagtcaagggccggccgaagccttccgacgatatcgccgcgccggtcgtgccgttcaccggcggcgatgtgaagcccggcacgaagcagcgcctcgaccagctcggcccgaagaaattcgccgaatgggtgaaggcgcagccggaggtgctgatcaccgacacgacgatgcgcgacggccaccaatcgcttctcgccacgcgcatgcgcacctacgacatcgcccgcatcgccggcacctatgcgcgggcgctgcccaacctcttttcgctcgaatgctgggggggcgcgaccttcgacgtgtcgatgcgcttcctgaccgaagatccgtgggagcggctggcgatggtgcgcgagggtgcgccgaacctgctcctgcagatgcttctgcgcggcgccaacggcgtcggctacaagaactatccggataatgtcgtcaaatatttcgtccgccaggccgcgaagggaggcatcgacgtcttccgcgtcttcgactgcctgaactgggtcgagaacatgcgcgtggcgatggacgcggtggccgaggaggacaggatctgtgaggcggcgatctgctacaccggagacatcctcaattccgcccggccgaaatacgacctgaaatactacacggcgcttgcggccgagctggaaaaggccggcgcccacatgatcgccgtcaaggacatggccgggctcctgaagccggccgcggcgcgtgtgctcttcaaggcgctcaaggaagcgaccggcctgccgatccattttcacacgcacgacacttccggaattgcggcggcgaccgtgctcgccgcagtcgagtcgggcgtcgatgtcgtcgatgcggcgatggacgcgctctccggaaacacctctcagccctgcctcggctcgatcgtcgaagcgctgtccggctcggagcgcgacccgggtctcgatccggaatggatccgccgcatctccttctactgggaggcggtacgccatcaatatgcggccttcgaaagcgacctcaaggggccggcttcggaagtctatctgcacgagatgccgggcggccagttcaccaacctgaaggaacaggcccgctcgctcggcctcgagacccgctggcacgaggtggcgcaggcctatgccgacgccaaccggatgttcggcgatatcgtcaaggtgacgccgtcttccaaggtcgtcggcgacatggctctgatgatggtctcccaggatctgacggtcgccgatgtcgagaatccgggcaaggacatcgccttcccggaatcggtcgtctccatgctcaagggcgacctcggccaaccgccgggcggctggccggaggcgctgcagaagaaggcgctgaaaggcgaggagccctatgacgcgcgtccgggctcgctgctcgaagacgcggatctcgacgccgagcgcaagggcatcgaggagaagctcggccgcgaagtgaccgatttcgagttcgcctcctacctcatgtatccgaaggtcttcaccgattatgcggtggcctgcgagacctacggcccggtcagcgtgctgccgacgcccgcctatttctacgggatggcgccgggtgaggaactcttcgccgacatcgagaagggcaagacgctcgtcatcctcaaccaggcgcagggggagatcgacgagaagggcatggtcaagatgttcttcgaaatgaacgggcagccgcgttccatcaaggtacccgaccgcaaccgcggcgcctcggctgccgtccgccgcaaggcggaagccggcaacgccgcccatctcggcgcgccgatgccgggcgtgatctcgaccgttgcggtggcctccggccaatcggtcaaggccggagacgtgctgctctccatcgaggcgatgaagatggagacggcgcttcacgccgagaaggacggggtgatttccgaggtgctcgtaagggccggcgatcagatcgatgcgaaggatctgctggtggtgttcgggggttaa

SEQ ID NO: 5017 - protein, 1152 aa, Rhizobium meliloti
MSISKILVANRSEIAIRVFRAANELGLKTVAIWAEEDKLALHRFKADESYQVGRGPHLPRDLGPIMSYLSIDEVIRVAKLSGADAIHPGYGLLSESPEFAEACAANGITFIGPKPETMRQLGNKVAARNLAISIGVPVVPATEPLPDDPEEIKRLAEEIGYPVMLKASWGGGGRGMRAIRDPKDLIREVTEAKREAKAAFGKDEVYLEKLVERARHVESQILGDTHGNVVHLFERDCSIQRRNQKVVERAPAPYLNDAQRQELADYSLKIARATNYIGAGTVEYLMDSDTGKFYFIEVNPRIQVEHTVTEVVTGIDIVKAQIHILDGFAIGAPESGVPRQEDIRLNGHALQCRITTEDPEQNFIPDYGRITAYRGATGFGIRLDGGTAYSGAVITRYYDPLLEKVTAWAPNPGEAIQRMIRALREFRIRGVATNLTFLEAIISHPKFHDNSYTTRFIDTTPELFQQVKRQDRATKLLTYLADVTVNGHPEVKGRPKPSDDIAAPVVPFTGGDVKPGTKQRLDQLGPKKFAEWVKAQPEVLITDTTMRDGHQSLLATRMRTYDIARIAGTYARALPNLFSLECWGGATFDVSMRFLTEDPWERLAMVREGAPNLLLQMLLRGANGVGYKNYPDNVVKYFVRQAAKGGIDVFRVFDCLNWVENMRVAMDAVAEEDRICEAAICYTGDILNSARPKYDLKYYTALAAELEKAGAHMIAVKDMAGLLKPAAARVLFKALKEATGLPIHFHTHDTSGIAAATVLAAVESGVDVVDAAMDALSGNTSQPCLGSIVEALSGSERDPGLDPEWIRRISFYWEAVRHQYAAFESDLKGPASEVYLHEMPGGQFTNLKEQARSLGLETRWHEVAQAYADANRMFGDIVKVTPSSKVVGDMALMMVSQDLTVADVENPGKDIAFPESVVSMLKGDLGQPPGGWPEALQKKALKGEEPYDARPGSLLEDADLDAERKGIEEKLGREVTDFEFASYLMYPKVFTDYAVACETYGPVSVLPTPAYFYGMAPGEELFADIEKGKTLVILNQAQGEIDEKGMVKMFFEMNGQPRSIKVPDRNRGASAAVRRKAEAGNAAHLGAPMPGVISTVAVASGQSVKAGDVLLSIEAMKMETALHAEKDGVISEVLVRAGDQIDAKDLLVVFGG

SEQ ID NO: 5018 - DNA, 1350 bp, Rhizobium meliloti
  CDS (1)..(1350)
atggcgatgatctcgaaaatcctcattgccaatcgcggcgaaattgctctgcgcgtcctgcgcgcctgcaaggagctcggcatcgcgaccgtagccgtgcactcaacggcggacagcgacgccatgcatgtccggctcgccgacgagagcgtctgcatcggcccgccgccttcgcgcgagagctatctgaacatccatcagatcgttgccgcctgtgagatcaccggtgcggatgcggtgcatccgggttacggcttcctctcggagaacgccaagttcgccgatatcctcgatgcgcacggcatcactttcatcggaccgactgccgagcacatccgcctcatgggcgacaagatcaccgccaagaagacggcggaagaactcggcattccggtcgttccgggctccgatggcgaagtgaggccggagaatgccctggagatcgcccgccagatcggattccccgtgctgatcaaggcgacggcgggtggcggtggccgcggcatgaaggtcgcccgcaccgaggaggaactcgaaaatgcggttgcgacggcacgttccgaagccgcggccgcattcggcaacgacgcggtctacatggagaagtttctcggcaagccgcgccatatcgaaatacaggtcgtcggggacggcgaaggcaatgcgatccatctcggtgaacgcgactgctcgctgcagcgccgccatcagaaggtatgggaagaagccaactccccggccctgaacgtcgaacagcgcatgaagatcggtcaggtctgcgccgacgcgatgaagaagttgaagtatcgcggcgccggcacgatcgaattcctctacgagaacggcgagttctacttcatcgagatgaacacgcgcctgcaggtcgaacacccgattaccgaagcgatcaccgggatcgacctcgtgcacgagcagattcgcgtggcgtccggagccggcctctccgccaagcaggaggatatcgtcttctccggtcacgccatcgaatgccgcatcaatgccgaagatccgcgcaccttcgtcccttccccgggcacgatcacgcatttccacgccccgggcggcctcggtgtgcgcgtcgacagcggcgcctatcagggttaccgcatacccccctactatgacagcctgatcggtaagctgatcgtccacggccggacgcgcgtcgagtgcatgatgcggctgcgccgcgtgcttgacgaatttgtcatcgacggaatcaagacgactcttcccctttttcaggacctgatcaacaatcaggatatcgcaaacggcgattatgatatccattggctggagcaccatctggccacaacatccgcatag

SEQ ID NO: 5019 - protein, 449 aa, Rhizobium meliloti
MAMISKILIANRGEIALRVLRACKELGIATVAVHSTADSDAMHVRLADESVCIGPPPSRESYLNIHQIVAACEITGADAVHPGYGFLSENAKFADILDAHGITFIGPTAEHIRLMGDKITAKKTAEELGIPVVPGSDGEVRPENALEIARQIGFPVLIKATAGGGGRGMKVARTEEELENAVATARSEAAAAFGNDAVYMEKFLGKPRHIEIQVVGDGEGNAIHLGERDCSLQRRHQKVWEEANSPALNVEQRMKIGQVCADAMKKLKYRGAGTIEFLYENGEFYFIEMNTRLQVEHPITEAITGIDLVHEQIRVASGAGLSAKQEDIVFSGHAIECRINAEDPRTFVPSPGTITHFHAPGGLGVRVDSGAYQGYRIPPYYDSLIGKLIVHGRTRVECMMRLRRVLDEFVIDGIKTTLPLFQDLINNQDIANGDYDIHWLEHHLATTSA

SEQ ID NO: 5020 - DNA, 1677 bp, Brassica napus
  CDS (34)..(1641)
tgacaagaaggatctcagtctcttatccagcaaatggacgcctcaatgattactaattgcaaatccactgcctcccttccctctttgttcctggggagatcgggaggtagtcttagaagctcccagtgtaatgtcatgatggggaaaaccattaccttcccgagccaaaagactcagactttgaaggttagccggaagaacttgaataggaggtgtggtggtggtgcgcttggtgctacctgcagtggggataagattcttgtggctaacagaggtgaaattgctgtccgtgtgatccgaactgctcatgagatggggattccttgtgttgctgtttactcaaccatcgacaaggatgcattgcatgtcaaattggctgacgaggctgtttgtattggtgaagctcctagcaaccagtcgtatttggtgataccgaatgttctgtcagctgcaatcagccgaggatgcacaatgcttcatcctggatatggattccattcagagaacgctctttttgttgagatgtgcagagagcacaggatcaactttattggaccaaatcctgatagcatccgtgtcatgggtgacaaatcaactgccagggagacgatgaagaatgcaggtgtcccaactgtaccagggagtgatggactattaaagagcacagaagaaggagtcaagctcgccaatgagattgggttccctgtgatgatcaaggcaacagctggtggtggtggacgtggaatgcgtcttgctaatgaaccgtcagagtttgtgaaactgctgcaggcagcaaagagtgaggccgcggctgcttttggaaatgatggagtttatctggagaagtacgtccaaaatccccgccatattgagttccagattcttgcagataaatttggaaatgttgtgcacttcggcgagcgtgactgcagcatccagagacggaaccaaaagttgctggaagaagcaccttctcctgcactgacccctgagttgcgaaaagccatgggtgatgcagctgttgcagcagcagcgtcgattggctacgttggtgttggtaccgtggagttccttttggatgagagaggttccttctatttcatggagatgaacactagaatccaggtggagcatcctgtgacagagatgatttactctgttgatttgattgaagaacagattcgtgttgcaatgggagagaaactgcgttatacacaggatgagattgtgctaagaggacactctattgaatgccgtatcaatgcagaggacccattcaaaggattcagacctggacctggaagaataacagcatatctgccatctggaggtccttttgttagaatggatagtcatgtgtatcccgactatgttgttcctccaagctatgactctcttcttggaaagcttattgtatgggctccaacgagggaaagggcaattgagcggatgaaacgtgcacttaatgacactattattacaggggttcccaccaccattgagtaccacaaacttatccttgaagttgaggatttcaagaacggaaaagttgacactgctttcatccccaagcatgaggaggaattagcagagcctcatgaaattgtgctagtgaaagatttgacaaacgcagctgcttagaatccatcagctcttaagatgaaacagtaattttca

SEQ ID NO: 5021 - protein, 535 aa, Brassica napus
MDASMITNCKSTASLPSLFLGRSGGSLRSSQCNVMMGKTITFPSQKTQTLKVSRKNLNRRCGGGALGATCSGDKILVANRGEIAVRVIRTAHEMGIPCVAVYSTIDKDALHVKLADEAVCIGEAPSNQSYLVIPNVLSAAISRGCTMLHPGYGFHSENALFVEMCREHRINFIGPNPDSIRVMGDKSTARETMKNAGVPTVPGSDGLLKSTEEGVKLANEIGFPVMIKATAGGGGRGMRLANEPSEFVKLLQAAKSEAAAAFGNDGVYLEKYVQNPRHIEFQILADKFGNVVHFGERDCSIQRRNQKLLEEAPSPALTPELRKAMGDAAVAAAASIGYVGVGTVEFLLDERGSFYFMEMNTRIQVEHPVTEMIYSVDLIEEQIRVAMGEKLRYTQDEIVLRGHSIECRINAEDPFKGFRPGPGRITAYLPSGGPFVRMDSHVYPDYVVPPSYDSLLGKLIVWAPTRERAIERMKRALNDTIITGVPTTIEYHKLILEVEDFKNGKVDTAFIPKHEEELAEPHEIVLVKDLTNAAA

SEQ ID NO: 5022 - DNA, 1542 bp, Sulfolobus tokodaii
  CDS (1)..(1542)
atgccaccttttggaaaagtactcgttgcaaatagaggagaaattgcagtaagagttatgaaagcaatcaaagaaatgggcatgaaagctgttgctgtgtattcagaagctgataaatatgctttgcacgtaaaatatgcagatgaggcttattatatagggccgccaccagcattagaaagctacttaaatattcaagccattattgatgcagcagaaaaagctcatgctgatgcagttcatcctggttacggtttcttatctgaaaacgcagattttgctgaagctgttgtaaaggctggattaacatggattggaccaccagtagatgcgatgagagctattaagagtaagctagacggcaaaagaattgcaaaacaagctggagtacctatttcacctggttctgacggtccagttgatagtttagatgaggctctaaaattagctgaaaaaattggctacccaataatggtaaaagcggcattcggtggtggaggtactggaataactagggttgataatccagaccagttagtcgaagtttgggaaaggaataaaagattagcttatcaagcctttggtaaagctgatttatatattgaaaaggcggcagttaatccaagacatattgagtttcagctaataggagataaatatggcaactatgtagtagcatgggaaagagagtgtacaattcaaagaagaaatcagaaattaattgaagaagcaccctcaccagctctaaaaatggaagaacgagaaagaatgtttgaaccaattatcaagttcggtcaaattattcattattacacattaggaacatttgaaacagttttctcagatactacgagagaattctatttccttgaattaaataaaagacttcaagttgaacacccaattaccgaaatgatatttagaattgacttagtaaaacttcaaataaatatcgctgcaggtgaacctttaccttttacccaagaagaattaaataaaagagtaagagggcacgcaatcgaatatagaatcaatgctgaagatccgttaaatgactttactggtagctcgggatttatcacatactataaggaaccgactggtccgggagtaagagtagatagtggtgttactttaggtagttacgtaccaccattttacgattcgttaatttcaaaactcattgtatatggcgaaaatagagcttatgccatacaggctggaataagagctttaaatgattataaaataggtggagttagaacaacaattgaactatacaaatggatatcacaagaggaagattttcaaaaaggtaaattctcaactgcatatatagctgagaagagagaacaatacctaaaatacttaaaagcaaaagagcagatgaaagccgctttagctgcaacgttatatcaaagaggattgttaaagaaagcaacgactacagttaattctactcaaccacaaaatcaaacaaagaggtcgaattggaaaacatacggtttattgcaacaatcctcttatagggtgatgtggtaa

SEQ ID NO: 5023 - protein, 513 aa, Sulfolobus tokodaii
MPPFGKVLVANRGEIAVRVMKAIKEMGMKAVAVYSEADKYALHVKYADEAYYIGPPPALESYLNIQAIIDAAEKAHADAVHPGYGFLSENADFAEAVVKAGLTWIGPPVDAMRAIKSKLDGKRIAKQAGVPISPGSDGPVDSLDEALKLAEKIGYPIMVKAAFGGGGTGITRVDNPDQLVEVWERNKRLAYQAFGKADLYIEKAAVNPRHIEFQLIGDKYGNYVVAWERECTIQRRNQKLIEEAPSPALKMEERERMFEPIIKFGQIIHYYTLGTFETVFSDTTREFYFLELNKRLQVEHPITEMIFRIDLVKLQINIAAGEPLPFTQEELNKRVRGHAIEYRINAEDPLNDFTGSSGFITYYKEPTGPGVRVDSGVTLGSYVPPFYDSLISKLIVYGENRAYAIQAGIRALNDYKIGGVRTTIELYKWISQEEDFQKGKFSTAYIAEKREQYLKYLKAKEQMKAALAATLYQRGLLKKATTTVNSTQPQNQTKRSNWKTYGLLQQSSYRVMW

SEQ ID NO: 5024 - DNA, 2085 bp, Rhizobium loti
  CDS (1)..(2085)
atgccgaactgcaaggcagcatccggcgaagcgaaagcctatccatataggcttgcgagacagagggggcgcgaaggaacgcctgcgtcgctttcagcaagccctcgctacggaggctccatgttcagcaaaatcctgatcgccaatcgcggcgagatcgcttgccgtgtcatccgcacggcccgcaagatgggtgtgcgcaccgtcgctgtctattcggacgccgacgcgaaatccctgcatgtcgagatggccgacgaggccgttcatatcggccccccgtcggttggcgaaagctatctgcgcggtgaccggattgtcgcggctgcgctttcgacgggggcgcaggccatccatcccggttacggcttcctgtcggaaaatcctgatttcgtcgaccaggtggtggcggcggggcttaccttcatcggcccgtcggcggcctcgatccgcgccatggggctgaaggacgccgccaagcggctgatggagaaagccggcgttcccgtcgttccgggctatcatggcgaagcgcaggagatcgtgctgcttgcctccaaggcacgcgagattggctatcccgtgctgatcaaggcgcgcgccggcggcggcggcaagggcatgcggcgcgtcgagcatcccgatgatttctccgaggcgctgtccagcgcccggcgcgaggcaaaggctgctttcggcgacgaccgcgttctcgtcgaaaaatatgtcgacaagccgcggcacatcgaagtgcaggtgttcggcgacaatttcggcaatgccgtgcatctctacgaacgcgactgctcggcgcagcgccgccaccagaaagtgatcgaggaagcccccgcccccggcatgacgccggcgctgcgcaaggcgatgacggaagcggctgtgaaggccgccaaggcgatcggctactcaggcgccggcaccatcgaattcatcgtcgatgcctcgcaaggcctcaagcccgaccgcttctggttcatggagatgaacacccgcctgcaggtcgagcatccggtcaccgagatggtcaccggcaccgacctcgtcgagtggcagttgcgcgttgccagcggcgaaaagctgccgaatacgcagagcgagatcgcgctgaccggccatgccctggaggcgcgaatctatgccgaggatgcgtcaaagggcttcctgcccgcaacgggcacgctccatcatctgaagttccctgaggcggcacccgagggcgccacgatgcgcgtcgagaccggcgtgcggaccggtgatgccatctcaccctattatgatccgatgatcgccaagctggtggtccatgcaaaggacaggctagcagcgctggaagctctcggcgcggcgctggcgcggaccgaaatcgcgggttccaccgtcaacaccggctttcttgccgcccttgccgccgatcccgacttttgtgctggtgatgtcgacaccggcctgatcggcagacatcaggcggcactgaccggggtcgcgccgccgaccggcgaaatcgtctcggcagcagcccttgccgcctccggtgccgcagccttgccgctatcgaacgacccatggtcgtcactttccggctacgcgcatttccacggcgtggcgcggcgcacgcggctgaagttcggggagaccgatatactggcaaaggtttcggtgcggccggacgggcgcttccaggtggcgttcgatgcgccctatgacagcaccaattcgcatgattttcgcgccgctccccgcctcgcccgctggcctggccacatcacggtgttcgaaggcgccgtcggctacacattcgcggtaccggacccgttggcacggagcgatgaagcggccgccgcctccggcagcctgcgcgcgccgatgccgggcctggtcaagctggtgcgcgtggcgaagggcgatgcggtgatcaaggggcaaccgttgctgatcctcgaggcaatgaagatggagcacactatcgccgccccgcatgacggggtggttgccgagatcgccacggaaggcgcgcaggtcacggacgggacagtgctggtgcggttcgtagaggagcagaacgcgtag

SEQ ID NO: 5025 - protein, 694 aa, Rhizobium loti
MPNCKAASGEAKAYPYRLARQRGREGTPASLSASPRYGGSMFSKILIANRGEIACRVIRTARKMGVRTVAVYSDADAKSLHVEMADEAVHIGPPSVGESYLRGDRIVAAALSTGAQAIHPGYGFLSENPDFVDQVVAAGLTFIGPSAASIRAMGLKDAAKRLMEKAGVPVVPGYHGEAQEIVLLASKAREIGYPVLIKARAGGGGKGMRRVEHPDDFSEALSSARREAKAAFGDDRVLVEKYVDKPRHIEVQVFGDNFGNAVHLYERDCSAQRRHQKVIEEAPAPGMTPALRKAMTEAAVKAAKAIGYSGAGTIEFIVDASQGLKPDRFWFMEMNTRLQVEHPVTEMVTGTDLVEWQLRVASGEKLPNTQSEIALTGHALEARIYAEDASKGFLPATGTLHHLKFPEAAPEGATMRVETGVRTGDAISPYYDPMIAKLVVHAKDRLAALEALGAALARTEIAGSTVNTGFLAALAADPDFCAGDVDTGLIGRHQAALTGVAPPTGEIVSAAALAASGAAALPLSNDPWSSLSGYAHFHGVARRTRLKFGETDILAKVSVRPDGRFQVAFDAPYDSTNSHDFRAAPRLARWPGHITVFEGAVGYTFAVPDPLARSDEAAAASGSLRAPMPGLVKLVRVAKGDAVIKGQPLLILEAMKMEHTIAAPHDGVVAEIATEGAQVTDGTVLVRFVEEQNA

SEQ ID NO: 5026 - DNA, 1962 bp, Rhizobium loti
  CDS (1)..(1962)
atgggcaagctgttctcaaaaatcctcatcgccaatcgcggcgaaatcgcttgccgcgtcatccggacggcgcgcaggctcggtatggcgaccgtcggtgtctactccgatgccgacgcgaaatcgcttcatgtagcaatggccggcgaggcagtgcatatcggcgcctcccccgtcgccgaaagctacctgaaggctgaccgcatcatcgacgcggctctcaagaccggcgcgcaggcgatccacccgggctatggcttcctgtcggaggccccggatttcgtcgagcgggtggaagcggcaggactggtgttcatcggaccgtcggcttcgtcgatccgcgccatgggtctgaaggacgctgccaagcgcctgatggaaataaccggtgtgccggtcgtgccgggttatcatggcgaagcgcaggatcctgccttgctggcctccagggccatagagatcggctttcctgtcctgatcaaggcgcgtgcgggaggcggcggcaagggcatgcgccgtgtcgagactgccggagaattcgccgatgcgctcgcgtcggcgcagcgcgaagcgaaagcctccttcggcgacgacaaggtgttgatcgagaagtacgtagagaagccgcgccacatcgaggtgcaggtcttcggcgacaatcacggcaatggggtccatctcttcgagcgcgactgctccgcccagcgccgccaccagaaggtcattgaggaagcgcctgcccccggcatgacgccggagatgcgcgtggcgatgacccacgccgccgtgaaggccgcgaaggcgatcaattactccggtgccggtacgatcgagttcatcgtcgacgcgtcggagggccttcgcgcggaccgattctggttcatggagatgaatacgcgtcttcaggtcgaacaccctatgacggagatggtgaccggacaggatctcgttgaatggcagatacgcgtcgctgctggcgagctactgccgctcacgcaagatgacatccatctcgacgggcacgcctttgaagcgcggctctacgccgaagacgcatcgcgcggcttcttgccggcgaccggcacattgtatcatctgaggttcccgccggaagcctcgtcgattcgcatagaaaccggtgttcgacagggcgatacgatttcatctttctatgacccgatgatcgccaagatcgtcacgaaaggaagcgaccggaaagatgctctagaactgcttgtcagcgcgctggcagtcactgaggttgccggctcaaccgttaacaccgccttcctttcggcgcttgctcaggacgaagacttcgccaccggcgatgtcgatacgggcctcatcgcgcgcaagcagggggcgttgaccgccctggccgaagcatctgctcgttcgaaggcgctcgcagcgctcagggtcgcaagtgttgacgaggccacgtcgaatgacccctgggccagcctgactggctacgaccatttcggatcgactgccaaagcgatctcgctcggcgagtccggcgagatcagtgtttccctaactgcagagacaaatggcgcttggcgcgctgaggtcgatgaacagactatccgtttctctcccacgtcgctgcccgaagcactcgcatcggccgtcatctggcccggccacgtcaccgtcttcgacggcgcggtcagccacaccttcatcgcccgcgatcctctcgacgaagctgccgatgcttatggtggcgccggcagcctgcgcgcgccgatgcccggtctcgtcaagctcgtgcgcgccaagcccggcttcaaggtcagcaagggcgatccacttcttatcctcgaggcgatgaagatggagcatacgatcacggcacctcatgatggcacgatcgccaagatcgccgccgagggtgcgcaggtcgctgacggaaccgtgcttgtccgcttcgaagagtcgggaggaaactga

SEQ ID NO: 5027 - protein, 653 aa, Rhizobium loti
MGKLFSKILIANRGEIACRVIRTARRLGMATVGVYSDADAKSLHVAMAGEAVHIGASPVAESYLKADRIIDAALKTGAQAIHPGYGFLSEAPDFVERVEAAGLVFIGPSASSIRAMGLKDAAKRLMEITGVPVVPGYHGEAQDPALLASRAIEIGFPVLIKARAGGGGKGMRRVETAGEFADALASAQREAKASFGDDKVLIEKYVEKPRHIEVQVFGDNHGNGVHLFERDCSAQRRHQKVIEEAPAPGMTPEMRVAMTHAAVKAAKAINYSGAGTIEFIVDASEGLRADRFWFMEMNTRLQVEHPMTEMVTGQDLVEWQIRVAAGELLPLTQDDIHLDGHAFEARLYAEDASRGFLPATGTLYHLRFPPEASSIRIETGVRQGDTISSFYDPMIAKIVTKGSDRKDALELLVSALAVTEVAGSTVNTAFLSALAQDEDFATGDVDTGLIARKQGALTALAEASARSKALAALRVASVDEATSNDPWASLTGYDHFGSTAKAISLGESGEISVSLTAETNGAWRAEVDEQTIRFSPTSLPEALASAVIWPGHVTVFDGAVSHTFIARDPLDEAADAYGGAGSLRAPMPGLVKLVRAKPGFKVSKGDPLLILEAMKMEHTITAPHDGTIAKIAAEGAQVADGTVLVRFEESGGN

SEQ ID NO: 5028 - DNA, 3459 bp, Rhizobium loti
  CDS (1)..(3459)
atggccatcacgaagatcctcgtcgccaaccggtcagaaatcgccatccgcgtctttcgcgcggccaatgaactgggcctcaaaaccgtggcgatctgggccgaggaagacaaatattcgctgcaccgcttcaaggccgacgagagctaccaggtcgggcgcggtccgcatctcaccaaggatatggggccgatcgagagctatctgtcgatcgaggaggtgatccgcgtcgcccggctctcgggcgccgatgccatccaccccggctacgggcttctgtccgaaagccccgaattcgccgaagcctgcgcgcaagcgggcatcaccttcatcgggccgaagccggacacgatgcgccgcctcggcaacaaggtcgcggcgcgcaatctcgccatcgaggtcggcgtgcctgtcattcccgccaccgatccgttgccggacgatatggaggcggtcaagaaactggccaaggagatcggctatccagtgatgctcaaggcctcctggggcggcggtgggcgcggcatgcgcgccatccgctccgaggccgatctcgcccgtgaggtcacggaaggcaagcgcgaggcgaaagccgccttcggcaaggacgaggtctatctcgaaaagctgatcgagcgcgcccgccacgtcgaggtgcaggtgcttggcgacacgcatggcaatgccgtgcacctgttcgagcgcgactgctcgatccagcgccgcaaccagaaggtcgtcgagcgggcgccggcgccctatctcgaaatgtcgcagcgcgaggagctttgcggctacgcgctgaagatcgcgcgcgagaccagctatatcggcgccggcacggtcgagttcctgcaggatgccgataccggaaaattctatttcatcgaggtcaacccgcgcatccaggtcgagcataccgtcaccgagcaggtgaccggcatcgatatcgtcaaggcgcagatccacatcctcgacggcttcgccatcggcacaccgcaatcgggcgtgccggcgcagaaggatatcaggctgaacggccatgccttgcagtgccgcatcaccaccgaggatcccgagcacaatttcatcccggactatggccgcatcaccgcctatcgcggcgccaccggcttcggcatccggctggatggcggcaccgcctattctggcgcggtcatcacccgcttctacgatccgctgctggagaaggtgacggcgtgggcgccgacgccggccgagaccattgcccgcatgaaccgggcgctgcgcgaattccgcattcgcggcgttgccaccaacctcaccttcctcgaagcgatcatcaaccacccgagcttcgccgacaattcctacacgaccaagttcatcgacacgacgccggagctgttccagcaggtcaagcggcaggaccgcgcgaccaagctgctcaactatctggccgatgtcagcgtcaacggccatcccgagacgcgcggccggccgacgccgaaggccgatgcggccgcaccggtcgtgccctatctcaacggcaatgtgccgggcggcagcaagcagaagctggacgtgctcggtccggaaaaattcgccggctggatgcgcgaacaaaggcaagttctggtcaccgatacgacgatgcgcgacggccaccagtcgctgctcgcgacgcgcatgcgcacgcacgacattgccaatattgccggcacctatgcgcgcgccctgccgcagcttctgtcgctcgaatgctggggcggcgcgaccttcgacgtcgccatgcgcttccttaccgaggatccttgggagcggctgtcgctggtgcgcgaggcggcgcccaacctgttgctgcagatgctgctgcgcggcgccaacggcgtcggttacaccaattatcccgacaatgtcgtgcagcatttcgtcaagcaggcggcgagcggcggtatcgacctgttccgcgtcttcgactgcctgaactgggtcgagaacatgcgcgtcgccatggacgcggtcggcgccgaaggcaagctgatcgaagcggcgatgtgctacaccggcgacattctcgatccggcgcgggccaaatacgatctgaaatattatgtcggcctggccagcgaattgcaggccgccggcgcccacatcatcgccgtcaaggacatggccggcctgttgaagcccgccgccgcccgcgtgctgttcaaggcgctgcgcgaggcgaccgacctgccgatccatttccatacccacgacacgtctggcctgtcggcggcgaccgtgctggcggcggttgagagcggcgtcgacgccatcgatgcggcgatggacgccttctccggcaacacgtcgcagccttgcctgggctcgatcgtcgaggcgctgaagggcaccgagcgcgacccgggcctcgacccgcaatggatccgcaagatctcgttctactgggaagcggtgcgcaaccagtacgccgccttcgaaagcgacctcaaagggccggcttcggaagtctacctgcatgaaatgccgggcggacaattcaccaacctcaaggagcaggcgcgctcgctcgggctggaaacgcgctggcatgaggtggcgcagacctatcacgacgtcaatctgatgttcggcgacatcgtcaaggtgacgccgtcatccaaggtcgtcggcgacatggccctgatgatggtcagccaggacctgaccgtcgccgatgtcgagaacccggccagggatattgccttcccggactcggtcgtctcgatgctgcgcggcgatctcggccagtcgcccggcggttggccggcggcgctgcagaagaaggcgctgaaaggcgacgagccgatcacggcacggccaggctcgctgctcaagcccgccgatctcaaggccagccgcaaggagatcgaggagaagctcgagcgcaagctctcggaatacgaattcgcctcctggctgatgtatccgaaggtgttcactgacttcgccggcgcgcaggaaacctacggcccggtcagcgtcctgccgacgccgacctatttctacggcatgaaatcggaagacgagatcttcatcgacatcgagaagggtaagacgctggtcgtgcggtgccttgccatcggcgatgtggacgacaagggcatggtcacggtgttcttcgagctcaacggccagccacggcgcgtgaaggtgccggaccgggcgcatggcgcctccgccgccaaggcgcgccgtaaggccgagcctggcaacgaggcgcatgtcggcgcgccgatgccgggcgtggtttcggcgctttcggtcgccacggggcaagcggtgaaagccggtgacgtgctgctgtccatcgaggcgatgaagatggaaacggcgctgcatgccgagcgtgacggcaccgtcgccgaggtgctggtcaaggccggcgaccagatcgatgccaaggatctgctgatagccttcgcttga

SEQ ID NO: 5029 - protein, 1152 aa, Rhizobium loti
MAITKILVANRSEIAIRVFRAANELGLKTVAIWAEEDKYSLHRFKADESYQVGRGPHLTKDMGPIESYLSIEEVIRVARLSGADAIHPGYGLLSESPEFAEACAQAGITFIGPKPDTMRRLGNKVAARNLAIEVGVPVIPATDPLPDDMEAVKKLAKEIGYPVMLKASWGGGGRGMRAIRSEADLAREVTEGKREAKAAFGKDEVYLEKLIERARHVEVQVLGDTHGNAVHLFERDCSIQRRNQKVVERAPAPYLEMSQREELCGYALKIARETSYIGAGTVEFLQDADTGKFYFIEVNPRIQVEHTVTEQVTGIDIVKAQIHILDGFAIGTPQSGVPAQKDIRLNGHALQCRITTEDPEHNFIPDYGRITAYRGATGFGIRLDGGTAYSGAVITRFYDPLLEKVTAWAPTPAETIARMNRALREFRIRGVATNLTFLEAIINHPSFADNSYTTKFIDTTPELFQQVKRQDRATKLLNYLADVSVNGHPETRGRPTPKADAAAPVVPYLNGNVPGGSKQKLDVLGPEKFAGWMREQRQVLVTDTTMRDGHQSLLATRMRTHDIANIAGTYARALPQLLSLECWGGATFDVAMRFLTEDPWERLSLVREAAPNLLLQMLLRGANGVGYTNYPDNVVQHFVKQAASGGIDLFRVFDCLNWVENMRVAMDAVGAEGKLIEAAMCYTGDILDPARAKYDLKYYVGLASELQAAGAHIIAVKDMAGLLKPAAARVLFKALREATDLPIHFHTHDTSGLSAATVLAAVESGVDAIDAAMDAFSGNTSQPCLGSIVEALKGTERDPGLDPQWIRKISFYWEAVRNQYAAFESDLKGPASEVYLHEMPGGQFTNLKEQARSLGLETRWHEVAQTYHDVNLMFGDIVKVTPSSKVVGDMALMMVSQDLTVADVENPARDIAFPDSVVSMLRGDLGQSPGGWPAALQKKALKGDEPITARPGSLLKPADLKASRKEIEEKLERKLSEYEFASWLMYPKVFTDFAGAQETYGPVSVLPTPTYFYGMKSEDEIFIDIEKGKTLVVRCLAIGDVDDKGMVTVFFELNGQPRRVKVPDRAHGASAAKARRKAEPGNEAHVGAPMPGVVSALSVATGQAVKAGDVLLSIEAMKMETALHAERDGTVAEVLVKAGDQIDAKDLLIAFA

SEQ ID NO: 5030 - DNA, 2013 bp, Rhizobium loti
  CDS (1)..(2013)
atgttcacgaaaatcctgatcgccaaccgtggcgagatcgcctgtcgcgtcatcaagacggcgcgcaagatggggattgccacggtcgctgtctattccgatgccgatcgcgatgccgtgcatgtcgagatggccgacgaggcggtgcatatcgggccttcgcccgccgcgcagagttatcttgtccctgaaaagatcatcgccgcctgcaaggaaaccggggctcaggccgtgcatcccggttatggcttcctgtccgaacgcgccgccttctgcgaggcgctggagaaggaaggcatcgtcttcatcggtccgaagcccaaggcgatcaaggcgatgggcgacaagatcgaatcgaagaaattcgccaacgccgccaaggtttcgaccgtgcccggctggctcggcgtcatcgagaatgccgaccatgccgaaaagatcgccggcgagatcggctatcccgtgatgatcaaggcctcggccggcggcggcggcaagggcatgcgcatcgcctggaaccagtcggaagtgcgcgacggcttcgaccgggcgcgctcggaagccaagagctcgttcggcgatgaccgcgtgttcatcgaaaaattcgtcgtcgatccgcgccatatcgaaatccaggtgctggccgacgcgcatggcaatgcgctctatctcggcgagcgtgaatgctcgatccaacgccgcaaccaaaaggtcgcggaagaggcgccgtcgccattcctcgacgccaagacgcgcaaggccatgggcgagcagtcggtggcgctagccagggccgtcgactatcagagtgccggcacggtcgagttcatcgtcgacaaggacaagaacttctatttccttgaaatgaatacacgattgcaggtcgagcatccggtgacggagctcgtcaccggcatcgatctggtcgagcagatgatccgcgtcgccgccggcgaaaaactctctttgaagcaaagcgacatcaagctgaatggctgggccgtggaaagccggctctatgccgaggatccctatcgcaatttcctgccgtcgatcggccggctgacgcgctaccggccgccggaggaggggcaattcggcgatgtcgtcatccgcaacgataccggcgtcaccgaaggctccgagatttcgatgttctatgacccgatgctcgccaaattgtgtacctgggctccgacgcgcatcgaggcgatcgatgccatgtcggaagtgctcgacagttttgtggtcgatggcatcgagcacaatatcccgttcctggccgcgctgatgcagcatccgcgctggcgggaaggggcaatatcgaccggcttcatagccgaggaatatcccgacggttttgcgcctgtcgtgccgaacagccgggaaaaggccgtgctggcctcgatcgtgaccgcggtggaactgctgcgccgcgaccggctcgaccggctgggcgggcggttggcgccgcattcgggagtactcaagcgcgattgggtcgtgaggctcggcgacgactatctccaggcgtccatcctcgaaggcatgatttccattccgatggagatcgacctgtcgatcgatggcggcaaggcgctgaccgtttcatccgactggcggccaggcgacctgatctggcgcggcacggtcggcaagcgctccgtcgtcgcccagatccggcctgtcgccaacggtcttcgcatcgcctggaaaggcatgtcggtgaccgcgcgcgccatgctgccgcgcatcgccgagctggagcggcttatgccggagaaggtggcgccggacacgtcgaaactgctgctttgcccgatgcccggcctcgtcgtgtcgatcgctgtcaccgagggccaggaggtgaaggccggcgagaccttagccgtggtcgaggcgatgaagatggaaaacgtgctgcgcgccgaacgcgatctcgtcgtgtcgaaattgaacgccaagccgggcgacagtctggccgtcgacgcggtgatcatggaattcgcctga

SEQ ID NO: 5031 - protein, 670 aa, Rhizobium loti
MFTKILIANRGEIACRVIKTARKMGIATVAVYSDADRDAVHVEMADEAVHIGPSPAAQSYLVPEKIIAACKETGAQAVHPGYGFLSERAAFCEALEKEGIVFIGPKPKAIKAMGDKIESKKFANAAKVSTVPGWLGVIENADHAEKIAGEIGYPVMIKASAGGGGKGMRIAWNQSEVRDGFDRARSEAKSSFGDDRVFIEKFVVDPRHIEIQVLADAHGNALYLGERECSIQRRNQKVAEEAPSPFLDAKTRKAMGEQSVALARAVDYQSAGTVEFIVDKDKNFYFLEMNTRLQVEHPVTELVTGIDLVEQMIRVAAGEKLSLKQSDIKLNGWAVESRLYAEDPYRNFLPSIGRLTRYRPPEEGQFGDVVIRNDTGVTEGSEISMFYDPMLAKLCTWAPTRIEAIDAMSEVLDSFVVDGIEHNIPFLAALMQHPRWREGAISTGFIAEEYPDGFAPVVPNSREKAVLASIVTAVELLRRDRLDRLGGRLAPHSGVLKRDWVVRLGDDYLQASILEGMISIPMEIDLSIDGGKALTVSSDWRPGDLIWRGTVGKRSVVAQIRPVANGLRIAWKGMSVTARAMLPRIAELERLMPEKVAPDTSKLLLCPMPGLVVSIAVTEGQEVKAGETLAVVEAMKMENVLRAERDLVVSKLNAKPGDSLAVDAVIMEFA

SEQ ID NO: 5032 - DNA, 1347 bp, Pasteurella multocida
  CDS (1)..(1347)
atgttagagaaagtggttattgccaatcgtggtgaaattgcgctacgtattttgcgtgcttgcaaagaattaggcataaaaactgttgcggtgcattccacagcagaccgtgaattgaaacatgttttacttgcagatgaaactgtttgtattggtcctgcgccttcaacgaaaagttatcttaatattccggctatcattgcagcggctgaagtaacaggtgcggatgccattcaccctggttatggttttttatctgaaaatgcagattttgcggagcaagttgaacgttctggatttatttttattggtcccactgcagacgtgatccgtttaatgggtgacaaagtttctgcgattgaagcaatgaagaaatcaggtgtaccttgtgtaccgggctctgatggtcctgtgggtagcgatatggtaaaaaataaagaaatcgccaaacgtattggttaccctgtgattattaaagcttcaggcggcggtggtggtcgtggtatgcgtgtagtgcgtgatgaggcctctttagaagaatctatcgcgatgaccaaagcagaagcaaaagcggcttttaataacgatatggtgtatatggaaaaatacctagaaaatccacgtcatattgaaattcaagtcttagccgatacccatggtaatgccatttatttagcggagcgtgattgctcaatgcaacgtcgccatcaaaaagtagtagaagaagccccagcaccgggtatttccgatgaagttcgtcgtgatattggtgaacgttgtgccaaagcatgcgtagaaattggttatcgtggggcaggtacgtttgagttcttgtatgaaaatggggagttctatttcattgagatgaatacccgtattcaagtagaacatccagtcacagaaatgatcacgggtgtggacttggtgaaagaacaattgcgtatcgcagccggattgccgatctccattaagcaagaagatgtgaaagtgcgtggtcatgcgatcgaatgccgtattaatgcagaagatcctaaatccttcttgccttcaccgggtaaggtggatcatttacactctccgggtggattaggtgtgcgttgggattcacatgtttatgcgggttataccgtcccaccacattatgattcaatgattgcaaaattgattacttatggtgatactcgtgaagtcgcgattcgtcgtatgcaaaatgcactgggtgaaacgattttaaccggtattaaaaccaatattcctctgcacgaattgattctggcagatgaaaattttcaacagggtggcacgaatatccattacctagagaaaaaacttggcatgcgtgactaa

SEQ ID NO: 5033 - protein, 448 aa, Pasteurella multocida
MLEKVVIANRGEIALRILRACKELGIKTVAVHSTADRELKHVLLADETVCIGPAPSTKSYLNIPAIIAAAEVTGADAIHPGYGFLSENADFAEQVERSGFIFIGPTADVIRLMGDKVSAIEAMKKSGVPCVPGSDGPVGSDMVKNKEIAKRIGYPVIIKASGGGGGRGMRVVRDEASLEESIAMTKAEAKAAFNNDMVYMEKYLENPRHIEIQVLADTHGNAIYLAERDCSMQRRHQKVVEEAPAPGISDEVRRDIGERCAKACVEIGYRGAGTFEFLYENGEFYFIEMNTRIQVEHPVTEMITGVDLVKEQLRIAAGLPISIKQEDVKVRGHAIECRINAEDPKSFLPSPGKVDHLHSPGGLGVRWDSHVYAGYTVPPHYDSMIAKLITYGDTREVAIRRMQNALGETILTGIKTNIPLHELILADENFQQGGTNIHYLEKKLGMRD

SEQ ID NO: 5034 - DNA, 4000 bp, Brachydanio rerio
  CDS (25)..(3567)
tgaatctggacctggctagacaagatgctactgcatttaggagggtccagagcgaagacgggaatcctgctcatcagaagagctggtttgttttgtcgttcagcccacctgtcttcccaaaccctggagtatcacccaatcaaaaaggtcatggtagcaaatagaggtgaaatagccatccgtgtgttccgggcatgcacagagctcgggatccggacagtggctgtatactcagagcaggacacgggacagatgcacagacagaaggcagatgaggcatacctcattggcagaggcctgtcccccgttgcagcctatctccatatccctgacataattaaagtggctaaggaaaataatgtggatgccatccaccctggttatggctttttatcagagcgtgcagactttgcccaagcctgtgctgaagctggggtgagattcattggtccttccccagaggttgtacgcaagatgggggataaagtggaagcccgtgctctggccataaaagcaggtgttccagttgttcccggaacagatgctcctatctcatgccttcaagaggctcaagaatttgccaaaacatatgactttcccatcatctttaaagctgcatatggaggaggaggccgtggaatgagggtcgtcagaaattatgaggaactagaggaaaactaccagagagcctattcagaggctttagcagcatttggtaatggtgctctgtttgttgagaagttcattgagaaaccacgacacattgaagtgcaaattcttggtgataaatatgggaatgtgattcatctgtatgagagggattgctcaattcagagaagacatcagaaagtggtagagattgctcccgctgcccacctcgactctcatctcagagacagactgaccttagactcggtcaacttagccaaacaggtgggctatgagaacgctggcacagtggagttcctcgtggacaaacatggaaagcactacttcatcgaggtgaactcccgtctacaggtggaacatacagttacagaggagatcactgatgtggatttggttcacgcacaactgcgtgtgtgtgagggccgcagtcttcctgagctgggtctcgaacaggacaagatccagatcaacggctgtgccatacagtgccgggtcactacagaagatccctcccgtggttttcagccagacacaggtcgcatagaggtgttccgcagtggagagggtatgggtatacggctagacagtgcatctgcctttcaaggcgccatcatatcccctcactatgactcactgttggttaaagtcatagccagtggcaaagaccttcccaccgctgcaaccaaaatgcacagagcactaaccgagttcagagttcgtggtgttaagactaatattccattcctgcaaaatgtactgagcaacagccagttcctgtatgccacagttgacacacagtttattgatgagaaccagaatcttttcaacctcaaacctacacagaacagagcacagaaactcctgcactatctgggtcacgtaatggtaaatggacccatgacacctattccagtaaaagccaaaccatcacctgttgatccagtcattccttctgtttctctgggtgagccgcccctggggtttcgtgaagttttattgagggagggtcctgaaggttttgcaagggcaattagacagcaccagggtcttctactgatggacaccaccttcagagatgcccaccaatccctactggccacgcgcgtcaggacacatgacctcaaaaagattgctccctatgtgagccacaacttcagcaacctcttcagcctggagaactggggaggggctacatttgatgcagcaatgcgttttctgtcagagtgtccatggaagagacttcaggagcttagagctctgattcctaatgtcccgtttcagatgctgctacgtggagctaatgctgtaggatacacaaactaccctgataatgccgtgttcaaattttgtgaggttgccaaagagaacggaatggatatatttcgtgtttttgactccttgaattatattcccaacatgcttttggggatggaggctgcaggggcagcgggaggtgtagtggaagcagccatttcttacacaggagatgtgtctgaccccatgagacagaaatattcactggactactatctgaagctggccgatgagctagttaaagctggaacacacatactatctattaaggatatggctggccttctgaagccccaagccagccgtttactaattgaagcattgagagatcgtttccctgacattcccattcatgtgcacactcacgatacagcaggggctggagtagcagctatgttagcctgtgcacaagcaggagctgatatagtagacgtagctgtggactcaatggctggcatgacttctcaaccgagcatgggtgccatcgtagcctgcaccaaaggaaccaaacttgatactgggatttctctggacaaagtgtttgactacagcgagtactgggaagtggctcgtggtctgtatgctccctttgactgcactgccacaatgaagtctggtaatgcagatgtttatgaaaatgagatcccagggggccagtacaccaacctacacttccaggcccacagcatgggcctcggtaacaagttcaaagaggtgaagaaagcctatactgaagccaacaagctgctgggagaccttatcaaagtgaccccctcctctaagattgtgggcgatctggctcagtttatggtgcaaaacctctctcgtgctgaagtggaaaagagagcagacgagctctccttccctctctctgttgtggagttcctgcaaggacacattgggataccacatggaggattccctgaacccttcaggtcaaaggtgctcaagtcattgcctcgaattgaaggtcgtccaggggcttcgctaccaccgatggactttgaggctcttgaatctggtcttcgagcagcacacggggatgaaatcactcctgaagatgtgatgtcagcagccatgtaccctaaagtcttccaggagtttaaagagtttacatcaacctttggtccggtggactgccttaatactcgtctgtttctggatggccctaaaatcgcagaggagtttcaggtcgagttggaaagagggaaaattctgcatatcaaagcattggccttgggtgacttgaacaagtctggtcagagagaggtgttttttgaactcaacggccagttgcgttcagtcttggtcaaggatacagcagcaatgaaggagatgcactttcaccctaaagccttgaaagacgtccggggacaggttggagcgcctatgcctggtaaagtggtggaagtaaaggtgaaggcaggccagaaggtggagaaaggtcagcctctctgcgtcctcagtgcaatgaagatggagacagtcgtcaactcgccaatctctggcatcatttccaaggtgcatgtcaatgccgacagcagcctggaaggggaagatcttatcttagaaataactgaataaagtttgtttttttaaatcccagcttaaaggctgctcttcagaaggccagttttagagtatttctgtaattcagtggacagatggtgttgtaattgcgaatgattttaagatttctactcttctaagggttctagggtcaagaattccaagggtcaaattcaaaaacttactaaaaaataactgctgctattttaaaacagaagcatatttttcggtatatgcaaccaagaactagagaaggctttggtattcggtttaacaacagaaaagatttttctttatttttctttttttcttttttttttaagttaattaaaaaggttagttataattcaaacaacagtatctgatttacatggatgtttgtgcactgtatttgtgtgagagagagtttgaagaggacagcagtttcatattaacgtcgtattagtgg

SEQ ID NO: 5035 - protein, 1180 aa, Brachydanio rerio
MLLHLGGSRAKTGILLIRRAGLFCRSAHLSSQTLEYHPIKKVMVANRGEIAIRVFRACTELGIRTVAVYSEQDTGQMHRQKADEAYLIGRGLSPVAAYLHIPDIIKVAKENNVDAIHPGYGFLSERADFAQACAEAGVRFIGPSPEVVRKMGDKVEARALAIKAGVPVVPGTDAPISCLQEAQEFAKTYDFPIIFKAAYGGGGRGMRVVRNYEELEENYQRAYSEALAAFGNGALFVEKFIEKPRHIEVQILGDKYGNVIHLYERDCSIQRRHQKVVEIAPAAHLDSHLRDRLTLDSVNLAKQVGYENAGTVEFLVDKHGKHYFIEVNSRLQVEHTVTEEITDVDLVHAQLRVCEGRSLPELGLEQDKIQINGCAIQCRVTTEDPSRGFQPDTGRIEVFRSGEGMGIRLDSASAFQGAIISPHYDSLLVKVIASGKDLPTAATKMHRALTEFRVRGVKTNIPFLQNVLSNSQFLYATVDTQFIDENQNLFNLKPTQNRAQKLLHYLGHVMVNGPMTPIPVKAKPSPVDPVIPSVSLGEPPLGFREVLLREGPEGFARAIRQHQGLLLMDTTFRDAHQSLLATRVRTHDLKKIAPYVSHNFSNLFSLENWGGATFDAAMRFLSECPWKRLQELRALIPNVPFQMLLRGANAVGYTNYPDNAVFKFCEVAKENGMDIFRVFDSLNYIPNMLLGMEAAGAAGGVVEAAISYTGDVSDPMRQKYSLDYYLKLADELVKAGTHILSIKDMAGLLKPQASRLLIEALRDRFPDIPIHVHTHDTAGAGVAAMLACAQAGADIVDVAVDSMAGMTSQPSMGAIVACTKGTKLDTGISLDKVFDYSEYWEVARGLYAPFDCTATMKSGNADVYENEIPGGQYTNLHFQAHSMGLGNKFKEVKKAYTEANKLLGDLIKVTPSSKIVGDLAQFMVQNLSRAEVEKRADELSFPLSVVEFLQGHIGIPHGGFPEPFRSKVLKSLPRIEGRPGASLPPMDFEALESGLRAAHGDEITPEDVMSAAMYPKVFQEFKEFTSTFGPVDCLNTRLFLDGPKIAEEFQVELERGKILHIKALALGDLNKSGQREVFFELNGQLRSVLVKDTAAMKEMHFHPKALKDVRGQVGAPMPGKVVEVKVKAGQKVEKGQPLCVLSAMKMETVVNSPISGIISKVHVNADSSLEGEDLILEITE

SEQ ID NO: 5036 - DNA, 1386 bp, Streptomyces sp
  CDS (1)..(1386)
atgttcgagaaggtactcatcgccaaccgcggcgagatcgcgctgcgtgtcgccgcgacctgtcgggagctcggcatccggaccgtcgtcgtgcactccgatgccgaccgccactccgccgccgtgcggttcgcggacgaggccgtgtgcgtcggccccgccccgccgcgcgccagctacctcaacgccgccgccgtgctccaggccgccgtgcagaccggcgtcgaggcggtccaccccggctacggattcctgtccgaggacccggacttcgccgaggcgtgcgaggacgagggcatcaccctcatcggcccgcccgccgaggtgatgtcgcggctcgggaacaaggcgtccgcccggtcgatcatgtcgcaggccggccttccgctgctgcccggcagcctcgacccgctctccgaccgcgaggcgcacgcgctcgccgacacgatcggctaccccgtcatcgtcaaggcggcggccggcggcggcgggcgcggcatgtcggtggtccactccagcgacgacttccccgacacgttccgccgcacccaggccaccgcgttggcggtgttcggcgacgggcgggtgtacgtcgagcgctacctgcccgaggcccggcacgtcgagatccaggtgctcgccgaccgctacggcaacgtcgtccacctgggcgaacgcgactgctccgtgcagcgccggcaccagaagctcgtcgaggagacgcccgggccccggcttccggacggcctcgccgcccggatgggcgaggcggccgtcgccggggcgcgcgcggtcggctacgtcggcgccggcacgttcgagttcctgctcgcgcccgacggaacgttctccttcatggaggtcaactgccgtatccaggtcgagcacccggtcacagagatggtcaccggcatcgacctggtgcgcgagcagatcctggtcgccgccggccgtccgctgacggtgcgccaggaagacatccgacccaacggcgtgtccatggagtgccgcatcaacgccgaggacccgacgcgcggattcgtgccgacgccagggctgatcgacacgttcacgcccgccggcggcccgttcgtgcgcgtcgacacacacgtgcacgccgggtacaccgtgcccgcgtcgtacgactcgctgctggccaagctcgtggtgtgggcaccggaccgcgaacaggccctcgcccgcatgcgccgcgcgctcgaccagttcgaggtcgagggccaacgggtgcgcaccaccatcgggttcctgcgcgaggtgttcgacaacgacaagttcgccgccggacgccacagcacctccctcgtcgacgagatgctcgccgccgaggcccggaacgcgcggacgggagtgcccctgtccgcgtga

SEQ ID NO: 5037 - protein, 461 aa, Streptomyces sp
MFEKVLIANRGEIALRVAATCRELGIRTVVVHSDADRHSAAVRFADEAVCVGPAPPRASYLNAAAVLQAAVQTGVEAVHPGYGFLSEDPDFAEACEDEGITLIGPPAEVMSRLGNKASARSIMSQAGLPLLPGSLDPLSDREAHALADTIGYPVIVKAAAGGGGRGMSVVHSSDDFPDTFRRTQATALAVFGDGRVYVERYLPEARHVEIQVLADRYGNVVHLGERDCSVQRRHQKLVEETPGPRLPDGLAARMGEAAVAGARAVGYVGAGTFEFLLAPDGTFSFMEVNCRIQVEHPVTEMVTGIDLVREQILVAAGRPLTVRQEDIRPNGVSMECRINAEDPTRGFVPTPGLIDTFTPAGGPFVRVDTHVHAGYTVPASYDSLLAKLVVWAPDREQALARMRRALDQFEVEGQRVRTTIGFLREVFDNDKFAAGRHSTSLVDEMLAAEARNARTGVPLSA

SEQ ID NO: 5038 - DNA, 1344 bp, Gamma
  CDS (1)..(1344)
atgagttataaagttcttattgccaatcgtggtgagattgctcttcgagctataagagcttgtaaagagcttggtatcaagacagtatctgtttactcagaagctgataaagatctaaaacatttaagattctctgatgaaactgtttgtattgggcctgcatctccaactcaaagctacctaaatatacctgccattctctcagctgcagaacttacaagtgctaatgctatatatcctggatatgggttccttgcagaagatcataattttgcagaaatgtgtgaaaaaagtggatttaaatttattgggccaacctcagaaacaatccaaaaaatgggcgacaaaataacagcaaaaacactggctgaaaaatctggaattcaaatcgttccaggttataaagatgagattccatctgataatgatgagtttaaaaaaattgctagagatatcggctatccaattatgattaaggcaacggctggtggcggtggaagaggaatgagagttgttgaaagagaggaagatcttattggacatgcagaaataacaatgcaggaagctaaaaatggattcggcaatgaaaccatttatctagaaaaatttattgggaaccctagacatattgaagttcaaatagttggtgatggtaaaggaaaggcgatacatttaggtacaagggattgcagtatgcagaggagacatcaaaaaataattgaggaagctccagcacttaatataaatcaagaagctcttaataaaacactaatagcttgtgtcaatttatgtgaagaaataaattacgaaggggttggcactattgaatttttatacgaagataatcaattctattttatagaaatgaatacaagaattcaggttgaacatccggtaacagaaatgataactggctttgatttagtaaaagcacaactaagaattgctcttgaaatgccaattgagctaaatcaagatgatattaattttcatggccactcactagaatgcagaattaatgcagaagatcctgataattttcaaccatccccaggaacaattacaaaaatgcatacacctggcggttttggcataagatatgactcacatatttatggaggatatagagttccccctaactatgattcacttctagcaaaaatcattactcaggcaaattctagaagctcggctattaagagaatgctgagtgctttagatgaattttttatagagggcattaaaacaaatcaccctcttcatcaaaggattctgcatgatgatacctttaaagaaaataaacatactattaattacttagaaaatgagttcctaaaaaaatga

SEQ ID NO: 5039 - protein, 447 aa, Gamma
MSYKVLIANRGEIALRAIRACKELGIKTVSVYSEADKDLKHLRFSDETVCIGPASPTQSYLNIPAILSAAELTSANAIYPGYGFLAEDHNFAEMCEKSGFKFIGPTSETIQKMGDKITAKTLAEKSGIQIVPGYKDEIPSDNDEFKKIARDIGYPIMIKATAGGGGRGMRVVEREEDLIGHAEITMQEAKNGFGNETIYLEKFIGNPRHIEVQIVGDGKGKAIHLGTRDCSMQRRHQKIIEEAPALNINQEALNKTLIACVNLCEEINYEGVGTIEFLYEDNQFYFIEMNTRIQVEHPVTEMITGFDLVKAQLRIALEMPIELNQDDINFHGHSLECRINAEDPDNFQPSPGTITKMHTPGGFGIRYDSHIYGGYRVPPNYDSLLAKIITQANSRSSAIKRMLSALDEFFIEGIKTNHPLHQRILHDDTFKENKHTINYLENEFLKK

SEQ ID NO: 5040 - DNA, 4218 bp, Mycobacterium smegmatis
  CDS (600)..(3983)
ccgagcgcggtgtgggtgctgatcgccggtgtgctgggcctcgcggcgtcactgacgctgacggtcgagaagatcgaactgctgatcaatcccgactacgtgccgtcgtgcagcatcaacccggtgctgtcgtgcggttcggtgatggtcacctggcaggcgtcgctgttcggattcccgaacccgctgatcggcatcgtggccttctcggtcgtcctggtgacgggcgtgctcgcggtcgccggggtgcgtctgccgcgctggtactgggccgggctcgcgacgggcaccgcgctgggagcggtgttcgtgcactggctgatcttccagagcctgtaccgcatcggggccctgtgcccctactgcatggtggtgtgggccgtgacgatcccgctggccgtggttacggccgtcatcgcgctgcgcgcgcgggccggcgacgcggacgcgggtcccggcaacatcgtccaccagtggcgatggtccctggtggcgctgtggttcaccgcacttgtgcttttgatcctggtgcggttctgggaatactggtcaacactgctttgacaatccggaaatagacacagcggttagggttacgcatgatctccaaggtgctcgtcgccaaccgcggcgaaatcgcgatccgcgcattccgtgctgcgtacgagatgggcatcgccacggtggcggtgtatccgtacgaggaccggaattcgctccatcggctcaaggccgacgagtcatatcagatcggcgaggtgggtcatcccgtccgcgcgtatctgtcggtcgacgagatcatccgcgtcgccaagcattcgggcgccgacgcggtgtacccgggctacggcttcctgtcggagaaccccgatctggcggccaagtgcgccgaggcgggtatcacgttcgtgggaccgtccgccgaggtgctgcagctcacgggtaacaaggcacgcgcgatcgccgcggcgcgcgccgcgggccttcccgtgctgagttcgtcggagccgtcgtcgtcggtggacgagttgatggccgctgccgccgacatggagttcccgctgttcgtcaaggcggtctcgggtggcggcgggcgcggcatgcgccgcgtcaccgaccgcgagtccctggccgaggcgatcgaggcggcctcgcgggaggccgagtcggcgttcggcgacgcgtcggtgtacctggagcaggccgtgctcaacccgcgtcacatcgaggtgcagatcctcgccgacggcgcgggcaacgtcatgcacctgttcgagcgtgactgcagcgtgcagcgcaggcatcagaaggtcgtcgagctggcgcccgcgcccaacctgagtgacgaactgcgccaacagatctgcgccgacgccgtggccttcgcgcgccagatcgggtactcgtgcgcgggcaccgtcgagttcctgctcgacgagcgcggccatcacgtgttcatcgagtgcaatccgcgaatccaggtggagcacacggtgaccgaggagatcaccgacgtggacctggtgtcctcgcagttgcgcatcgccgcgggcgagacgctcgccgatctcggtctgtcccaggaccggctcgtggtgcgtggcgcggccatgcagtgccgcatcaccaccgaggtcccggccaacggcttccgacccgacaccggccgcatcaccgcgtaccgctcgccgggcggcgcgggcatccgcctcgacggcggcaccaacctgggtgcggagatctcggcgcacttcgactccatgctggtcaagctgacgtgccggggacgcgacttctcggccgcggcctcgcgcgcgcgccgcgccctggcggagttccgcatccgcggtgtgtcgaccaacatcccgttcctgcaggcggtcatcgacgatccggacttccgcgccggacgggtgacgacgtcgttcatcgacgaccggccgcatctattgacctcgcggtctcctgccgaccgcggcaccaggatcctcaactacctggccgacatcacggtcaacaagccgcacggcgaacggccttcgacggtttacccgcaggacaagctgccgccgctggatctgcaggcgccgccgcccgcgggatccaaacagcgcctcgtggaactggggcccgagggtttcgcgggctggctgcgcgaatccaaggccgtcggcgtcaccgacacgacgttccgcgacgcgcaccagtcgctgctggccacgcgtgtgcgcaccaccggtctgctgatggtggcgccgtacgtcgcacgctccatgccgcagttgctgtcgatcgagtgctggggcggcgcgacctacgatgtggcccttcgcttcctgaaggaagacccgtgggagcggctggcggcgctgcgcgagagcgtgcccaacatctgcctgcagatgctgctgcggggacgcaacaccgtgggctacacgccgtacccggaactggtcacctcggcgttcgtcgaggaggccgcggcgaccggtatcgacatcttccggatcttcgacgcgctcaacaacgtcgagtcgatgcggcccgcgatcgacgcggtgcgggaaaccggttcgaccatcgccgaagtcgcgatgtgctacacgggcgacctcagcgatcccgcggagaacctctacacgctcgactactacctgaagctggccgagcagatcgtcgaggccggcgcccacgtgctggcgatcaaggacatggccggtctgctgcgcgccccggccgcccacacgctcgtgagcgcgttgcgcagccggttcgatctgcccgtgcacgtgcacacccacgacaccccgggcggtcagctcgcgacgtacctcgcggcgtggtcggccggcgcggacgcggtggacggcgcctcggcgccgatggccgggaccacgagccagcccgcgctgagctcgatcgtcgcggcggccgcgcacacccagtacgacacgggcctggacctgcgtgcggtgtgcgaccttgagccctactgggaggcggtgagaaaggtctacgcgccgttcgagtccgggctgcccgggccaaccggccgcgtctacacccacgagattcccggtgggcagttgagcaacctgcgtcagcaggccatcgcgttgggcctcggcgaccggttcgaggagatcgaggccaattacgctgcggccgaccgggttctgggacggctcgtgaaggtgaccccgtcgtcgaaggtggtcggggacctggcgctggcgctcgtgggtgcgggcatcaccgccgaggagttcgccgaggatcccgcgaagtacgacatccccgacagcgtgatcggcttcctgcgcggtgaactcggggatccgccgggcggatggccggaaccgttgcgcaccaaggcgctccagggccgcggaccggcccggccggtcgagaagctgaccgccgacgacgaggcgttgctcgcccagcccgggcccaagcggcaggccgcgttgaaccgcctgcttttccccgggcccaccgccgagttcgaggcgcaccgcgaaacctacggcgacacctcatccctcagcgcgaaccagttcttctacgggctgcgctacggcgaggagcaccgcgtgcaactcgaacgtggcgtggaactgctgatcgggcttgaggcgatctcggaggccgacgagcgcggcatgcgcaccgtgatgtgcatcatcaacggtcagctgcgcccggttctcgtgcgcgaccgcagcatcgccagcgaggtgcccgccgccgaaaaggccgaccgcaacaatgccgaccacatcgccgcgcccttcgccggtgtggtgaccgtcggtgtcgcagaaggtgactcggtggacgcgggacaaaccatcgcgacgatcgaggcgatgaagatggaggccgccatcaccgcgcccaaggcaggcaccgtcgcgcgcgtcgcggtcgcggcgaccgcccaggtcgagggcggcgatctgctggtggtggtcagctgacccggatcatcgcgggctttctgggtggccgacgcatcgaggtgcccaagagcggtacccggcccacctccgaccgggtgcgcgaggcggtgttcaacgccctggccgcgcgtctggacttcgctggtctggccgtgctcgatctgtacgccggatcgggcgcccttgggctggaggcgatttcgcgtggcgcgagctcggcgttgttcgtcgagtccgatcagcgtgcggccgc

SEQ ID NO: 5041 - protein, 1127 aa, Mycobacterium smegmatis
MISKVLVANRGEIAIRAFRAAYEMGIATVAVYPYEDRNSLHRLKADESYQIGEVGHPVRAYLSVDEIIRVAKHSGADAVYPGYGFLSENPDLAAKCAEAGITFVGPSAEVLQLTGNKARAIAAARAAGLPVLSSSEPSSSVDELMAAAADMEFPLFVKAVSGGGGRGMRRVTDRESLAEAIEAASREAESAFGDASVYLEQAVLNPRHIEVQILADGAGNVMHLFERDCSVQRRHQKVVELAPAPNLSDELRQQICADAVAFARQIGYSCAGTVEFLLDERGHHVFIECNPRIQVEHTVTEEITDVDLVSSQLRIAAGETLADLGLSQDRLVVRGAAMQCRITTEVPANGFRPDTGRITAYRSPGGAGIRLDGGTNLGAEISAHFDSMLVKLTCRGRDFSAAASRARRALAEFRIRGVSTNIPFLQAVIDDPDFRAGRVTTSFIDDRPHLLTSRSPADRGTRILNYLADITVNKPHGERPSTVYPQDKLPPLDLQAPPPAGSKQRLVELGPEGFAGWLRESKAVGVTDTTFRDAHQSLLATRVRTTGLLMVAPYVARSMPQLLSIECWGGATYDVALRFLKEDPWERLAALRESVPNICLQMLLRGRNTVGYTPYPELVTSAFVEEAAATGIDIFRIFDALNNVESMRPAIDAVRETGSTIAEVAMCYTGDLSDPAENLYTLDYYLKLAEQIVEAGAHVLAIKDMAGLLRAPAAHTLVSALRSRFDLPVHVHTHDTPGGQLATYLAAWSAGADAVDGASAPMAGTTSQPALSSIVAAAAHTQYDTGLDLRAVCDLEPYWEAVRKVYAPFESGLPGPTGRVYTHEIPGGQLSNLRQQAIALGLGDRFEEIEANYAAADRVLGRLVKVTPSSKVVGDLALALVGAGITAEEFAEDPAKYDIPDSVIGFLRGELGDPPGGWPEPLRTKALQGRGPARPVEKLTADDEALLAQPGPKRQAALNRLLFPGPTAEFEAHRETYGDTSSLSANQFFYGLRYGEEHRVQLERGVELLIGLEAISEADERGMRTVMCIINGQLRPVLVRDRSIASEVPAAEKADRNNADHIAAPFAGVVTVGVAEGDSVDAGQTIATIEAMKMEAAITAPKAGTVARVAVAATAQVEGGDLLVVVS

SEQ ID NO: 5042 - DNA, 1722 bp, Myxococcus xanthus
  CDS (1)..(1722)
atggagcgcttcaagaaggtcctcatcgcgaaccgcggcgagattgccgtccgggtgattcgcacctgccagcggctgggttacagcaccgtggcggtgttctccgaggcggaccgcggcgcgccgcacgtgctggcggcggacgaggcggtggccattggtccgtctccggcgaaggagtcctacctcgtcatcgggaagattctggaagcggcgaagacgtccggcgcggaggccatccacccgggctacggtttcttgtcggagaacgcggacttcgcgcgcgcttgccgcgacgcgggcctggtgttcatcggcccggaggccgaggccatcaccctgatgggcaacaagcgtcaggcgaacgtgcgcatgattgcggcgggcgtgccctgcattcctggctacgaggcgtccgacctggatgatgaggcgctggcggtggagggcgagcgcatcggcttcccgctgatggtcaaggcggcggcgggtggcggcgggcgcggcatgcggctggtgcacgaggcatcgcagcttcgcgcggccctgcgcgcggcgcgctcggaggcgacgaatgccttcgggagcggggagctcatcctggagaaggccgtcatcgacgcgcggcacgtggaggtccaggtcttcgcggacacgcacggcaacgtggtgcacctgggcgagcgggactgctcggtgcagcgccggcaccagaaaatcgtggaggagagtccgtcaccggcggtgagcccggcgctgcgcgcgcgcatgggtgaggtggcggtggcggcggctcgggcgattggctaccggggagcggggaccatcgagttcctcctcgctccgagcggtgacttctacttcatggagatgaacacacgtctccaggtggagcacccggtgacggagctgattaccgggttggatttggtggagtggcagctccgcgtggcggcgggggagacgctgccccggacgcaggaggcgatttccgcgtcggggcatgccatcgaggttcgcctctgcgcggaggacccggcgaagggctacgcgccccaggccgggcggctgctggcgtggaggctgccgctgcgtgagggcgtgcgcatcgaccacggcgtgcgggaggggcaggagattccgcccttctatgactccatgcaggcgaaggtgattgcgcacggcccggaccgggagacggcgcgccggcggctggtggaggcgctgcgcgagctgacggtgttcggcgtcaccaccaacaagaacctgttgttgtacgtgctggagcacgcggcgttccgttcaggggagtacgacacggcgttcatcgcgaggcacgcggcggcgtcggaggtggaagggctgtatcaggcagacgcgaaggcgcgggcgctggcggcggcgctgctcttccacgacgaaggcctgaagctggcggacacggcgggtctggatgtgtccctgctgaattggaacacgtcccaccgccaccccgtgcggatgaagctcgtgagccgtggcgcggaagcgtccgtcaccgtccagcccgtgtccggggaagggtacaaggtggacgtgggggattcgtcgttcgacgtgtccgtgttggggctgtccgcgggcgtgctcgacttctccagcgccgggacacggggccgcgcacgctactgcgggacggggacacgctgtggctggacctgggctcgggcgcgcacgccgtga

SEQ ID NO: 5043 - protein, 573 aa, Myxococcus xanthus
MERFKKVLIANRGEIAVRVIRTCQRLGYSTVAVFSEADRGAPHVLAADEAVAIGPSPAKESYLVIGKILEAAKTSGAEAIHPGYGFLSENADFARACRDAGLVFIGPEAEAITLMGNKRQANVRMIAAGVPCIPGYEASDLDDEALAVEGERIGFPLMVKAAAGGGGRGMRLVHEASQLRAALRAARSEATNAFGSGELILEKAVIDARHVEVQVFADTHGNVVHLGERDCSVQRRHQKIVEESPSPAVSPALRARMGEVAVAAARAIGYRGAGTIEFLLAPSGDFYFMEMNTRLQVEHPVTELITGLDLVEWQLRVAAGETLPRTQEAISASGHAIEVRLCAEDPAKGYAPQAGRLLAWRLPLREGVRIDHGVREGQEIPPFYDSMQAKVIAHGPDRETARRRLVEALRELTVFGVTTNKNLLLYVLEHAAFRSGEYDTAFIARHAAASEVEGLYQADAKARALAAALLFHDEGLKLADTAGLDVSLLNWNTSHRHPVRMKLVSRGAEASVTVQPVSGEGYKVDVGDSSFDVSVLGLSAGVLDFSSAGTRGRARYCGTGTRCGWTWARARTP

SEQ ID NO: 5044 - DNA, 6966 bp, Brassica napus
  CDS (1)..(6966)
atggagatgagagctttagtttcgtgttctgctgccggaaatggagcttctgatcggtttagactctccaatgtttcaccatggatcacatcagctcgtggtgcaagtggcagtgactccccagccacagtgaagctgggaagcagctctatgattagagctttcaaaggcgtttcgatttacaaaaacaagaccagaaggaatgttctgtctcaaaggaacaaacagttccgtcctatggcctacttaggaaggaaggacttgagcagccctgatccgacctccttctgcgataatgatatatctgaacctcaagggaccggatccattaatgggaatgatcatagtgctgtaagagtgtctcaagtcgatgagttctgtaaggctcatggtggaaaaaggccaatccatagcattttggttgctaccaatggaatggcagctgtcaagttgatacggagtgttagagcatggtcttaccaaacatttggctcggaaaaatccatatcattggtggccatggcgactcctgaagacatgcggatcaatgcggaacatatcaggatcgctgatcagtttatgcaagtcccgggtggaacgaacaataacaattatgctaatgttcatcttattgtagagatggctcaagcaacaggtgtggatgcagtttggcctggttggggtcatgcatctgaaaaccctgagttgcctgatgcattaaaggccaaaggagtcatatttcttggtcctacagcagcctcaatgttagcattaggcgataagattgggtcgtccttgattgcacaagctgctgatgtacctactctgccatggagtggttcccatgttaaaatacctcctggtagcagcatggtaacgatccccgaggagatgtacaggcaagcttgtgtctacactaccgaagaagcggttgctagttgtcaagttgtcggttatccagcaatgatcaaagcttcgtggggtggtggtggtaaaggcattagggaggtccatgatgatgatgaggttaggactctattcaagcaagttcaaggcgaggtcccaggctcgccgatattcataatgaaggttgcttcccagagtcggcatctagaggtgcagctgctctgtgaccaatatggaaatgtttcagctttgcatagccgtgattgtagcgtccagagaagacaccaaaagatcatcgaggagggtcccatcactgtggctccccgagataccgtgaagaagctggagcaggcagctagaaggttggctaagagtgttaactatgttggagctgctactgttgagtttctctacagcatggacactggggactacttcttcttagagcttaaccctaggttacaggtcgagcaccctgtaaccgagcggatcgctgacataaatcttccagctgcccaagttgctgtcggtatgggaatccctctctggcaaatccctgagataagacggttctatggtatagaacaatatgattcgtggaggacaacatctttgctagcctccccttttgattttgataaagctgaatctgtaaggccaaaaggtcactgtgtcgctgtccgggtgacaagcgaggatcctgatgacgggtttaaacccaccagcggtcaagtgcaggagcttagttttaagagcaacccaaatgtgtgggggtacttctctgtcaagtctggtggaggcatccacgagttctcagattctcagtttggacatgtttttgcatttggggaatccagagccatggcaatatcaaatatggttcttgcgctgaaagaaattcaaattcgtggaggagttaggactaacgttgactacacgattgaccttctacatgcttctgattaccgggaaaacaaaattcacactggttggttggacagtagaattgctatgcgggtccgagcagataggcctccgtggcacctctctgttgtcagcgggactctctataaagcatcagcgactggtgctgccgtggtctcggattacattgcttatcttgacaaggggcaaattcccccaaagcatatatctcttgtgcattctcaagtgtctctgaatattgaaggaagtaaatatacggttgatgtggtccggagtggatcaggaagctacaagctaagaatgaacaactcagaagtggcagcagaaatacacactctacgtgatggaggtttgttgatgcagttggatggtaaaagccatgttatatatgcacaggaagaaacctcaggcacccgtcttctgattgacggcaaaacttgtttacttcagaatgaacacgacccttcaaaattaatggctgagacaccgtgcaagctagttaggtatctggtttcagatgatagcagcattgatgctgatacaccctatgcagaggttgaggtcatgaagatgtgcatgccgcttctttcacctgcgtcaggagttatccattttaaaatgtcagagggacaagtcatgctgcctggtgaacttatagccaatcttgatcttactgatccttcgactgtaagaaaggccgaacccttccatggtcgcttcccaagattagggcttccaacggaaatttctgctaaagttcataagagatgtgctgcaactttaaatgctgctcgcatgattcttgccggctatgagcatcaagtagatgaggttgttcaagacttggtttcttgccttgatagccctgaactcccattccttcagtggcaagagtgctttgcagttctggcgacacggttaccaaaagatctcagaatcatgctagaatcaaagtacatggaatatgagtgtatctccaggaactccttgaccgcagattttcctgccaaacttttaaaaggcattctaaaggctcatgtagcatcttgtgatgagaatgagagaggtgcccttgaaaggctcattgaaccattgatgagccttgcaaactcttacgaaggtggtagagaaagtcatgcctgtgctattgttcgttccctctttgaggaatatctatcagtagaaggattattcaacgataacatgctggctcatgttatagaacgtatgcgtcaggaatacaagaaagtagatcggtcgaagattgtggatatagtgctgtcacaccagggcctaaaaagcaaaaacaagctcgttctccgactcatggagcattttgtttatgctaatccttctgtgtacagagataaacttgtccgattcttgacacttaaccatactaactactctgatgtggtgctcaaggcgattcaattactcgaacagagaaaactaagtgaacttcgttctagcattctgtcggagttagaaatgtgtgcagaggatggggaaaatatggatactcccaagagtaagtgtgccatggaagatcttgtgagcgcacctttagctgttgaagatgctctcgtgggactatttgaccacagcgaccgcacacttcaaagattagttgttgagacttatattcgcagattgtaccagccctacgtcgttaaagaaagcgtgaggatgcagtggcaccaatatggtcttattgcttcctgggagtttctagacgatcttatggaaagaaaaaccactgactcagatgatgaccaagagacatgtgaaaaagtttttgttgagaagcgtagaaagaaaaaaaaggggtttatggttataatcaaatcgctggagtttttgccgaatataataagtgcagcactgacagaaacaaaccacagcgactatgaatctcctttatctggcaatataatgcacattgctattgtgggcatgagtcttcttcaggacaggtacttgacacaagcctgtgacgttttcaaactaagtgagaatgaggaacaagctcaaggaagagtggacaaagttctcaaagaggaagaagtaagttcgagactccgttctgcaggtgtcggtgtggtaagctgtataatccagcgggatgaagaacaaacgcctattagacattcgttccattggtcgatggagaaacagtattacgcagaagagccgatgctgcgccatcttgaacctcctctttccatataccttgagttggataagctgagaggatatgaaaatatacaatatacccctacacgagatcgtcaatggcatctgtatactgtcacagacaacaagccggtgccagtcaggaggatgttcctgagatctcttgttcgacaagggcaggataaccaacttagcctaacacttgttagatctttgagggatgcgatggaggaacttgaactgaatgcccataaggaggatgctatgaaaccagaccacgcacatatgtttctttgcctatctcgtgaacagcagattaatgatcttatgccttaccccaggagagttgacgtgaatgcggcggaggttgaagaaactacaatggagatgatgttagaagaaacagtaggagagatacacaagtcagctggagtgagaatgcataggttgggtgtgtgcgagtgggaagtgcgcctgcggttggcgtcctctggagtggctagtggcgcctggagggctgtggttacaaacgtgacaggccgtacatgcactgtccatatataccgagaagttgaagcgactgggggaaacagtttaatttatcaatcaataaccaagaagggacctttgcatggaaccccgatcaatgatcaatataagccactgggacatcttgacaggcaacgactagccgcaaggaggagtaacactacttattgctatgatttccctttggcatttgagacagccttggaagagttgtgggagtcacaacacccgggagttaagaaactttataagaatactctgatcaatgttgaagagcttgtactctctactccagaaggttctcttattccggttaaaagattaccgggtctcaacgactgtggaatggtggcatggaccctagagatgtcgactcctgagtttccaaagggacggaaaattatcatagtcgccaatgacgtcaccttcaaagctgggtcttttggtcctagagaggacgcgtttttcctcgctgtgactgagctcgcttgcgccgagaaacttcccttgatttacttagcagcaaactctggcgcccggctaggggtagctgaagaagtcaaagcctgctttaaagtcggatggtcggatgaagtttcccctgagaatggttttcagtatatatacctaagccctgaggatcatgcaaggattggatcatctgtcattgcgcacgaaataaagctgcccagcggggaaaaaaggtgggtcattgatacaatcgttggtcaagaagatggtattggcgtagagaatctaacgggaagcggggcaatagcgggtgcttactcgagggcgtacaaggaaacttttactttaacctttgtcagtggaagaacggttggcattggtgcttaccttggccgcctgggtatgcggtgcattcagagattagaccagcctatcattttgactggcttttcgacgctgaacaagttacttgggcgtgaggtctacagctctcacatgcagctcggcggccccaaaatcatgggcgcaaatggtgttgttcatcgtacagtctcagatgatctagaaggcgtgtcggcgattctaaactggctgagctacgttcctgctcacgcgggtggccctcttcctcttctcgcccctttagatccaccggagagaactgtggagtacgtcccgcagaactcttgcgacccgcgagctgctatagctggggtcaatgacaaggccggtaaatggcttggcggtatctttgataaaaacagctttatcgagactctggaaggctgggcgaggacggttgtgaccggtagagctaagctcgggggagtacctgttggagttgtagcagttgagacgcagactgtgacgcagattattccagcggatcctggacaggtggactcgcacgaaagagtggttccgcaggcagggcaagtctggttccctggctcagcagccaagacggctcaagcgctcatggatttcaaccgggaagggcttccgttgtttatcctagcgaactggcgagggttttcaggcgggcagagagatcttttcgaagggatactccaggctggttcagctatcgtcgaaagtctgagaacgtatgggcagcctgtgtttgtgtacatccccaagatgggagagctgcgaggtggagcgtgggtggttgttgatagccagattaattcggattacgttgaaatgtatgctgacgaaacttcacgtgggaatgtgctcgagcccgaagggatgatagagatcaaatttagaaagagagagatgttggagtgcatgggaaggttggaccagaacctgatcagtctcagagcaaaactgcaagacgccaaacaaagcgagatggaccttatcaagcaacagatcaaagctcggaagaagcagcttttaccgctttacatccaaatcgccaccaaatttgcggatcttcacgacacttccatgaggatggcagcaaaaggagtgatcaaatgcgttgtggattggagcggttcgcgatccttcttctatagaaagctcattcggagaattgcggagagctccctggtgaaacacgtaagagaagcttctggagacaacttatcgtacaaatctgcaatgggtttgattaaggattggttctgcaaatctgatgttgcaaaggggaaagaagaggcttggacagacgaccaagtgttctttacatggaaagacaatgttggtaactacgaatccgagctcagcgagttgagagcacgtaaactgctgaatcaacttgcggagattgggaattcatctgatctgcaggctctgccccagggacttgccaatattctacacaaggtggagcctttgaaaagaaaagagctagtggatgctctaagaaaggtgttgagttga

SEQ ID NO: 5045 - protein, 2321 aa, Brassica napus
MEMRALVSCSAAGNGASDRFRLSNVSPWITSARGASGSDSPATVKLGSSSMIRAFKGVSIYKNKTRRNVLSQRNKQFRPMAYLGRKDLSSPDPTSFCDNDISEPQGTGSINGNDHSAVRVSQVDEFCKAHGGKRPIHSILVATNGMAAVKLIRSVRAWSYQTFGSEKSISLVAMATPEDMRINAEHIRIADQFMQVPGGTNNNNYANVHLIVEMAQATGVDAVWPGWGHASENPELPDALKAKGVIFLGPTAASMLALGDKIGSSLIAQAADVPTLPWSGSHVKIPPGSSMVTIPEEMYRQACVYTTEEAVASCQVVGYPAMIKASWGGGGKGIREVHDDDEVRTLFKQVQGEVPGSPIFIMKVASQSRHLEVQLLCDQYGNVSALHSRDCSVQRRHQKIIEEGPITVAPRDTVKKLEQAARRLAKSVNYVGAATVEFLYSMDTGDYFFLELNPRLQVEHPVTERIADINLPAAQVAVGMGIPLWQIPEIRRFYGIEQYDSWRTTSLLASPFDFDKAESVRPKGHCVAVRVTSEDPDDGFKPTSGQVQELSFKSNPNVWGYFSVKSGGGIHEFSDSQFGHVFAFGESRAMAISNMVLALKEIQIRGGVRTNVDYTIDLLHASDYRENKIHTGWLDSRIAMRVRADRPPWHLSVVSGTLYKASATGAAVVSDYIAYLDKGQIPPKHISLVHSQVSLNIEGSKYTVDVVRSGSGSYKLRMNNSEVAAEIHTLRDGGLLMQLDGKSHVIYAQEETSGTRLLIDGKTCLLQNEHDPSKLMAETPCKLVRYLVSDDSSIDADTPYAEVEVMKMCMPLLSPASGVIHFKMSEGQVMLPGELIANLDLTDPSTVRKAEPFHGRFPRLGLPTEISAKVHKRCAATLNAARMILAGYEHQVDEVVQDLVSCLDSPELPFLQWQECFAVLATRLPKDLRIMLESKYMEYECISRNSLTADFPAKLLKGILKAHVASCDENERGALERLIEPLMSLANSYEGGRESHACAIVRSLFEEYLSVEGLFNDNMLAHVIERMRQEYKKVDRSKIVDIVLSHQGLKSKNKLVLRLMEHFVYANPSVYRDKLVRFLTLNHTNYSDVVLKAIQLLEQRKLSELRSSILSELEMCAEDGENMDTPKSKCAMEDLVSAPLAVEDALVGLFDHSDRTLQRLVVETYIRRLYQPYVVKESVRMQWHQYGLIASWEFLDDLMERKTTDSDDDQETCEKVFVEKRRKKKKGFMVIIKSLEFLPNIISAALTETNHSDYESPLSGNIMHIAIVGMSLLQDRYLTQACDVFKLSENEEQAQGRVDKVLKEEEVSSRLRSAGVGVVSCIIQRDEEQTPIRHSFHWSMEKQYYAEEPMLRHLEPPLSIYLELDKLRGYENIQYTPTRDRQWHLYTVTDNKPVPVRRMFLRSLVRQGQDNQLSLTLVRSLRDAMEELELNAHKEDAMKPDHAHMFLCLSREQQINDLMPYPRRVDVNAAEVEETTMEMMLEETVGEIHKSAGVRMHRLGVCEWEVRLRLASSGVASGAWRAVVTNVTGRTCTVHIYREVEATGGNSLIYQSITKKGPLHGTPINDQYKPLGHLDRQRLAARRSNTTYCYDFPLAFETALEELWESQHPGVKKLYKNTLINVEELVLSTPEGSLIPVKRLPGLNDCGMVAWTLEMSTPEFPKGRKIIIVANDVTFKAGSFGPREDAFFLAVTELACAEKLPLIYLAANSGARLGVAEEVKACFKVGWSDEVSPENGFQYIYLSPEDHARIGSSVIAHEIKLPSGEKRWVIDTIVGQEDGIGVENLTGSGAIAGAYSRAYKETFTLTFVSGRTVGIGAYLGRLGMRCIQRLDQPIILTGFSTLNKLLGREVYSSHMQLGGPKIMGANGVVHRTVSDDLEGVSAILNWLSYVPAHAGGPLPLLAPLDPPERTVEYVPQNSCDPRAAIAGVNDKAGKWLGGIFDKNSFIETLEGWARTVVTGRAKLGGVPVGVVAVETQTVTQIIPADPGQVDSHERVVPQAGQVWFPGSAAKTAQALMDFNREGLPLFILANWRGFSGGQRDLFEGILQAGSAIVESLRTYGQPVFVYIPKMGELRGGAWVVVDSQINSDYVEMYADETSRGNVLEPEGMIEIKFRKREMLECMGRLDQNLISLRAKLQDAKQSEMDLIKQQIKARKKQLLPLYIQIATKFADLHDTSMRMAAKGVIKCVVDWSGSRSFFYRKLIRRIAESSLVKHVREASGDNLSYKSAMGLIKDWFCKSDVAKGKEEAWTDDQVFFTWKDNVGNYESELSELRARKLLNQLAEIGNSSDLQALPQGLANILHKVEPLKRKELVDALRKVLS

SEQ ID NO: 5046 - DNA, 7128 bp, Arabidopsis thaliana
  CDS (1)..(7128)
atggagatgagagctttgggttcttcgtgttctactggtaatggaggttctgctccgattaccctcacgaatatatctccatggatcacaacagtttttccgtcgacagtgaagctgagaagtagtttgagaaccttcaaaggagtttcgtcaagagtgagaacctttaaaggagtttcttcgacaagagttttgtctcggaccaaacaacagtttcctctgttttgtttcctaaaccctgatccgatctccttcttggaaaatggtttctttctctctatcttttgcttaacttatgattgcattttttcgcttttttcctatacatttgacatgaatttgtctgtcatctctatgataacgctgatcggttcacgggctggatctgttaacgggtatcatagtgatgtagtacccggtagaaatgtggctgaggtcaatgagttctgtaaagctcttggagggaaaaggccaatccatagtattctggttgctactaatggaatggcagctgtgaagtttatacgtagtgtcagaacatgggcttacgaaacatttggctcggaaaaagcggtaaagttggtggcaatggcaactcctgaagacatgaggatcaatgcggaacatatcagaattgctgatcagtttgttgaggttccgggaggaactaataataacaattatgctaatgttcagcttattgtggagatggctgaggtcacgcgtgtggatgcagtttggcctggttggggtcatgcatctgagaaccctgaattacctgatgctttaaaggagaaaggaattatatttcttggtcctcctgcagattcaatgatagcattaggggataagattggttcgtcgttgattgctcaagctgctgatgtacctactcttccatggagtggttcccatgttaagatacctccggggagaagtttggtaactgtccccgaggagatatacaagaaagcttgtgtttacacaacagaagaagcaattgctagttgtcaagttgttggttatccagcaatgatcaaagcatcgtggggtggtggtggtaaaggcattaggaaggttcataatgatgatgaggttagggctctattcaagcaagttcaaggtgaggtcccgggctcgccgatatttataatgaaggttgcttcacagagtcgacatttagaggcccagttgctttgtgaccaatatggaaacgtagcagctttgcatagccgtgattgtagcgtccagagaagacaccaaaagatcatagaggaaggtccaatcaccgtagctccgcaagaaaccatcaagaaacttgaacaagcagctagaaggttagctaagagtgttaactatgttggagctgctactgttgagtatctctatagtatggacactggggagtactacttcttagagcttaaccctcgcttacaggttgagcatcctgtaaccgagtggatcgccgaggttaatcttcctgctgctcaagttgctgttgggatgggaattcctctctggcaaatccctgagataagacggttttacggtatggaacatggtggaggatatgattcttggaggaaaacatcggttgtagcctctccttttgattttgatgaagctgaatctttaaggccaaaaggtcattgtgtggctgtacgtgtgacaagcgaggatcctgatgacgggtttaaaccaaccagcggtgaaatacaggaattgagttttaagagcaagccaaatatgtggtcgtacttctctgtcaagtctggtggaggcatccacgagttctcagattcacagtttggacatgtttttgcatttggggaatccagatccgtggcgatagcaaatatggttcttgcgctgaaagaaattcaaatccgtggagatattaggactaacgttgactacacgatcgaccttctacatgcttctgattaccgggaaaacaaaatacacactggttggttggacagtaggattgctatgcgggtcagagcagagagacctccatggtatctctctgtagtcggtggggctctttataaagcatctacgaccagttctgctgtagtttcggattacgttggctatctagaaaaggggcaaattcccccaaagcatatatctcttgtgcattctcaagtgtcactgaatattgaaggaagtaaatatacgattgatgtagtccggggtggatcaggaacctacaggctaagaatgagcaactcagaagttgtagcagaaatacacactctacgtgatggaggtctattgatgcagttggatggtaaaagccatgtgatatatgcaaaggaagaagcgacaggaacccgtcttctcattgacggaagaacttgcttactacagaatgatcatgatccttcgaagttgatggctgagacaccatgcaagttgctaaggtacctggtttcagacaacagcagtattgatactgatacgccgtatgcagaagttgaagtcatgaagatgtgcatgccacttatttcacctgcgtcaggagttatccatttcaagttgtctgaaggacaagccatgcaggctggtgaactcatagccaagcttgatcttgatgatccttctgctgtaagaaaggccaaacccttccgtggaagtttcccacgattagggcttccaacggcaatctccggtaaagttcatcagagatgtgctgcaactttaaatgctgcacgtatgattcttgctggctatgatcataaagtagatgaggttcttcaagacttgcttaattgccttgatagccctgaactcccatttcttcagtggcaagagtgctttgcagttctggcgacacgactacctaaagatctcaggaacatgctagaattgaaatacaaggaatttgagattatctccaaaacctccctgaccccagatttccctgccaaactcttaaaaggcatccttgaggctcatctatcttcttgtgatgagaaagagagaggttcccttgaaaggctcattgaaccgttgatgagccttgtgaagtcttatgaaggtggtagagaaagtcatgcccgtcttattgttcattccctctttgaagaatacctatcagttgaagaattattcaatgataacatgctggctgatgttatagaacgcatgcgtcagcaatacaagaaggatcgattaaagattgtcgatatcgtgctttcacaccagggcataatacacaaaaacaaactggttcttcgacttatggagcagcttgtttatcctaatcctgctgcatacagagaaaaacttattcgattctcagcacttaatcatactaattactctcagttggcgctcaaggcgagtcaattgctcgaacagaccaaacgaagcgaacttcgttcaaatattgctagaagcctttcagaattagaaatgtttacagaggctggagaaaatatggatactcccaagaggaagagtgccattagtgaaacgatggaaaatcttgtgagctcatctttagctgttgaagacgctctcgtgggattatttgaccatagcgatcacacacttcaaagacgggttgttgagacttatattcacagattataccagccctatgtcgttaaagaaagtgtgaggatgcagtggcaccagtctggtgtcattgcttcttgggagttcctagaacatttcgaaagaaaaaacactggcccagacgatcacgagatatctgaaaaaggaattgttgcgaagagtagtaagagaaaacgggggactatggttataatcaaatcgctgcagtttctgccgagtataataaatgcatcattgagagaaacaaaccatagccactgtgaatatgcccgagctcctttatctggtaatatgatgcacattgctgttgtgggcatcaacaatcagatgagtctgcttcaggacagtggggacgaggaccaaactcaggaaagagtaaacaagctggccaaaattcttaaagaggaagaagtgagtttgactctctgttctgcaggtgtcggtgtgatcagttgtataattcagcgagatgaaggacgaacaccaatgagacattcttttcattggttgatggagaaacagtattatgtagaagagccgttgctgcgacatgttgaacctcctctatctgtataccttgagttggataagcttaaagggtactcaaatatacagtattcgccttcacgagaccgtcaatggcatatgtatagtgttacagacaggccagtgccaatcaaaagaatgttccttagatctcttgttcgacaaactacaatgaatgatgggtttctgttgcagcaagggcaggactaccaacttagccaaacagtgctctccatggcgtttacatcgaaatgcattctgaggtctttgatgaatgcaatggaggaactggaactgaatgcacataatgctgccatgaaaccagaccacgcacatatgttcctatgcatactacgtgagcagcagatagatgatcttgtgccttaccccaggagatttgaagtgaatgcggaggatgaagaaactacagttgagacgatcttagaagaagcaacacaggaaatacataggtctgttggagtgagaatgcatgcattgggtgtttgcgaatgggaagtgcgactgtggttggtgtcctcgggactggcaaatggcgcttggagggtcgtggttgcaaacgtgactggccgtacctgcactgtccatatataccgagaagtggaagctactgggagaaacagtttaatctaccactcaataactaagaagggacctttgcatggaactctgatcaatggtcaatataaaccacttaataatctggacaggaaacgtttagccgcaaggaggagtaacactacttattgctatgacttccccttggcatttgagacagcattggagctgaattgggcatcacaacactcgggagttaggaaaccatgcaagaatagactcatcaacgtcaaagagcttgtattctccaatacagaaggttctttgggtacatctcttattccggttgaacgaccagctggtctcaacgacattggaatggtggcctggatcttagagatgtcgactcctgagtttcctatgggacggaaacttctcattgtcgccaatgatgtcacattcaaagctggttcttttggtcctagagaggacgcatttttccttgctgtgactgaactcgcttgtaccaaaaagcttcccttgatttacttggcagcaaattctggtgcccgactcggtgtagctgaagaagtaaaagcatgcttcaaagttggatggtcggatgaagtttcccccggtaatgattttcagtatatatacctaagctctgaagactatgcaaggattggatcatctgtcattgcgcacgaagtgaagctccctagtggcgaaacaaggtgggtgattgatacaattgttggtaaagaagatggtcttggagttgagaatttaacaggaagtggggcaatagcgggtgcttactcaagggcgtacaatgaaacttttactttaacctttgttagtggaagatcggtcggaattggtgcttaccttgcccgactgggcatgaagtgcatacagagactagaccaaccgatcatcttgaccggcttttctacactcaacaagctgcttggacgtgaggtctatagctctcacatgcaacttggtggcccaaaaatcatggggacaaatggtgttgttcatcttacagtctcagatgatctcgaaggtgtatcagcaattctcaactggctgagctacattcctgcgtatgtgggtggtcctcttcctgttcttgctcctttagatccaccggagagaactgtggagtatatcccagagaactcttgtgacccacgagctgctatagctgggattaacgataatactggtaaatggcttggtggtatctttgataaaaatagctttgttgagactcttgaaggctgggcaaggacggtagtgactggtagagctaagcttgggggaatacccattggagttgttgctgtcgagacacagactgtaatgcatgtcatcccagcagatcctggacagcttgactctcatgaaagagtggttccgcaagcagggcaagtctggtttcctgattcagcagccaagacagctcaagcgctcatggatttcaaccgggaacagcttcctttgtttatcatagcaaactggagaggtttttcaggtgggcaaagagatctttttgaaggaatacttcaggcgggttcagctatagtagaaaatctgagaacatatcggcagccagtgtttgtgtacatcccaatgatgggagaactgcgaggtggagcatgggtggttgttgatagccagataaattcggattatattgaaatgtacgctgatgaaaccgctcgtggaaatgtgcttgagcctgaagggatgatagagataaaatttagaaggaaagagctgttagagtgcatgggaaggttggaccagacgctaatcaatctgaaagcaaatatccaagatgccaagcgaaacaaggcatatgcaaacatcgagcttctccagaaacagattaaaacccgagagaagcaacttttaccagtttatacccaaatcgctaccaaatttgctgaactccatgacacttccatgagaatggctgcaaaaggtgtgatcaaaagtgttgtggaatggagcggctcgcggtcattcttctataaaaagctctatcggagaatcgcagagagctctctagtgaggaacataagaaaagcttctggagacatcttatcatataaatctgctatgggtttgattcaggactggttccgcaaatccgagattgcaaaggggaaagaagaagcttggacggacgaccaactgttctttacatggaaagacaatgttagtaactacgagcagaagctgagcgagttgagaacacagaaactgctgaatcaacttgcagagattgggaattcgtcagatctgcaggctctgccacaaggacttgctaatcttctaaacaaggtggatctttcaagaagagaagagctggtggacgcgattcggaaggtgttgggttga

SEQ ID NO: 5047 - protein, 2375 aa, Arabidopsis thaliana
MEMRALGSSCSTGNGGSAPITLTNISPWITTVFPSTVKLRSSLRTFKGVSSRVRTFKGVSSTRVLSRTKQQFPLFCFLNPDPISFLENGFFLSIFCLTYDCIFSLFSYTFDMNLSVISMITLIGSRAGSVNGYHSDVVPGRNVAEVNEFCKALGGKRPIHSILVATNGMAAVKFIRSVRTWAYETFGSEKAVKLVAMATPEDMRINAEHIRIADQFVEVPGGTNNNNYANVQLIVEMAEVTRVDAVWPGWGHASENPELPDALKEKGIIFLGPPADSMIALGDKIGSSLIAQAADVPTLPWSGSHVKIPPGRSLVTVPEEIYKKACVYTTEEAIASCQVVGYPAMIKASWGGGGKGIRKVHNDDEVRALFKQVQGEVPGSPIFIMKVASQSRHLEAQLLCDQYGNVAALHSRDCSVQRRHQKIIEEGPITVAPQETIKKLEQAARRLAKSVNYVGAATVEYLYSMDTGEYYFLELNPRLQVEHPVTEWIAEVNLPAAQVAVGMGIPLWQIPEIRRFYGMEHGGGYDSWRKTSVVASPFDFDEAESLRPKGHCVAVRVTSEDPDDGFKPTSGEIQELSFKSKPNMWSYFSVKSGGGIHEFSDSQFGHVFAFGESRSVAIANMVLALKEIQIRGDIRTNVDYTIDLLHASDYRENKIHTGWLDSRIAMRVRAERPPWYLSVVGGALYKASTTSSAVVSDYVGYLEKGQIPPKHISLVHSQVSLNIEGSKYTIDVVRGGSGTYRLRMSNSEVVAEIHTLRDGGLLMQLDGKSHVIYAKEEATGTRLLIDGRTCLLQNDHDPSKLMAETPCKLLRYLVSDNSSIDTDTPYAEVEVMKMCMPLISPASGVIHFKLSEGQAMQAGELIAKLDLDDPSAVRKAKPFRGSFPRLGLPTAISGKVHQRCAATLNAARMILAGYDHKVDEVLQDLLNCLDSPELPFLQWQECFAVLATRLPKDLRNMLELKYKEFEIISKTSLTPDFPAKLLKGILEAHLSSCDEKERGSLERLIEPLMSLVKSYEGGRESHARLIVHSLFEEYLSVEELFNDNMLADVIERMRQQYKKDRLKIVDIVLSHQGIIHKNKLVLRLMEQLVYPNPAAYREKLIRFSALNHTNYSQLALKASQLLEQTKRSELRSNIARSLSELEMFTEAGENMDTPKRKSAISETMENLVSSSLAVEDALVGLFDHSDHTLQRRVVETYIHRLYQPYVVKESVRMQWHQSGVIASWEFLEHFERKNTGPDDHEISEKGIVAKSSKRKRGTMVIIKSLQFLPSIINASLRETNHSHCEYARAPLSGNMMHIAVVGINNQMSLLQDSGDEDQTQERVNKLAKILKEEEVSLTLCSAGVGVISCIIQRDEGRTPMRHSFHWLMEKQYYVEEPLLRHVEPPLSVYLELDKLKGYSNIQYSPSRDRQWHMYSVTDRPVPIKRMFLRSLVRQTTMNDGFLLQQGQDYQLSQTVLSMAFTSKCILRSLMNAMEELELNAHNAAMKPDHAHMFLCILREQQIDDLVPYPRRFEVNAEDEETTVETILEEATQEIHRSVGVRMHALGVCEWEVRLWLVSSGLANGAWRVVVANVTGRTCTVHIYREVEATGRNSLIYHSITKKGPLHGTLINGQYKPLNNLDRKRLAARRSNTTYCYDFPLAFETALELNWASQHSGVRKPCKNRLINVKELVFSNTEGSLGTSLIPVERPAGLNDIGMVAWILEMSTPEFPMGRKLLIVANDVTFKAGSFGPREDAFFLAVTELACTKKLPLIYLAANSGARLGVAEEVKACFKVGWSDEVSPGNDFQYIYLSSEDYARIGSSVIAHEVKLPSGETRWVIDTIVGKEDGLGVENLTGSGAIAGAYSRAYNETFTLTFVSGRSVGIGAYLARLGMKCIQRLDQPIILTGFSTLNKLLGREVYSSHMQLGGPKIMGTNGVVHLTVSDDLEGVSAILNWLSYIPAYVGGPLPVLAPLDPPERTVEYIPENSCDPRAAIAGINDNTGKWLGGIFDKNSFVETLEGWARTVVTGRAKLGGIPIGVVAVETQTVMHVIPADPGQLDSHERVVPQAGQVWFPDSAAKTAQALMDFNREQLPLFIIANWRGFSGGQRDLFEGILQAGSAIVENLRTYRQPVFVYIPMMGELRGGAWVVVDSQINSDYIEMYADETARGNVLEPEGMIEIKFRRKELLECMGRLDQTLINLKANIQDAKRNKAYANIELLQKQIKTREKQLLPVYTQIATKFAELHDTSMRMAAKGVIKSVVEWSGSRSFFYKKLYRRIAESSLVRNIRKASGDILSYKSAMGLIQDWFRKSEIAKGKEEAWTDDQLFFTWKDNVSNYEQKLSELRTQKLLNQLAEIGNSSDLQALPQGLANLLNKVDLSRREELVDAIRKVLG

SEQ ID NO: 5048 - DNA, 3579 bp, Aspergillus niger
  CDS (1)..(3579)
atggctgctccccgccagcccgaggaggcggtcgatgacaccgagttcatcgatgaccaccatgaccagcaccgggactctgtccacacccgtctgcgtgccaattcggctatcatgcagttccaaaagatccttgttgccaaccgtggtgaaatccccattcgtatcttccggacggctcacgagctgtccctgcagaccgtcgccgtctactcccatgaggaccatctctccatgcaccgtcagaaggccgacgaggcctacatgattggcaagcgcggtcaatatacaccggttggggcctacttggccattgacgagatcgtcaagattgctctggagcatggtgtacacctgatccacccgggttacggtttcctgtccgagaacgccgagtttgcccgcaaggtggagcagtccggcatggttttcgtcggccctaccccccagaccatcgagagcctcggtgacaaggtctccgcccgtcagctggctatccgctgcgacgtgcccgtcgtgcccggtaccccgggccctgtcgagcgctacgaggaggtcaaggccttcaccgacacctacggcttccccatcatcatcaaggccgcctttggtggtggtggtcgtggtatgcgtgtcgttcgcgaccaggccgaactgcgtgactccttcgagcgtgccacctccgaggcccgctctgcctttggcaacggcaccgtcttcgtcgagcgcttcctcgaccgccccaagcacatcgaagtccagctgctgggtgacaaccacggcaacgtcgtccacctgttcgagcgtgactgctccgtccagcgtcgccaccagaaggtcgttgaaattgccccggccaaggacctgcctgccgatgtccgtgaccgcatcctggctgatgctgtcaagctggccaagtcggtcaactaccgcaacgccggtactgcagagttcctggttgaccagcagaaccgttactacttcattgagatcaacccccgtatccaggtcgagcacactatcaccgaagagatcacgggtatcgatatcgttgctgctcagatccagattgcggccggtgctaccctggaacagctgggtctgacccaggaccgcatctccactcgtggattcgccattcagtgccgtatcaccaccgaggacccctccaagggcttctcccccgacaccggtaagatcgaggtctaccgctccgccggtggtaacggtgtccgtctggatggtggaaacggtttcgccggtgccatcatcacccctcactacgactccatgttggtcaagtgtacctgccgtggttccacctatgagatcgctcgccgcaaggtcgttcgtgctttggtcgagttccgtatccgtggtgtcaagaccaacattcctttcctcacctctcttctgagtcaccctgtgttcgtggatggtacctgctggaccacgttcattgatgacactcccgagctgttcgcccttgtcggcagtcagaaccgtgcccagaagctgctggcttacctgggtgatgtggctgtcaacggcagcagcatcaagggccagatcggcgagcccaagctcaagggcgatatcatcaagcccgttctgcatgacgctgccggcaagcccctcgacgtctctgtccccgccaccaagggatggaagcagatcctggacagtgagggtcccgaggcttttgcccgcgctgtgcgtgccaacaagggctgcttgatcatggatactacctggcgtgatgcccaccagtcgctgctggccactcgtgtgcgtaccattgacctcctgaacatcgcccacgagacgagccacgccctcgccaacgcctacagtttggaatgctggggtggtgccaccttcgatgtcgccatgcgcttcctgtacgaggacccctgggaccgtcttcgcaagctgcgcaaggccgttcccaacatccccttccagatgttgctccgtggtgccaacggtgttgcttactcctccctccctgacaacgccatctaccacttctgtaagcaggccaagaagtgcggtgtcgacatcttccgtgtcttcgatgctctcaacgacgttgaccagctcgaggtcggtatcaaggctgtccacgctgccgagggtgttgttgaggctactatttgctacagtggtgatatgctcaaccccagcaagaagtacaacctgccttactacctcgaccttgttgataaggtggtccaattcaagccccacgtcttgggtatcaaggacatggctggtgtgctgaagccccaggctgctcgtctgctgatcggttccatccgcgagcgctaccccgacctccccatccacgtgcacacccacgattctgctggtaccggtgtggcttccatgattgcttgcgctcaggccggtgctgatgccgttgatgctgccacggacagcctttccggtatgacctcccagcccagcattggtgctatcctcgcttccctcgagggaactgagcacgaccccggcctcaactcggcccaggttcgcgcccttgacacctactgggcgcagctgcgtctcctctactcgcccttcgaggcaggtctgactggtcccgaccccgaggtttacgagcatgagatccctggtggtcaattgaccaacctgatcttccaggccagccagcttggtctgggccagcagtgggcggagacgaagaaggcttacgagtctgccaacgatcttttgggcgatgtcgtcaaggtcacccccacttccaaggtggtcggtgatttggctcagttcatggtctccaacaagttgactgctgaagatgtgattgctcgcgccggcgagcttgacttccccggttccgttctggagttcctcgagggtctcatgggccagccctacggtggattccccgagcctctgcgctctcgcgctctgcgtgaccgtcgcaagctcgacaagcgccctggtctgtacctggagccccttgacctggccaagatcaagagccagatccgggagaactatggcgcagctaccgagtacgatgtggccagctatgccatgtaccccaaggtcttcgaggattacaagaagtttgtcgccaagttcggtgatttgtccgtcctgcccacgcgttacttcttggccaagcccgagatcggcgaggaattccacgtcgagctggagaagggtaaggtgctgatcctgaagttgttggccattggtcccctctccgagcagaccggccagcgtgaggtcttctacgaagtcaacggtgaggttcgccaggttagtgtggacgacaagaaggcgtccgtcgagaacaccgcccgccccaaggccgagctgggtgacagcagccaggttggtgctcctatgagcggtgtggttgtcgagatccgcgtccacgacggcctggaagtcaagaagggtgaccccattgccgtcctgagcgccatgaagatggaaatggttatctctgctccccacagtggcaaggtctccagcttgctggtcaaggaaggtgactcggtggatggccaggatcttgtctgcaagatcgtcaaggcctag

SEQ ID NO: 5049 - protein, 1192 aa, Aspergillus niger
MAAPRQPEEAVDDTEFIDDHHDQHRDSVHTRLRANSAIMQFQKILVANRGEIPIRIFRTAHELSLQTVAVYSHEDHLSMHRQKADEAYMIGKRGQYTPVGAYLAIDEIVKIALEHGVHLIHPGYGFLSENAEFARKVEQSGMVFVGPTPQTIESLGDKVSARQLAIRCDVPVVPGTPGPVERYEEVKAFTDTYGFPIIIKAAFGGGGRGMRVVRDQAELRDSFERATSEARSAFGNGTVFVERFLDRPKHIEVQLLGDNHGNVVHLFERDCSVQRRHQKVVEIAPAKDLPADVRDRILADAVKLAKSVNYRNAGTAEFLVDQQNRYYFIEINPRIQVEHTITEEITGIDIVAAQIQIAAGATLEQLGLTQDRISTRGFAIQCRITTEDPSKGFSPDTGKIEVYRSAGGNGVRLDGGNGFAGAIITPHYDSMLVKCTCRGSTYEIARRKVVRALVEFRIRGVKTNIPFLTSLLSHPVFVDGTCWTTFIDDTPELFALVGSQNRAQKLLAYLGDVAVNGSSIKGQIGEPKLKGDIIKPVLHDAAGKPLDVSVPATKGWKQILDSEGPEAFARAVRANKGCLIMDTTWRDAHQSLLATRVRTIDLLNIAHETSHALANAYSLECWGGATFDVAMRFLYEDPWDRLRKLRKAVPNIPFQMLLRGANGVAYSSLPDNAIYHFCKQAKKCGVDIFRVFDALNDVDQLEVGIKAVHAAEGVVEATICYSGDMLNPSKKYNLPYYLDLVDKVVQFKPHVLGIKDMAGVLKPQAARLLIGSIRERYPDLPIHVHTHDSAGTGVASMIACAQAGADAVDAATDSLSGMTSQPSIGAILASLEGTEHDPGLNSAQVRALDTYWAQLRLLYSPFEAGLTGPDPEVYEHEIPGGQLTNLIFQASQLGLGQQWAETKKAYESANDLLGDVVKVTPTSKVVGDLAQFMVSNKLTAEDVIARAGELDFPGSVLEFLEGLMGQPYGGFPEPLRSRALRDRRKLDKRPGLYLEPLDLAKIKSQIRENYGAATEYDVASYAMYPKVFEDYKKFVAKFGDLSVLPTRYFLAKPEIGEEFHVELEKGKVLILKLLAIGPLSEQTGQREVFYEVNGEVRQVSVDDKKASVENTARPKAELGDSSQVGAPMSGVVVEIRVHDGLEVKKGDPIAVLSAMKMEMVISAPHSGKVSSLLVKEGDSVDGQDLVCKIVKA

SEQ ID NO: 5050 - DNA, 1482 bp, Methanosarcina barkeri
  CDS (1)..(1482)
atgttcaaaaaagtactcattgcaaaccgcggtgagattgcaatcagggttatgcgtgcatgccgtgaacttgggatttcaacggttgcggtctgttcggaagctgataaaaacgccctctttgccaaatatgcagacgaagcctacctgataggcccggccccttccagccagagctatctgaatatggaagctattcttgcagttgcaaaaaacacaggagctgaagcaattcatccgggctatggtttcctctccgaaaaccctgtctttgcaaaacgctgtgaggaagaaggaatcgtcttcataggccctccaagccatgtgattgccgaaatgggaagcaagatcagggccagaaatcttatggtgaaggctggtgttcctgttgtgcctgggacgaaagacgcagttgaggatccggtcgaggctgtaaaaattgcagaagagatcggctatcctgttttgattaaagcctcggcaggtggcggcggaattgggatgaaagtagttaattccagcgacgaattcgccactgcacttagctctaccaggcaaatggctggttcagcttttggtgactcctcggttttcattgaaaaatatgtcgaggagcccaggcacatagagatccagattctagcagatggatatggaaacacgatttacctttcagatagggaatgctccattcagagacggcatcagaagcttattgaggaagctccttcacctatcatgactcctgaactcagggcaaagatgggagaagccgcagtcagggtagcaaagacaattggttacgtaaatgctgggacagtggagtttctttattcaaagggcaacttctatttccttgaagtcaatactcgcttgcaggtcgaacatgggataactgagatggttacaggtatcgatattgtaagagagcagctcaggatagcctgggggaaaaagcttgagtttaaacaggaagatattgttattgatgggcattctattgagtgcaggatcaacgcagaagatccgttaaacgactttgctccttctcccggaaagatccggggatatcggtcagcaggtgggcctggagtcagggtggacagcggagtacatacaggttacaccatttctccttactacgattcaatgatttcgaaactctgcgtctgggcaaagacaagggatgcagcgattgccaggatggaaagagctctttacgagtatgtggttgttggagtgaaaaccaatatacccttccataaagcagtcatgcgtaatccagtcttccgcaggggcgacctgacaacggcttttatcgaagataataatattatggaagccgttgaagaggttgtcaaagcagatgctgaaaaaggggctactctggcttctgctcttgaagcaaaagacaagaaagttgcggccattacggctgccgtgcatgcctatgtgagcatggcccagaaaacacagcggtga

SEQ ID NO: 5051 - protein, 493 aa, Methanosarcina barkeri
MFKKVLIANRGEIAIRVMRACRELGISTVAVCSEADKNALFAKYADEAYLIGPAPSSQSYLNMEAILAVAKNTGAEAIHPGYGFLSENPVFAKRCEEEGIVFIGPPSHVIAEMGSKIRARNLMVKAGVPVVPGTKDAVEDPVEAVKIAEEIGYPVLIKASAGGGGIGMKVVNSSDEFATALSSTRQMAGSAFGDSSVFIEKYVEEPRHIEIQILADGYGNTIYLSDRECSIQRRHQKLIEEAPSPIMTPELRAKMGEAAVRVAKTIGYVNAGTVEFLYSKGNFYFLEVNTRLQVEHGITEMVTGIDIVREQLRIAWGKKLEFKQEDIVIDGHSIECRINAEDPLNDFAPSPGKIRGYRSAGGPGVRVDSGVHTGYTISPYYDSMISKLCVWAKTRDAAIARMERALYEYVVVGVKTNIPFHKAVMRNPVFRRGDLTTAFIEDNNIMEAVEEVVKADAEKGATLASALEAKDKKVAAITAAVHAYVSMAQKTQR

SEQ ID NO: 5052 - DNA, 1845 bp, Streptomyces coelicolor
  CDS (1)..(1845)
atgatcacttccgtcctcgtcgccaaccgcggcgagatcgcctgccgcgtcttcagcacctgccgcgagtcgggcatccgcaccgtcgccgtgcactcggacgccgacgcgaacgccctccacgcgcgcgtggccgacgccgccgtacgcctgccgggcgcggcccccgccgacacctatctgcgcggcgacctgatcgtgaaggccgccgtcgccgccggagccgacgccgtccaccccggctacggcttcctctccgagaacgccgacttcgcgcgcgccgtacgggacgcggggctggtgtggatcggaccgccgcccgaggccatcgaggcgatggcgtccaagacccgcgccaaggaactgatgggcatcgcgcccctcaccgacgtcaccgaggccgacctgccggtgctggtgaaggcggcggcgggcggcggcggacgcggcatgcgcgtcgtacgccgcctcgccgacctcgacgccgaactgaccgccgcccgcgcggaggccgcgagcgccttcggcgacggcgaggtcttcgtcgagccgtatgtggtcgacggccgccacgtcgaggtgcagatcctcgccgacacccacggcacggtgtgggtgctcggcacccgcgactgctccctccaacgccgccaccagaaggtgatcgaggaggccccggcgcccggcctgacccccgggctcaccgccgaactccacgacctcgccgtgcgcgccgcccgcgccgtcgactacgtcggcgcgggcaccgtcgagttcctcgtcgccgacggcacggcgcacttcctggagatgaacacccgcctccaggtcgaacacccggtcacggaggcggtcttcggcatcgacctcgtcgccctccagctccggatcgccgaaggccacgccctcgacgacgaccccccgcgcgcgcgtggccacgccgtcgaggcccgcctctacgccgaggacccggcgaacggctgggccccgcagaccggccgcctgcaccgcctcgccgtgccggacggcatccgcctggacaccggctacaccggcggcgacgacatcggcgtccactacgacccgatgctcgccaaggcggtcgcccacgcacccacgcgcgcggaggccgtccgccgactcgccggcgccctggaacgcgccgcgatccacggcccggtcaccaaccgcgacctcctcgtccgctccctgcgccacgaggagttcacctccggccgcatggacacgggcttctacgaccgccacctcgccgccctcaccgagccggcccccgaccccctcgccccgctggccgccgccctcgccgacgcgagcacccgtgcgggacgcttcggcggctggcgcaacctgccctcgcaaccgcaggtcaagcggtacgccgtggcgggcgaggaacacgaggtccgttacgggcacacccgcacgggcctcaccgccgagggcgtccgcgtcgtccacgcgggccccgaccgggtcgtcctcgaagcggacggcgtacaacgccccttcgacatcgcccgctacggcgaccacgtgcacgtcaacaccacgcgcctcaccgccctgccccgcttccccgaccccaccacccagcacgcccccggctccctcctggcccccatgccgggcacggtcgtccgcgtcgcggagggcctgaccgagggcaccaccgtccaggcgggccagccgttgctgtggctggaggccatgaagatggaacacaggatcaccgccccggtgacagggaggctgaccgcactcccggcgggcctcggacgacaagtagagatgggcgccctcttggcggtcgtcgagtccgactga

SEQ ID NO: 5053 - protein, 614 aa, Streptomyces coelicolor
MITSVLVANRGEIACRVFSTCRESGIRTVAVHSDADANALHARVADAAVRLPGAAPADTYLRGDLIVKAAVAAGADAVHPGYGFLSENADFARAVRDAGLVWIGPPPEAIEAMASKTRAKELMGIAPLTDVTEADLPVLVKAAAGGGGRGMRVVRRLADLDAELTAARAEAASAFGDGEVFVEPYVVDGRHVEVQILADTHGTVWVLGTRDCSLQRRHQKVIEEAPAPGLTPGLTAELHDLAVRAARAVDYVGAGTVEFLVADGTAHFLEMNTRLQVEHPVTEAVFGIDLVALQLRIAEGHALDDDPPRARGHAVEARLYAEDPANGWAPQTGRLHRLAVPDGIRLDTGYTGGDDIGVHYDPMLAKAVAHAPTRAEAVRRLAGALERAAIHGPVTNRDLLVRSLRHEEFTSGRMDTGFYDRHLAALTEPAPDPLAPLAAALADASTRAGRFGGWRNLPSQPQVKRYAVAGEEHEVRYGHTRTGLTAEGVRVVHAGPDRVVLEADGVQRPFDIARYGDHVHVNTTRLTALPRFPDPTTQHAPGSLLAPMPGTVVRVAEGLTEGTTVQAGQPLLWLEAMKMEHRITAPVTGRLTALPAGLGRQVEMGALLAVVESD

SEQ ID NO: 5054 - DNA, 1941 bp, Streptomyces coelicolor
  CDS (1)..(1941)
atgttcgacaccgtgctcgtcgccaaccgcggcgagatcgccgtccgcgtcatccggacgctgcgctcgatgggcgtgcgctcggtggcggtcttctccgacgccgacgcggacgcacggcacgtgcgggaggcggacgacgcggtacggatcggcccggcgcccgcgacggagagctatctgtccgtcgagcggctgctggcggcggcggcccggacgggggcgcaggccgtccacccgggatacggcttcctcgccgagaacgcgggtttcgcgcgggcctgcgaggaggcggggctggtcttcatcgggccgtccgccgacgcgatcgccctgatgggcgacaagatccgcgccaaggagacggtgcgggcggccggggtgccggtcgtccccggctccagcggcagcgggctcaccgacgagcagctcgccgacgccgcccgcgagatcggcaccccggtgctgctcaagccgtcggcgggcggtggcggcaagggcatgcggctggtgcgggacacggcggtgctggccgacgagatcgccgccgcgcgccgcgaggcccgcgcctccttcggcgacgacacgctgctggtggagcggtggatcgaccgtccccggcacatcgagatccaggtgctggccgacggccacgggggcgtggtgcacctgggcgagcgcgagtgctcgctccagcgccgccaccagaaggtgatcgaggaggcgcccagcgtcctgctggacgaggcgacccgggcggcgatgggcgaggcggccgtgcaggcggcccggtcctgcggctaccggggcgcgggcacggtggagttcatcgtgcccgggagcgacccctcccagtactacttcatggagatgaacacccgtctccaggtcgagcacccggtgacggagctggtgaccggcctggacctggtggagtggcagctgcgggtggcggcgggcgagccgctcgggttcgggcaggaggacgtacggctgaccgggcacgcgatcgaggcccggctgtgcgcggaggacccggcgcgcggcttcctgccctccggcggcacggtgctgcggctgcgcgagcccgagggcgacggcgtgcgcaccgactcggggctcagtgagggcaccgaggtcggcagcctctacgacccgatgctgtccaaggtgatcgcgtacggccccgaccgggagaccgcgctgcgcaggctccgggcggcgctggccgggacggtcaccctgggcgtgcagaccaacgccgggttcctgcggcggctgctcgcgcacccggcggtggtggcgggcgagctggacacggggctggtggagcgcgaggtcgacggcctggtcgccaccgacgtaccggaggaggtgtacgaggcggcggcggccgtacggctggaggcgctgcgcccgcgcggggacggctggacggacccgttctcggtgccgagcggctggcggatgggcggcgagccgaaggcggccgccttccacctccgggtcaccgacccggtggaacacaccccgcgcggaacccacaccgtcaccggggaccgggtcacggtcaccctggacggcgtccggcacaccttccaccgcgccgccgactggctgggccgcgacggcgacgcctggcaggtgcgcgaccacgacccggtggccgcctccctcaaccggtccgcccacgcgggcgccgactcgctgaccgcgccgatgccgggcacggtgacggtggtgaaggtcgccgtcggcgacgaggtgagcgccgggcagagcctgctggtggtggaggcgatgaagatggagcacgtcatctccgccccgcacgcgggcaccgtcgccgagctggacgtggcgccgggcacgacggtcgccatggaccaggtgctcgcggtcatcgcacccaccgacgacgcgacggaggagacggcatga

SEQ ID NO: 5055 - protein, 646 aa, Streptomyces coelicolor
MFDTVLVANRGEIAVRVIRTLRSMGVRSVAVFSDADADARHVREADDAVRIGPAPATESYLSVERLLAAAARTGAQAVHPGYGFLAENAGFARACEEAGLVFIGPSADAIALMGDKIRAKETVRAAGVPVVPGSSGSGLTDEQLADAAREIGTPVLLKPSAGGGGKGMRLVRDTAVLADEIAAARREARASFGDDTLLVERWIDRPRHIEIQVLADGHGGVVHLGERECSLQRRHQKVIEEAPSVLLDEATRAAMGEAAVQAARSCGYRGAGTVEFIVPGSDPSQYYFMEMNTRLQVEHPVTELVTGLDLVEWQLRVAAGEPLGFGQEDVRLTGHAIEARLCAEDPARGFLPSGGTVLRLREPEGDGVRTDSGLSEGTEVGSLYDPMLSKVIAYGPDRETALRRLRAALAGTVTLGVQTNAGFLRRLLAHPAVVAGELDTGLVEREVDGLVATDVPEEVYEAAAAVRLEALRPRGDGWTDPFSVPSGWRMGGEPKAAAFHLRVTDPVEHTPRGTHTVTGDRVTVTLDGVRHTFHRAADWLGRDGDAWQVRDHDPVAASLNRSAHAGADSLTAPMPGTVTVVKVAVGDEVSAGQSLLVVEAMKMEHVISAPHAGTVAELDVAPGTTVAMDQVLAVIAPTDDATEETA

SEQ ID NO: 5056 - DNA, 1293 bp, Bacillus subtilis
  CDS (1)..(1293)
atgagaatcatacgtacgtgcagccgccttgggatcaaaacggcagcggtatattctgaagcagacagagatgcgctccatacaaaggcagcaacagaggcttattatatcggagaatcgagagtcagtgagagctatttaaatattgagagaatcatagaggcggcgaaaaaggcaaatgccgacgccatccatccgggatatggattattgtcagaaaacagccgtttcgcgcaacgctgcaaagaagaaaacattgtatttatcggtccttcacccgctgtgattgccaaaataggaagtaagattaaagcacgaaaggcaatggaggaggcaggtgttcctgtagtgccgggtgtttccgaatcccttggagatattcaggcagcctgcctcgccgcgagtgaaatcggctaccccgttatgctgaaagcttcagcagggggaggaggcatcggaatgcagctcgttcctgacgaagaagcattgataaaggcgtatgaaggaaacaaaaagcgagcagcagattttttcggagacggctccatgtatatagaaaaggtgattgaacacgcccgccacatcgaaattcaaattcttgcagatcaccatgggcatgctgtgcatctgtttgaacgtgattgttctgtccagagacgccaccaaaaggtcattgaagaagccccatctccatttgttgatgatgagctgagaatgaagataggagaaacggcagtgaaagcagccaaagcgatcggctatgccaatgcgggaacgatcgaatttttagtcgatgagaataaaaacttttattttctggaaatgaatacgagattgcaggtagaacatcccgtgactgaagaaattacaggtttagatttagttgagcagcaattaagggttgcggagggacagactctcagattctctcagcaggacataaaacgaaacggccatgccatagaggtcagaatatatgcggaagatccgaaaacctctatcccgtcaccggggacaatcaccgctttttctctcccggaacaatatggagtccgacacgaatgtgcagtagcaacagggagcgcagttacgcctttttacgatccgatgatcgccaaaatgatcgtcaaaggcccaaacagagaggaagcgattgagaggctaaaggaggcgctccgtgactatcggatagaaggcatcaaaacgaatattccgcttctcttacaggctgcttcatcagaagcattcaaaaaaggagacgtcacgactgattttttgaaaaacaacttataa

SEQ ID NO: 5057 - protein, 430 aa, Bacillus subtilis
MRIIRTCSRLGIKTAAVYSEADRDALHTKAATEAYYIGESRVSESYLNIERIIEAAKKANADAIHPGYGLLSENSRFAQRCKEENIVFIGPSPAVIAKIGSKIKARKAMEEAGVPVVPGVSESLGDIQAACLAASEIGYPVMLKASAGGGGIGMQLVPDEEALIKAYEGNKKRAADFFGDGSMYIEKVIEHARHIEIQILADHHGHAVHLFERDCSVQRRHQKVIEEAPSPFVDDELRMKIGETAVKAAKAIGYANAGTIEFLVDENKNFYFLEMNTRLQVEHPVTEEITGLDLVEQQLRVAEGQTLRFSQQDIKRNGHAIEVRIYAEDPKTSIPSPGTITAFSLPEQYGVRHECAVATGSAVTPFYDPMIAKMIVKGPNREEAIERLKEALRDYRIEGIKTNIPLLLQAASSEAFKKGDVTTDFLKNNL

SEQ ID NO: 5058 - DNA, 1323 bp, Lactobacillus plantarum
  CDS (1)..(1323)
atgtttcgcaagctgttaatcgcgaatcgcggtgaaattgccgtacggattatcaaagcctgtcaacaattgaatattcagacggtcgccgtttgctcaactgccgatcggcatgcgggttacacacaattagcggatgaagtggtctgtatcggacctgcagctgccagtggatcgtatttaaatgccgaagcgattctaatggctgcaattaatacgcacgccgatgcgattcacccgggatatggttttttagctgaaaatgcggattttgccgccatgtgtgcggaatgtggcattgcctggattggcccgcagactgagcaaattaagttgatgggtgataaggcccgcgctaaggattttgcacggcaacaagccgttccggtactagcaggtcaatcattacagggcttagcatggccggatattaaacacgcggccgccaagatcggttttccactagttttgaaagccagttatggtggcggtggcaagggtattcgagtgcttaccgacgttcatgaactccatcaacaattgcgggctgcgcgtcaagaagctgctgcgtcctttttgaacgatgcgatgtatttagagcaatttctgacaactgcccgccacattgaagttcaagtcctcggcacggggacgaaattattcattcttggtgatcgtgattgtagcctccaattgcacaagcaaaaggttctcgaagaaagtccggcaagtattttgactgagacacaacgccggaccttatacgatctgtcccggcagttattagcgggtacacattatcaaagcttgggcacaattgaatacttatttgcggatggtcagttctatttcatggaaatgaatacgcgtttacaggttgaacacggggtgacagaattaaccaccggaattgatattgtggctgaacaaatcaaacaggcggctggcgtcacggttgattttccagagcatgttggcttgcagcccaagtgtacggcgatcgaagctcgattgaccgctaccttaccggttaagcagacgcggattgaaacgctgagctggccagccgatgtacgagtggatacggattatcatcagggcgatcggctagtaaccatgtatgatggtttaattgccaagttgatggtcaccggtgcgaaccgtcagcaagccgtgcgcaacttacaacgggccttagcgcaagtaacattgacaggacccacgacgaacttaacttttctacagcaaacggtggcccggccggcctacattcatgatcagtacacgattcacagtctagcacgttgggaggcgtcgaaatga

SEQ ID NO: 5059 - protein, 440 aa, Lactobacillus plantarum
MFRKLLIANRGEIAVRIIKACQQLNIQTVAVCSTADRHAGYTQLADEVVCIGPAAASGSYLNAEAILMAAINTHADAIHPGYGFLAENADFAAMCAECGIAWIGPQTEQIKLMGDKARAKDFARQQAVPVLAGQSLQGLAWPDIKHAAAKIGFPLVLKASYGGGGKGIRVLTDVHELHQQLRAARQEAAASFLNDAMYLEQFLTTARHIEVQVLGTGTKLFILGDRDCSLQLHKQKVLEESPASILTETQRRTLYDLSRQLLAGTHYQSLGTIEYLFADGQFYFMEMNTRLQVEHGVTELTTGIDIVAEQIKQAAGVTVDFPEHVGLQPKCTAIEARLTATLPVKQTRIETLSWPADVRVDTDYHQGDRLVTMYDGLIAKLMVTGANRQQAVRNLQRALAQVTLTGPTTNLTFLQQTVARPAYIHDQYTIHSLARWEASK

SEQ ID NO: 5060 - DNA, 1620 bp, Glycine max
  CDS (1)..(1620)
atggaagtcacactttcagcctgcaagtccgttagctcgccttctgttcccgtcgcaggtttgtttgcggggaatggaggaattaagagctcgcaatgcagtttcttagcgggagcgagcaaagtgaggtttcctaggcaagtaggtcaagttagccaccttcgcaaacagcgccaaacgcgtcactgcggtgctctccacgcgacttgcagcggtgacaagatcctgatcgcgaacagaggcgagattgccgtccgcgttattcgaaccgctcatgaattggggattccttgtgtggctgtgtactccaccatcgacaaggacgcgcttcatgtcaaattggctgatgaagccgtttgcatcggggaagcgccgagtagccagtcctacttgctgatcccgaatgttctgtcagctgctattagccgcagatgcaccatgttgcatcctggctatggttttcttgcggagaatgcagtgtttgttgaaatgtgcagagaacatggaatcaactttattgggcctaaccctgacagtattcgggttatgggtgacaaagcaactgccagagagacaatgaagaaagcaggtgttcccaccgttccgggaagtgatggccttttacagagcacagaagaagccatcagactggcaaatgagattggtttccctgtgatgatcaaggcaacagctggtggtggaggacgtggcatgcgtcttgctaaagaacctgctgagcttgtgaagtttttacagcaagctaagagtgaggcagctgctgcatttggcaatgatggggtttatttggagaagtacattcaaaacccaaggcacattgagttccaggttcttgcagataaatatggtaatgttgttcactttggagaacgtgattgcagcattcagaggcgcaaccagaaactgcttgaagaagcaccatctcctgccctgacccctgagttgcgaaaggcaatgggagatgcagcagttgcagctgctgcatctattggttacataggtgttggaacggttgagttccttttggatgaaagaggttccttttactttatggagatgaacactcgtatccaggttgagcatccggtgacagaaatgatttcctcaacggatttgatagaagagcaaattcgtgtagctatgggagaaaaacttcgatacaaacaggaggatattgtcctcagaggvcattctattgaatgccgtatcaatgcagaagatgcttttaagggatttagaccagggccaggtagaattactgcatacttgccatccggaggtccatttgttagaatggatagccatgtttatcctgattatgtggttcctccaagctatgattcccttcttggaaagctgattgtatgggccccaactagagaaaaagcaattgaacgcatgaaaagggcacttgatgatactattatcacaggagttcctactacaattgattatcataaacttatccttgacatagaggatttcagaaatggcaaggttgatactgcttttattccaaaacacgaggaagagttggcaatgccaccgcagaagatggtactcgctaacagggtgaatgaactagctggttcaactgcctga

SEQ ID NO: 5061 - protein, 539 aa, Glycine max
MEVTLSACKSVSSPSVPVAGLFAGNGGIKSSQCSFLAGASKVRFPRQVGQVSHLRKQRQTRHCGALHATCSGDKILIANRGEIAVRVIRTAHELGIPCVAVYSTIDKDALHVKLADEAVCIGEAPSSQSYLLIPNVLSAAISRRCTMLHPGYGFLAENAVFVEMCREHGINFIGPNPDSIRVMGDKATARETMKKAGVPTVPGSDGLLQSTEEAIRLANEIGFPVMIKATAGGGGRGMRLAKEPAELVKFLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSTDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFRNGKVDTAFIPKHEEELAMPPQKMVLANRVNELAGSTA

SEQ ID NO: 5062 - DNA, 3622 bp, Lactococcus lactis
  CDS (105)..(3518)
caaatgtcagtcgtttaaaagtgtataaaagatttttataatatatggaagagtgaaaggaattaataattacctttccaaacaagcctcattaaggagtcaaaatgaaaaaactactcgtcgccaatcgtggagaaatcgccgttcgtgtctttcgtgcctgtaatgaactcggactttctacagtagccgtctatgcaagagaagatgaatattccgttcatcgctttaaagcagatgaatcttaccttatcggtcaaggtaaaaaaccaattgatgcttatttggatattgatgatattattcgtgttgctcttgaatcaggagcagatgccattcatcccggttatggtcttttatctgaaaatcttgaatttgctacaaaagttcgagcagcaggattagtttttgtcggtcctgaacttcatcatttggatattttcggcgataaaatcaaagcaaaagccgcagctgatgaagctcaagttcccggaattcccggaacaaatggtgcagtagatattgacggagctcttgaatttgctcaaacttacggatatccagtcatgattaaggcagcattgggcggcggcggtcgtggaatgcgtgttgcgcgtaatgacgctgaaatgcacgacggatatgctcgtgcgaaatcagaagctatcggtgcctttggttctggagaaatctatgttgaaaaatacattgaaaatcctaagcatattgaagttcaaattcttggggatagtcatggaaatattgtccatttgcacgaacgtgattgctctgtccaacgccgaaatcaaaaagtcattgaaattgctccagccgtaggactctcaccagagttccgtaatgaaatttgtgaagcagcagttaaactttgtaaaaatgttggctatgttaatgctgggacggttgaatttttagtcaaagatgataagttctactttatcgaagtcaacccacgtgttcaagttgaacacacaattaccgagcttattacaggtgtagatattgttcaagcacaaattttgattgctcaaggcaaagatttacatacagaaattggtatcccggcacaagctgaaataccacttttgggctcagccattcaatgtcgtattactacagaagacccgcaaaatggcttcttgccagatacaggtaaaatcgatacctaccgttcaccaggtggtttcggcattcgtttggacgttggaaatgcctatgctggttatgaagtgactccctattttgactcgcttttagtaaaagtttgtacctttgctaatgaatttagcgatagtgtacgtaaaatggatcgtgtgcttcatgaattccgtattcgtggggtgaaaactaatattccatttttgattaatgttattgccaatgaaaactttacgagcggacaagcaacaacaacctttattgacaatactccaagtcttttcaatttcccacgcttacgtgaccgtggaacaaaaaccttacactacttatcaatgattacagtcaatggtttcccagggattgaaaatacagaaaaacgccattttgaagaacctcgtcaacctctacttaacattgaaaagaaaaagacagctaaaaatatcttagatgaacaaggggctgatgcggtagttgaatatgtgaaaaatacaaaagaagtattattgacagatacaactttacgtgatgctcaccagtctcttcttgccactcgtttgcgtttgcaagatatgaaaggaattgctcaagccattgaccaaggacttccagaacttttctcagctgaaatgtggggtggggcaacctttgatgtcgcttatcgtttcttgaatgaatcgccttggtatcgtctacgtaaattacgtaaactcatgccaaataccatgttccaaatgcttttccgtggttcaaatgcagttggatatcaaaactatcctgataatgtcattgaagaatttatccacgtagctgcacatgaaggaatcgatgtctttcgtatctttgatagcctcaactggttgccacaaatggaaaaatcaatccaagcagtgcgtgataatggaaaaattgccgaagcaaccatttgttatacaggagatatccttgacccaagtcgaccaaaatataatatccaatactacaaagatttggcaaaagagttagaagctactggggctcatatacttgccgttaaagatatggcgggcttgttgaaacctcaagcggcatatcgcttgatttcagaattaaaagatacggttgacttaccaattcacttgcatacacatgatacttcaggaaatggtattattacctattctggtgcaactcaagcaggagtagatattattgatgtggcaactgccagtcttgctggtggaacttctcaaccttcaatgcaatcaatttattatgcccttgaacatggtccccgtcatgcttcaattaatgtgaaaaatgcagagcaaattgaccattattgggaagatgtgcgtaaatattatgcaccttttgaggcaggaattacgagcccacaaactgaagtttacatgcatgaaatgcctggcggacaatatactaacttgaaatctcaagcagcagctgttggacttggacatcgttttgatgaaatcaaacaaatgtatcgtaaagtaaacatgatgtttggcgatatcattaaagtaactccttcatcaaaagtagttggtgatatggcactctttatgattcaaaacgaattgacagaagaggatgtctatgcgcgaggaaatgagcttaacttccctgaatcagtagtctcattcttccgtggtgatttaggacagcctgttggaggtttcccagaagaactacaaaaaattattgtaaaagacaaatcggtcattatggatcgtccaggattacatgccgaaaaagttgattttgcaactgtaaaagctgacttggaacaaaaaattggttatgaaccaggtgatcatgaagttatctcttacattatgtatccacaagttttccttgattatcaaaaaatgcaaagagaatttggagctgtcacactactcgatactccaactttcttacacggaatgcgcctcaatgaaaaaattgaagtccaaattgaaaaaggtaaaacgctcagcattcgtttagatgaaataggagaacctgacctcgctggaaatcgtgtgctcttctttaacttgaacggtcagcgtcgtgaagttgttattaatgaccaatccgttcaaactcaaattgtagctaaacgtaaggccgaaacaggtaatccaaaccaaattggagcaactatgcccggttctgttcttgaaatcctagttaaagctggagataaagttaaaaaaggacaagctttgatggttactgaagccatgaagatggaaacgaccattgagtcaccatttgatggagaggttattgcccttcatgttgtcaaaggtgaagccattcaaacacaagacttattgattgaaattgactaactttaaattaaccctaccattatggtaggattttttattttctaaaaaaaagtaattttaattttcagaaaatatataattttcggaataaaaagtgtataata

SEQ ID NO: 5063 - protein, 1137 aa, Lactococcus lactis
MKKLLVANRGEIAVRVFRACNELGLSTVAVYAREDEYSVHRFKADESYLIGQGKKPIDAYLDIDDIIRVALESGADAIHPGYGLLSENLEFATKVRAAGLVFVGPELHHLDIFGDKIKAKAAADEAQVPGIPGTNGAVDIDGALEFAQTYGYPVMIKAALGGGGRGMRVARNDAEMHDGYARAKSEAIGAFGSGEIYVEKYIENPKHIEVQILGDSHGNIVHLHERDCSVQRRNQKVIEIAPAVGLSPEFRNEICEAAVKLCKNVGYVNAGTVEFLVKDDKFYFIEVNPRVQVEHTITELITGVDIVQAQILIAQGKDLHTEIGIPAQAEIPLLGSAIQCRITTEDPQNGFLPDTGKIDTYRSPGGFGIRLDVGNAYAGYEVTPYFDSLLVKVCTFANEFSDSVRKMDRVLHEFRIRGVKTNIPFLINVIANENFTSGQATTTFIDNTPSLFNFPRLRDRGTKTLHYLSMITVNGFPGIENTEKRHFEEPRQPLLNIEKKKTAKNILDEQGADAVVEYVKNTKEVLLTDTTLRDAHQSLLATRLRLQDMKGIAQAIDQGLPELFSAEMWGGATFDVAYRFLNESPWYRLRKLRKLMPNTMFQMLFRGSNAVGYQNYPDNVIEEFIHVAAHEGIDVFRIFDSLNWLPQMEKSIQAVRDNGKIAEATICYTGDILDPSRPKYNIQYYKDLAKELEATGAHILAVKDMAGLLKPQAAYRLISELKDTVDLPIHLHTHDTSGNGIITYSGATQAGVDIIDVATASLAGGTSQPSMQSIYYALEHGPRHASINVKNAEQIDHYWEDVRKYYAPFEAGITSPQTEVYMHEMPGGQYTNLKSQAAAVGLGHRFDEIKQMYRKVNMMFGDIIKVTPSSKVVGDMALFMIQNELTEEDVYARGNELNFPESVVSFFRGDLGQPVGGFPEELQKIIVKDKSVIMDRPGLHAEKVDFATVKADLEQKIGYEPGDHEVISYIMYPQVFLDYQKMQREFGAVTLLDTPTFLHGMRLNEKIEVQIEKGKTLSIRLDEIGEPDLAGNRVLFFNLNGQRREVVINDQSVQTQIVAKRKAETGNPNQIGATMPGSVLEILVKAGDKVKKGQALMVTEAMKMETTIESPFDGEVIALHVVKGEAIQTQDLLIEID

SEQ ID NO: 5064 - DNA, 3375 bp, Streptomyces coelicolor
  CDS (1)..(3375)
atgttccgcaaggtgctggtcgccaaccgcggtgagatcgcgatccgtgcgtttcgggcgggctacgagctcggcgcgcgcaccgtcgccgtcttcccgcacgaggaccgcaattcgctgcaccggctcaaggccgacgaggcctacgagatcggggagcaggggcatcccgtccgcgcgtacctctccgtggaggagatcgtgcgcgccgcccgccgtgcgggggccgacgccgtctacccgggctacggcttcctgtccgagaaccccgaactcgcccgcgcctgcgaggaggccgggatcaccttcgtcggtcccagcgcccggatcctggaactgaccggcaacaaggcacgggccgtggccgccgcccgcgaggccggagtacccgtgctcggctcctcggcgccctccaccgacgtggacgaactcgtacgcgccgccgacgacgtcggcttccccgtgttcgtcaaggcggtcgcgggcggcggcgggcgcggcatgcgccgcgtcgaggaacccgcccagctgcgcgaggccatcgaggccgcctcccgcgaggccgcgtccgccttcggcgactccaccgtcttcctggagaaggcggtcgtcgaaccccgccacatcgaggtgcagatcctcgccgacggcgagggcgacgtcatccacctcttcgagcgggactgctcggtgcagcgccgccaccagaaggtgatcgagctggcgcccgcgcccaacctcgacccggccctgcgggagcggatctgcgccgacgccgtgaacttcgcccggcagatcggctaccgcaacgcgggcaccgtcgagttcctcgtcgaccgggacggcaaccacgtcttcatcgagatgaacccgcgcatccaggtcgagcacacggtcaccgaggaggtcaccgacgtcgacctggtccagtcccagctgcgcatcgccgccggccagacgctggccgacctcggactcgcccaggagaacatcaccctgcgcggtgccgcactccagtgccgcatcaccaccgaggacccggccaacggcttccgcccggacaccgggcagatcagcgcctaccgttcgccgggcggctccggcatccggctcgacggcggtaccacccacgccggtacggagatcagcgcgcacttcgactcgatgctggtcaagctctcctgccggggacgggacttcaccaccgcggtgaaccgcgcccggcgtgcggtcgccgagttccgcatccgcggcgtcgccaccaacatccccttcctccaggcggtcctggacgaccccgacttccaggccggccgggtcaccacctcgttcatcgaacagcgcccgcacctgctgaccgcccggcactccgccgaccgcggcaccaagctgctgacctacctcgccgacgtcacggtgaacaagccgcacggcgagcgccccgagctggtcgacccgctgaccaagctgccgacggcgtccgccggtgaaccgcccgccgggtcccgccagttgctggccgagctggggccggaggggttcgcccgccgactgcgcgagtcgtccaccatcggcgtcaccgacaccaccttccgcgacgcccaccagtcgctgctcgccacccgggtgcgcaccaaggacatgctcgccgtggcgcccgtcgtcgcccgcaccctgccccagctgctgtccctggagtgctggggcggcgccacctacgacgtcgccctgcgcttcctcgccgaggacccctgggagcggctagccgcgctgcgcgaggcggtgcccaacctctgcctccagatgctgctgcgcggccgcaacaccgtgggctacaccccgtacccgaccgaggtgaccgacgccttcgtgcaggaggccgccgccaccggcatcgacatcttccgcatcttcgacgccctcaacgacgtcgagcagatgcggcccgccatcgaggccgtacggcagaccggcagcgccgtcgccgaggtcgcgctctgctacaccgccgacctgtccgacccctccgagcggctctacaccctcgactactacctgcggctcgccgagcagatcgtgaacgccggagcgcacgtgctggccgtcaaggacatggccgggctgctgcgcgcaccggccgccgcgaccctggtgtccgcgctgcgccgggagttcgacctgccggtgcacctgcacacccacgacaccaccggcggccagctcgccacctacctggccgcgatccaggcgggcgcggacgccgtcgacggtgcggtggcgtccatggcgggcaccacttcgcagccgtcgctgtcggcgatcgtggccgccaccgaccacaccgagcggcccaccggcctcgacctccaggccgtcggcgacctggagccgtactgggagagcgtccgcaaggtctacgccccgttcgaggccggcctggcctccccgaccggccgggtctaccaccacgagattcccggcggccagctctccaacctgcgcacccaggccgtcgcgctcggcctcggcgaccgcttcgaggacatcgaggccatgtacgccgccgccgaccggatgctgggccgcctggtgaaggtcaccccgtcctccaaggtggtcggcgacctggccctgcatctggtgggcgccggtgtctccccggcggacttcgagcaggaccccgaccggttcgacatcccggactccgtggtcggcttcctgcgcggcgagctgggcaccccgcccggcggctggcccgagccgttccgcagcaaggcgctgcgcggccgcgccgaggccaggccgctcgccgagctgtccgaggacgaccgcgacggcctcggcaaggaccgccgggcgacgctcaaccggctgctgttcccgggaccggcccgcgagttcgacacccaccgcgcctcgtacggcgacaccagcatcctcgacagcaaggacttcttctacgggctgcgcccgggcaaggagtacacggtcgacctcgaccccggcgtccggctgctcatcgaactccaggcggtcggcgacgccgacgagcgcggcatgcgcaccgtgatgtcctccctgaacggacagctccgccccatccaggtccgcgaccggtcggccgccaccgacgtcccggtgacggagaaggccgaccgggcgaaccccggccacgtcgcggcgccgttcgccggtgtggtgaccctcgccgtcgccgagggcgacgaggtggaggccggggccaccgtggccaccatcgaggcgatgaagatggaggcgtcgatcacggccccgaagtccggcacggtgaccaggctcgccatcaaccgcatccagcaggtcgagggcggcgatcttctcgtccaactcgcctga

SEQ ID NO: 5065 - protein, 1124 aa, Streptomyces coelicolor
MFRKVLVANRGEIAIRAFRAGYELGARTVAVFPHEDRNSLHRLKADEAYEIGEQGHPVRAYLSVEEIVRAARRAGADAVYPGYGFLSENPELARACEEAGITFVGPSARILELTGNKARAVAAAREAGVPVLGSSAPSTDVDELVRAADDVGFPVFVKAVAGGGGRGMRRVEEPAQLREAIEAASREAASAFGDSTVFLEKAVVEPRHIEVQILADGEGDVIHLFERDCSVQRRHQKVIELAPAPNLDPALRERICADAVNFARQIGYRNAGTVEFLVDRDGNHVFIEMNPRIQVEHTVTEEVTDVDLVQSQLRIAAGQTLADLGLAQENITLRGAALQCRITTEDPANGFRPDTGQISAYRSPGGSGIRLDGGTTHAGTEISAHFDSMLVKLSCRGRDFTTAVNRARRAVAEFRIRGVATNIPFLQAVLDDPDFQAGRVTTSFIEQRPHLLTARHSADRGTKLLTYLADVTVNKPHGERPELVDPLTKLPTASAGEPPAGSRQLLAELGPEGFARRLRESSTIGVTDTTFRDAHQSLLATRVRTKDMLAVAPVVARTLPQLLSLECWGGATYDVALRFLAEDPWERLAALREAVPNLCLQMLLRGRNTVGYTPYPTEVTDAFVQEAAATGIDIFRIFDALNDVEQMRPAIEAVRQTGSAVAEVALCYTADLSDPSERLYTLDYYLRLAEQIVNAGAHVLAVKDMAGLLRAPAAATLVSALRREFDLPVHLHTHDTTGGQLATYLAAIQAGADAVDGAVASMAGTTSQPSLSAIVAATDHTERPTGLDLQAVGDLEPYWESVRKVYAPFEAGLASPTGRVYHHEIPGGQLSNLRTQAVALGLGDRFEDIEAMYAAADRMLGRLVKVTPSSKVVGDLALHLVGAGVSPADFEQDPDRFDIPDSVVGFLRGELGTPPGGWPEPFRSKALRGRAEARPLAELSEDDRDGLGKDRRATLNRLLFPGPAREFDTHRASYGDTSILDSKDFFYGLRPGKEYTVDLDPGVRLLIELQAVGDADERGMRTVMSSLNGQLRPIQVRDRSAATDVPVTEKADRANPGHVAAPFAGVVTLAVAEGDEVEAGATVATIEAMKMEASITAPKSGTVTRLAINRIQQVEGGDLLVQLA

SEQ ID NO: 5066 - DNA, 8001 bp, Drosophila melanogaster
  CDS (177)..(7625)
atcgtcggtcactgcagtagccatctagaaatcgtgcggaaccagtcagtctaggaagttcaaaccgatcctacacggtctactacaatccgatccgatccggtccgacctcgtcttcgaaactgccatcacaagctaaacaagggcacacgcagagtgctttttggatttagccgatgttgatcacgatattaggcactctggctgcttttctcgcattcctcttgacattgatctttggccgcggccagaaaagatccaaacccgtccaatcgtctgcagcaacatccgccacgacagcaacaactggcgacagcgacaacggcaacaccaatcacaactccagcgtgattgcagctacagcaacggcaacaaccaccagcagcaagcctcctattgctccagcagcacctccttcggcggtaaaagcgagtgacaagcgattccccaaggcgtgcatcaagaaggtccagttctccagcgagagcctccggtccgacgtggatgagctgtgcgaccagctgaaggatagcgcactcagcaatctgagcaacgacaacattcgcattgcctgccaccagaacaacaacaacagcagcatcaacaagaaccagaacaacaacagcatcgacatcagcatcagcatcagcaagatgagcgaaacaaatgagtccaatgacacggccgcccaatccgccgagggcgagcggcccagctttttggtgggtgatgagatcgacgagcgggccgccgaggcgggcgaggcatgtgacgagttccccctgaagatgcagaacgatgtccgccagaatggcgatatttccgagcggcgcaagcggttaaggccgagtatgtcgcgtggcacagggctgggccaggaccggcaccaggatcgcgacttccacatcgcaaccaccgaggagttcgtgaagcgctttggcggcacccgagtgatcaacaaggtcctgattgccaacaacggtatcgcggccgtcaagtgcatgcgatccatccggagatgggcgtacgaaatgtttaagaacgagcgggccattaggtttgtggtgatggtcactccggaggatctaaaggcgaatgccgaatacatcaagatggcggatcactatgtgcccgtgcccggcggatcgaacaacaacaactacgccaatgtcgagctcatcgtggacattgctcttcgcacccaagtgcaggccgtgtgggctggttggggtcatgcctccgagaacccgaagctgccggagctgcttcacaaagagggtctggtgttccttggccctccggaacgtgccatgtgggcgctgggcgacaaggtggcctcctctattgtggcccaaacggccgagattcccaccctgccgtggtccggttcggacctgaaggcccagtacagtggcaaaaagatcaagatttccagtgagctcttcgcccgaggttgtgtgaccaatgtggaacagggtctggccgcagttaacaagattggcttccccgtaatgatcaaggcctcggaaggaggtggtggcaagggtattcgccgcgtggacaccactgaggagttccccggcctgttccgccaggttcaagctgaggtgcccggctcaccgattttcgtgatgaagctggcccgcggagctcgccacttggaggtgcaactgttggcagatcagtacggcaatgccattagcttgttcggccgtgactgctccatccagcgtcgtcatcagaaaattattgaggaagctcctgccatcgtggcccagccagaggtgttcgaggacatggagaaggccgccgtgcggttggccaagatggtgggttacgtcagcgcgggaaccgtggagtacctatatgatccggagggtcgctacttcttcctggagctgaacccacgtttgcaggtggagcatccgtgtacggagatggtggccgatgtaaatcttccagctgctcagctgcagattggaatgggaattcccctttaccggctcaaggacatccgtctgctgtacggagagtctccctggggctcctcagtcattgacttcgaaaatccaccgaacaaaccgcgtccctccggacatgttatcgctgctcgtatcacctcagagaaccccgacgagggctttaagcccagttctggaaccgttcaggagcttaacttccggtcgagcaaaaatgtgtggggctacttcagtgtggctgccagtggaggattgcacgagttcgcggattcacagtttgggcattgtttctcctggggcgagaaccgtcaacaggctcgagagaacctggtgattgccctgaaggagctgtcaattcgaggtgatttccgaaccacagtggaatacttgatcactctgctcgaaacgaatcggttcctcgacaacagcatcgacaccgcctggctagatgccttgatcgcagagcgtgtgcaatccgagaagccggatatcctgttgggcgtaatgtgcggatcgctgcacatcgcagatcgtcaaattactgagagcttttccagcttccaaacctctctggagaaaggtcagatccaagcagcgaacacgctgacgaacgtggtggatgttgagctaatcaacgatggcatccgttacaaggtgcaggccgccaagagcggagccaactcgtacttcctgctgatgaacagctcgtttaaggagatcgaggtgcaccgcctctccgacggaggcttgctcatctctttggagggcgcctcctacaccacgtacatgaaggaggaggtggatcgctaccgcattgtgattggcaaccagacatgtgtctttgaaaaggagaacgatccatcgctgttgcgcagtccgtctgcgggaaagctcatcaacatgattgtggaagatggcgctcatgtaagcaagggccaggcctatgctgagattgaggtgatgaagatggtgatgaccctgacgtcccaggaggcaggcacagtgacatttgtgcgtcgaccaggagctgttctagatgcaggatcccttttgggccacttggagctggacgatccatcgctggtgacgaaagcgcagcccttcaagggacagttcctgcagccagagaacgcaccggtacccgagaaactaaacagggtgcacaatacttacaagagtatccttgaaaacacactggctggttactgcctgccagaaccgttcaatgcacagcgactcagagacatcatcgaaaaattcatgcaaagcttgcgtgatccctcgttgccgttgttggagctgcaagaagttatcgcctccatctctggtcgcatacccatatccgtggagaagaagatccggaaactgatgacgctgtacgagcgaaacataactagtgtcctggcccaattcccctcgcagcagatcgccagtgttattgacagccatgcggccacgctgcagaagcgcgctgaccgtgatgtcttcttcctgaccacccagagcattgtgcagctggtgcagcgctataggaacggaatccgcggcagaatgaaggccgccgttcatgagctgttgcgtcagtactacgatgtagagtcgcagttccagtatggacactacgacaaatgcgtgggactggtgcgagagcacaacaaggacgacatgcagacggtggtcaacaccatcttctcgcactctcaggtggccaagaagaatctgctggtcactctgctcattgatcacctgtgggccaacgaacctggactaacggacgaattggccaacacgctaagtgaattgacctctttgaatcgagctgagcactctagggttgccctgcggtcccgccaagttctgatcgctgcccaccagccggcttatgagctgcgccacaaccaaatggagtcgatctttctctccgccgttgacatgtacggtcatgacttccaccccgagaacctgcagcgcctgattctgtcggagacctcaatctttgacatcctgcacgacttcttctaccactctaaccgggcagtgtgcaatgctgctctggaagtctatgtgaggagagcttacacatcctatgagctgacctgcttgcagcatttggaactctccggtggcctgccgctggtgcacttccagttcctcctccccacagctcacccgaacagactgttctcgcgcatgtcctcccccgatggattggatcaggcagcggcagagtctttgggaaactcattcgtgcgcaccggagcgattgcagcctttgactccttcgaacactttgagatgtactcggacgagattctggatctgctcgaagacttcgtctcgccagccatggttaatgccaaggtcctggaagccgtagaggcagcggattctatctcggacagccgacacagcacctcgatcaatgtgtcgttgtcggatcccgtaacccgggcgaatgctgccgaggaggccaagtccaccgaaccgattcacattgttagtgtggctgtgagagaaacgggggagttggatgacctgcaaatggcccaaatctttggaaattattgccaagagcataacgaggagctcttccagcgacgcattcgtaggattacatttgctgctctgaagaagcggcaattccccaagttctttacgttcagagccagagataagttcacggaggatcgtatttaccggcatctggagccagcatctgctttccatctggagctgaaccgcatgaagacgtacgatctggaggctctgcccacggctaaccaaaagatgcacctgtaccttggcaaggccaaggtttcgaaaggtcaagaggtcacggactaccgcttcttcattcgctcgatcatccgtcattcggatctgattaccaaggaagcctctttcgagtatctgcaaaacgaaggagagcgtgtgctcctggaggccatggatgagctggaggtggcattctcgcatccgcacgccaaacgcacggactgcaaccacatcttcctgaactttgtgcccaccgtcatcatggatccggctaagatcgaggaatctgtaacaaagatgattatgcgatatggtccacgtctttggaagctgcgtgtactgcaggctgagctcaagatggtcatccgccagtcaccacagtcacccactcaggcagtgcgtctgtgcattgcaaatgactccggctacttcctggatatttcgatgtataccgaacaaacagaaccagagacaggaatcattaagtttaaggcctacggtgagaagcagggatctctgcacggacatcccatttcgacgccctacatgaccaaggacttcctgcagcagaaacgtttccaggcgcagtccaatggtaccacctatgtctatgatgtgcccgacatgttccgccagatgaccgagcgtcactggagagaattctccaaggctcgtcccaccgtggacattcgcactcccgacaagattttgatcgagtgcaaggagctggtcctcgagggcgacaaccttgtagagatgcagcgtctgcccggcgaaaacaattgcggcatggtggcttggcgcattgtcttggctactccggaatatccgaatggccgcgagatcattgttatagccaacgatctcacctacttgattggttcctttggaattaaggaggacgttctctttgccaaggcttcccaattggctcgccaactcaaagtaccgaggatatacatctccgttaacagcggtgcccgcataggacttgctgaggaggttaaagctatgttcaagatcgcatgggaggatccagaggagccagataagggcttcaagtacctctacttgagcaccgaggactacgcccaggtggccaacctgaactcggtgagggctatcctgatcgaggacgagggcgagcagcgttacaagattaccgacatcatcggcaaggacgatggtctgggcgtggagaatctgcgttacgccggcttgattgccggtgaaacgtcgcaggcctacgaggagattgttactatcgctatggttacctgccgtaccattggcattggatcctatgtggtgcgcctgggtcagcgcgttatccagatcgataattcacacattatactcactggctatgctgcgcttaacaagctgcttggacgcaaggtgtatgcctctaataatcagttgggtggcacacagatcatgtttaacaacggagtcacccacaaaacagaggccatcgacttggacggtgtctacaccatcctcgactggctctcgtacatccccgcgtacatcggttgtgacctgcccattgttttgcccaacgatcgtatcgaacgccctgtcgacttcatgcccaccaagtcgccctacgatccgcgctggatgctgggtggccgtgtgaatcccgtgaacgctaatgactgggagaacggattctttgatcgcgactcgtggagcgaaatcatggcctcgtgggccaagacagtggtcactggtcgcgcacgtctaggcggtgtccccgtgggcgtaatagccgttgagacccgcaccgtagaagtggagatgcccgccgatcctgccaatctcgattcggaagccaagaccctgcagcaggcaggtcaggtgtggtaccccgactcctcgtacaaaacggcacaagcgatcaaagattttggacgagaggagttgccgctgattgttttcgcaaattggcgaggcttctccggtggcatgaaggacatgtacgagcaaatcgtcaagttcggagcatacattgtcgacggcctgcgggagtacaagaagcctgtgctcatctacctgccgcccaacgccgagctgcgaggtggagcctgggccgtgttggattccctcattaacccgcgctacatggaaacgtatgccgatccggaggccagaggaggagttctcgagccggagggcattgtggaaataaagtacaaagagaaggacctggtcaagacgattcaccgcttggatccgaccaccattgcgctgaaaaaggagctcgatgaggcaaatgcgtctggcgacaaggtcagggctgctcaggtggacgaaaagatcaaggcccgcatcgctgtgctaatgcacgtctaccacacggtagcagttcactttgccgacctgcacgacacgccggagcgaatgctagagaaggagtgtatcagtgagattgtgccttggcgcgattcccgccgctggctgtactggcgtctgcgacgtctcctgttggaggacgcatatattaagaagatcctgcgcgctcaggacaacctctccgtgggtcaggccaagcagatgctgcgtcgatggctggtagaggagaagggtgccacagaggcttatctgtgggacaaaaacgaggagatggtgtcttggtatgaggagcagatcaatgccgaatctattgtttcccgcaacgtgaactccgtgagacgggatgccattatttctaccatttcgaaaatgctcgaggactgtcccgacgtagcgctggacgctgttgtgggtctttgccaaggtctgacgccagtgaatcgaggcgtggtcgtacgcacattagcccagatgcagctgaatgaggagacctctaacagcaaccagggatgattctacgctatgttctaagttctttttaggccctctatttcatccttcccgttcccgcccttcaccacatttctcagtcccgctttgcgcttgtaagatatcgcaaggcgtgcatgatgtgcattttgtttagttaaatttgtttaaaagtaattagcgtaaatctagttatgtattggagttgtaggcatgggttaatttgttgcctaagtggcccgataaactagttgtatcgtgtacatatttgattatgtatatcccctgaatacaaatcattccattagttgtataagaactaaagtcctttgtacacagagccttttgaataatacgagttactgaaaaaataaatgtatggtacactacattaacaaaa

SEQ ID NO: 5067 - protein, 2482 aa, Drosophila melanogaster
MLITILGTLAAFLAFLLTLIFGRGQKRSKPVQSSAATSATTATTGDSDNGNTNHNSSVIAATATATTTSSKPPIAPAAPPSAVKASDKRFPKACIKKVQFSSESLRSDVDELCDQLKDSALSNLSNDNIRIACHQNNNNSSINKNQNNNSIDISISISKMSETNESNDTAAQSAEGERPSFLVGDEIDERAAEAGEACDEFPLKMQNDVRQNGDISERRKRLRPSMSRGTGLGQDRHQDRDFHIATTEEFVKRFGGTRVINKVLIANNGIAAVKCMRSIRRWAYEMFKNERAIRFVVMVTPEDLKANAEYIKMADHYVPVPGGSNNNNYANVELIVDIALRTQVQAVWAGWGHASENPKLPELLHKEGLVFLGPPERAMWALGDKVASSIVAQTAEIPTLPWSGSDLKAQYSGKKIKISSELFARGCVTNVEQGLAAVNKIGFPVMIKASEGGGGKGIRRVDTTEEFPGLFRQVQAEVPGSPIFVMKLARGARHLEVQLLADQYGNAISLFGRDCSIQRRHQKIIEEAPAIVAQPEVFEDMEKAAVRLAKMVGYVSAGTVEYLYDPEGRYFFLELNPRLQVEHPCTEMVADVNLPAAQLQIGMGIPLYRLKDIRLLYGESPWGSSVIDFENPPNKPRPSGHVIAARITSENPDEGFKPSSGTVQELNFRSSKNVWGYFSVAASGGLHEFADSQFGHCFSWGENRQQARENLVIALKELSIRGDFRTTVEYLITLLETNRFLDNSIDTAWLDALIAERVQSEKPDILLGVMCGSLHIADRQITESFSSFQTSLEKGQIQAANTLTNVVDVELINDGIRYKVQAAKSGANSYFLLMNSSFKEIEVHRLSDGGLLISLEGASYTTYMKEEVDRYRIVIGNQTCVFEKENDPSLLRSPSAGKLINMIVEDGAHVSKGQAYAEIEVMKMVMTLTSQEAGTVTFVRRPGAVLDAGSLLGHLELDDPSLVTKAQPFKGQFLQPENAPVPEKLNRVHNTYKSILENTLAGYCLPEPFNAQRLRDIIEKFMQSLRDPSLPLLELQEVIASISGRIPISVEKKIRKLMTLYERNITSVLAQFPSQQIASVIDSHAATLQKRADRDVFFLTTQSIVQLVQRYRNGIRGRMKAAVHELLRQYYDVESQFQYGHYDKCVGLVREHNKDDMQTVVNTIFSHSQVAKKNLLVTLLIDHLWANEPGLTDELANTLSELTSLNRAEHSRVALRSRQVLIAAHQPAYELRHNQMESIFLSAVDMYGHDFHPENLQRLILSETSIFDILHDFFYHSNRAVCNAALEVYVRRAYTSYELTCLQHLELSGGLPLVHFQFLLPTAHPNRLFSRMSSPDGLDQAAAESLGNSFVRTGAIAAFDSFEHFEMYSDEILDLLEDFVSPAMVNAKVLEAVEAADSISDSRHSTSINVSLSDPVTRANAAEEAKSTEPIHIVSVAVRETGELDDLQMAQIFGNYCQEHNEELFQRRIRRITFAALKKRQFPKFFTFRARDKFTEDRIYRHLEPASAFHLELNRMKTYDLEALPTANQKMHLYLGKAKVSKGQEVTDYRFFIRSIIRHSDLITKEASFEYLQNEGERVLLEAMDELEVAFSHPHAKRTDCNHIFLNFVPTVIMDPAKIEESVTKMIMRYGPRLWKLRVLQAELKMVIRQSPQSPTQAVRLCIANDSGYFLDISMYTEQTEPETGIIKFKAYGEKQGSLHGHPISTPYMTKDFLQQKRFQAQSNGTTYVYDVPDMFRQMTERHWREFSKARPTVDIRTPDKILIECKELVLEGDNLVEMQRLPGENNCGMVAWRIVLATPEYPNGREIIVIANDLTYLIGSFGIKEDVLFAKASQLARQLKVPRIYISVNSGARIGLAEEVKAMFKIAWEDPEEPDKGFKYLYLSTEDYAQVANLNSVRAILIEDEGEQRYKITDIIGKDDGLGVENLRYAGLIAGETSQAYEEIVTIAMVTCRTIGIGSYVVRLGQRVIQIDNSHIILTGYAALNKLLGRKVYASNNQLGGTQIMFNNGVTHKTEAIDLDGVYTILDWLSYIPAYIGCDLPIVLPNDRIERPVDFMPTKSPYDPRWMLGGRVNPVNANDWENGFFDRDSWSEIMASWAKTVVTGRARLGGVPVGVIAVETRTVEVEMPADPANLDSEAKTLQQAGQVWYPDSSYKTAQAIKDFGREELPLIVFANWRGFSGGMKDMYEQIVKFGAYIVDGLREYKKPVLIYLPPNAELRGGAWAVLDSLINPRYMETYADPEARGGVLEPEGIVEIKYKEKDLVKTIHRLDPTTIALKKELDEANASGDKVRAAQVDEKIKARIAVLMHVYHTVAVHFADLHDTPERMLEKECISEIVPWRDSRRWLYWRLRRLLLEDAYIKKILRAQDNLSVGQAKQMLRRWLVEEKGATEAYLWDKNEEMVSWYEEQINAESIVSRNVNSVRRDAIISTISKMLEDCPDVALDAVVGLCQGLTPVNRGVVVRTLAQMQLNEETSNSNQG

SEQ ID NO: 5068 - DNA, 2397 bp, Drosophila melanogaster
  CDS (74)..(2170)
ataagcgacgatcgcacacttgctctgaataaagtatatttgttatttattcttacaattaattctactaataatgtacgccagactgctgcgaaacttcggcgcaaacgccaggtgctttgcaacagaagccagcccaaaagttcggcctatcagcaagatccttatttcaaatcgtggtgagatcgcatgcagggtgattcgaaccgcacgcaagctgggagttcgtaccgtggccgtgttctcggatccggacgagaagagcatgcacacgcagttggcagacgagtcgtaccgcgtgggggaagctgcctcctcggcttcctatcttcgcggtgaacgcatcctggacatagccaagcgttcgggcgcccaggccatccacccaggctacggcttcctctccgagtccgtcgagtttgccgagttgtgccagcgtgagggcatcatcttcatgggtccgcccagttccgccatccgggacatggggattaagagcaccagcaaggccataatggccgctgctggggtgccgatcatcaatggataccatggcgatgatcagtcagatgagtgtttgcagcgagaagccgacaaaattggctttcccttgatgattaaagccgtccgcggcggcggaggcaaaggcatgagaatcgcagaaaaaccggacgacttcctcaccgctctgaactcagctcgcaccgagtccgagaagtcgtttggcgacagctctgtgcttctggagcggtacgtccgatctccacgccacgtagaggttcaagtatttgcggatcagtatggtgatgctgtctatctgtgggaaagagattgctccgtgcaaagacgtcatcaaaagattattgaagaggcgccagctccaggtttgtcggaagatttgcgtcgtgagctgggcgaggctgctgttcgtgcagcgaaagctgtgggctacgtaggagctggcaccgtggagttcattctagacaaagaagatctctctttccacttcatggaaatgaatacccgcctgcaggtggagcatcctataacggaaatgattacgggcaccgatttggttgaatggcagattcgcattgccgccggtgagccattacccctgaagcaatctgagattacgcggcgtggccacgcatttgaagctcgcatttatgcagaaaatcctcgcggaggctttctgcccggagccggacccctgcgatatttgtctactccccaaccatcaaacaacgttcgcgtggagacgggtgtccgagaaggagatgaggtgtctgtgcactacgaccccatgattgccaagctagtcgtttggggcgaaaaccgcacacaagcgcttaactcattggttgcccgcctgggtgaatatcatatatctggtctggacactaacattaatttcctcatcgaccttgcgtcgcatcctgagtttcagctggccaatgtgcacactggctttatcgatgagcagttcgatactctatttccgccaattatcatcagtccgcagcaagtcagccaagctgctttggcgctagtcttaaacgagttgcaggcagcctttaggaacggaaacaaagatcaggatccatttgttgccacccctaacgctcgtctgaattactctttggttcgcagatatgacttgaaagccaatgagaaggtctattctgtggctgtcaagtttgatggcgaggatatgcaaattcaggtggataatggcgactggcaggatgcaaaggtcgaaagagttcaggatggaagtcgtctaaaaattcgtgccaatatcaatagcaacgtcaccacatataatgctagtattgatggcactagtgtctctttgttttcggaaagtggcaaggtcgattttgaggtgggacagccgaaattcttaagtgcccagggcgatcaattgggtgcagttgggtctcgcatagtggctcccatgcccgggattttagagaaggtgctggtaaagcccggtgacaaggtcaagaagggcgaaaacttggcagtgcttattgccatgaaaatggaacacattctaaaagctccaaaggacgccaccattaagtctattggaggagccgcgggcgataacgttgctaagggagcggccgtgattacattcgtcgacgaggaagtagaaaagtaacggaatatgtttcgaaacgtaccagagagttgttgcatttacaaacaaaattatattttaaatattaactagcctgcttttggttcagggatcacgaagtgcatttattatcgttaagtaaaaaagtgtccatctaatggaattttcttatctttaacccattaaacgtctaaaactgttaaaaaaaaaaaaaaaaaaaaaaaaaaaaaaaaaaaaaaaaaaaaaaa

SEQ ID NO: 5069 - protein, 698 aa, Drosophila melanogaster
MYARLLRNFGANARCFATEASPKVRPISKILISNRGEIACRVIRTARKLGVRTVAVFSDPDEKSMHTQLADESYRVGEAASSASYLRGERILDIAKRSGAQAIHPGYGFLSESVEFAELCQREGIIFMGPPSSAIRDMGIKSTSKAIMAAAGVPIINGYHGDDQSDECLQREADKIGFPLMIKAVRGGGGKGMRIAEKPDDFLTALNSARTESEKSFGDSSVLLERYVRSPRHVEVQVFADQYGDAVYLWERDCSVQRRHQKIIEEAPAPGLSEDLRRELGEAAVRAAKAVGYVGAGTVEFILDKEDLSFHFMEMNTRLQVEHPITEMITGTDLVEWQIRIAAGEPLPLKQSEITRRGHAFEARIYAENPRGGFLPGAGPLRYLSTPQPSNNVRVETGVREGDEVSVHYDPMIAKLVVWGENRTQALNSLVARLGEYHISGLDTNINFLIDLASHPEFQLANVHTGFIDEQFDTLFPPIIISPQQVSQAALALVLNELQAAFRNGNKDQDPFVATPNARLNYSLVRRYDLKANEKVYSVAVKFDGEDMQIQVDNGDWQDAKVERVQDGSRLKIRANINSNVTTYNASIDGTSVSLFSESGKVDFEVGQPKFLSAQGDQLGAVGSRIVAPMPGILEKVLVKPGDKVKKGENLAVLIAMKMEHILKAPKDATIKSIGGAAGDNVAKGAAVITFVDEEVEK

SEQ ID NO: 5070 - DNA, 4311 bp, Pseudomonas fluorescens
  CDS (125)..(3766)
gctcccacaggggacataaggtgtttggaagtttgctgtcggggacgaccccgctggccatcgaaaactgcgggacggcccgcatcccagttcaggcagcacgcatgcctgagggggcaatgccatgttcgaaaaaatcctcatcgccaaccgtggcgccatcgcttgccgcatcctgcggaccttgcgcgagctggaggtcaaaggcgtcgcggtgtactcccaggccgacgccgccagcttgcatatccagcaggccgatgaagcttattgcctgggcgatggtgcggcggccggtacttacctggcggtggataaactcctggcaatcgccaaaagcagcggcgcgaccgcgatccatcccggctacggtttcctctcggaaaacgcagccttcgccgaagcctgcgaggccgctgatattgctttcatcggcccaacgccggagcaactgcgtgtgttcggcctcaagcacaccgcccgcgacttggctcgtcgacacggcgtgccgctgctcgaaggcaccgaactgctcgacagcctcgacgccgcgctattggcgggcacccagctcggctatccggtgatgctcaaaagtaccgcgggcggcggcggcatcggcatgcgcgtgtgtcgcagcgccaccgacctgagcgaatccttcgaagcggtcaagcgcctgggccagaacaacttcagcgacgccggggtattcatcgagaagtacatcgaacgcgcgcggcatctggaggtgcaggtattcggcgacggccagggccaagtgatcgccttgggcgtacgcgactgctcggtgcaacggcgcaaccagaaagtcctcgaggaaaccccggcgccgaacctgcccgaaggcatggctgacgaactctgcgcagcggcgatccaactggcccaggcggtgaactaccgcagcgccggcaccgtggagtttgtgttcgacagcgacgcggggcgcttctacttcctggaagtgaacacccgcctgcaagtggagcacggtgtcaccgagcaggtgtggggcgtggacctggtgcgctggatggtgcaactggcggccggtgatctgccgccactgagcgagctgggccagggattgaaagccgaaggccacgcgatccaggcacgcctgtatgccgaggatccaggccgggatttccagccaagcccggggctgctgaccgcggtgaaatttccgcaggccgacggcaaagcactgcgcatcgacacctgggtcgaggccggttgccagatcccgccctacttcgacccgatgatcgccaaggtcattcgctgggcgccgacccgtgagcaagcgcggctgggcttgcatcaagcgctggacgaaagcttgttgtacggcgtcgaaaccaaccgccactacctgcaacagattctcctcgacgcgccgtttgccagcggtcaaccctggacccgctgcctggaggccttggtctaccgcgccaacaccgtggaagtgctcagccccggcacacagaccagcgtccaggactatcccggccgcctcggttattgggccgtgggggtgccgccgtcgggaccgatggacagccattcgttgcgcctgggcaatcgcctgctgggcaatgaagaaggtgccgcggcgttggaaatcaccatgaacggggccgcggtgcgcttcaactgcgatgcgcgggtggcggtgaccggcgcggtgattgccctcacgctcgacggtgaagccgtaccgatgaacaccccgttgtcgattgctgccggctccaccctgacgatcggcaccatcgctggggccggggcgcgcagttacctgtgcctgcaaggcggcgtgcaagtgccggattacctgggcagtaaaagcacgttcaccctcggtcagttcggcggccatggcggacgggcgttgtgtaccggcgatgtactgcacctgactgaactggatgagcacgccgcgctgccacaacagaacgcgccgatcctggagttgccgtcggaacggcagatccgcgtaatctacggcccgcacggcgcgccggaatatttcaccgagcgctacatccagaccttcttcgacactgcatgggaagtgcatttcaactccagccgcacgggcgtgcgcctgatcgggccgaaacctgaatgggttcgcgccgacggtggcgaggctgggctgcacccctccaacatccatgacaatccctacgccatcggcgccgtggacttcaccggcgacatgcccgtcatcctcggccccgacggcccgagcctgggggggttcgtctgcccggtgacggtgatcgaggcggacctctggcagttagggcagctcaaggccggggacaaggtgcgattcgtgccggtggatatatcgaccgcccgctcactggccttgaattgggccccttgtgggagcgagcttgctcgcgatagcggtctgtcagtttcatcaaggttggatgtgccgccgctatcgcgagcaagctcgctcccacagggtatggggtcgcctgtggtgttggatattgggcaggacgacacccgcctggtggcgagattagccggcgacacccacctgttgctggaaatcggcgccgccgaactggacctggtgctgcgctttcgcgcccacgcgttgatgcaggctttggaacacaaacaactgcccggcgtgatcgacctgacgccgggcattcgctcgctgcaagtgcactatcaacccgaacaaatgcccctggccgatctactgagcatcgtcgtcggtgagtgggacgccgtatgcgccgcgcaggacctgcaagtgccgtcgcgcatcgtccacctgccgctgtcctgggatgatccggcctgccagctggccatcgagaaatacatgaccaccgtgcgcaaggacgcaccctggtgcccgagcaacctggagttcattcgacgcatcaacgacctgcccaacctcgacgaggtgcaacgcacggtgtttgacgccagctatctggtgatgggcttgggggacgtctacctcggcgcgccggtcgccacgccgctcgacccacggcatagactggtgaccaccaaatacaacccggcccggacctggaccgcggaaaactcggtgggcatcggcggcgcctacatgtgcgtgtacggcatggaagggcctggcggctatcagttcgtcgggcgtacgttgcagatgtggaatcgttatcgggaggtcgcggcattcaacggcaagccctggttgctgcggttcttcgaccagatccgcttctacccggtcagtgccgatgaactgctgcacatccgccgtgagttcccgctgggccgcttcgacctgaagattgagcacagccagctcaacctcgccgactaccagcgttttttggtgcaggaagccgacagcatcgccgcgttccgacaacagcaacaaggcgccttcaacgccgagcgcgagcgctggatcgccagtggccaagcgcacttcgacagtgaagaaccggccgtcgcaccaagcgaagattcgctgctgaccgagggtcaactgagcgtcgacagccacatcgccggcaacctctggcaagtgcaggtagacgttggtgcgcgggtggccgccggtgatgtgctggtcatcctggagtcgatgaaaatggaaatccctctgcttgcgccctcggccggcgtagtgcgcgaggtgcgcgtccagcccggttcggcggtgcgtgccggacaacgcgtcgtggtgctggaccgtgcctgaactcaatcaaaggattaacaccatgaacctctctcttcgcttggacgacctgcgcacaacctaccgcagcggcgaactgacgccacgccaattactgttgggcctgcgggaaaaggccgcggcgctgaacacggactatcacctgttcatccacctgctgacggccgaggaactggagccctacctggccgcgttggaaggccgcgacctggagagcttgcccctgtacggcgtaccttttgccatcaaggacaacatcgacctggccggcattccgaccacggccgcctgcccggcgtttgcctatgtgccaccctgctcggcgaccattgtcgagcagttgctggcactgggcgcgatccccctgggcaagaccaacctcgaccaattcgccaccgggctcaatggcactcgctcgccctacggcgcctgccgcaacagcgtgttgcccgactatccggcaggcggttcgagcgccggttcgtcgctggccgtggccttgggcgtagcgagttttgccttgggcaccgataccgccggctccg

SEQ ID NO: 5071 - protein, 1213 aa, Pseudomonas fluorescens
MFEKILIANRGAIACRILRTLRELEVKGVAVYSQADAASLHIQQADEAYCLGDGAAAGTYLAVDKLLAIAKSSGATAIHPGYGFLSENAAFAEACEAADIAFIGPTPEQLRVFGLKHTARDLARRHGVPLLEGTELLDSLDAALLAGTQLGYPVMLKSTAGGGGIGMRVCRSATDLSESFEAVKRLGQNNFSDAGVFIEKYIERARHLEVQVFGDGQGQVIALGVRDCSVQRRNQKVLEETPAPNLPEGMADELCAAAIQLAQAVNYRSAGTVEFVFDSDAGRFYFLEVNTRLQVEHGVTEQVWGVDLVRWMVQLAAGDLPPLSELGQGLKAEGHAIQARLYAEDPGRDFQPSPGLLTAVKFPQADGKALRIDTWVEAGCQIPPYFDPMIAKVIRWAPTREQARLGLHQALDESLLYGVETNRHYLQQILLDAPFASGQPWTRCLEALVYRANTVEVLSPGTQTSVQDYPGRLGYWAVGVPPSGPMDSHSLRLGNRLLGNEEGAAALEITMNGAAVRFNCDARVAVTGAVIALTLDGEAVPMNTPLSIAAGSTLTIGTIAGAGARSYLCLQGGVQVPDYLGSKSTFTLGQFGGHGGRALCTGDVLHLTELDEHAALPQQNAPILELPSERQIRVIYGPHGAPEYFTERYIQTFFDTAWEVHFNSSRTGVRLIGPKPEWVRADGGEAGLHPSNIHDNPYAIGAVDFTGDMPVILGPDGPSLGGFVCPVTVIEADLWQLGQLKAGDKVRFVPVDISTARSLALNWAPCGSELARDSGLSVSSRLDVPPLSRASSLPQGMGSPVVLDIGQDDTRLVARLAGDTHLLLEIGAAELDLVLRFRAHALMQALEHKQLPGVIDLTPGIRSLQVHYQPEQMPLADLLSIVVGEWDAVCAAQDLQVPSRIVHLPLSWDDPACQLAIEKYMTTVRKDAPWCPSNLEFIRRINDLPNLDEVQRTVFDASYLVMGLGDVYLGAPVATPLDPRHRLVTTKYNPARTWTAENSVGIGGAYMCVYGMEGPGGYQFVGRTLQMWNRYREVAAFNGKPWLLRFFDQIRFYPVSADELLHIRREFPLGRFDLKIEHSQLNLADYQRFLVQEADSIAAFRQQQQGAFNAERERWIASGQAHFDSEEPAVAPSEDSLLTEGQLSVDSHIAGNLWQVQVDVGARVAAGDVLVILESMKMEIPLLAPSAGVVREVRVQPGSAVRAGQRVVVLDRA

SEQ ID NO: 5072 - DNA, 1755 bp, Streptomyces venezuelae
  CDS (1)..(1755)
atgcgcaaggtgctcatcgccaaccgtggcgaaatcgctgtccgtgtggcccgggcgtgccgggacgcgggtatcggcagcgtggccgtgtacgccgagccggaccgggatgctctgcatgtccgggcggctgacgaggcgttcgctctgggcggtgacactccggcgaccagttatctggacatggcgaaggtgttgcaggccgccgcggactcgggtgcggacgcggtccaccccggttacgggttcctttcggagaacgcggagttcgcgcaggcggtcctcgacgcgggtctgacgtggatcggtccgccgccgcaggcgatccgggatctgggtgacaaggtggcggcccgtcacatcgcccagcgtgccggggccccgctggtggccggcacgcccgacccggtctcgggtgcggacgaggtcgtggcgttcgccgaggagcacggtctgccgatcgcgatcaaggcggcgttcggtggcggtggccgtggtctgaaggtggcgcggacgctggaggaggtcccggagctgtacgactccgcggtccgtgaggcggtggcggcgttcgggcggggcgagtgcttcgtggagcggtacctggacaagccgcggcacgtggagacgcagtgcctggccgaccagcacggcaacgtggtcgtcgtctcgacgcgtgactgctcgctgcagcgccgtcaccagaagctggtggaggaggctccggcgccgttcctgtcggaggctcagaacgcggagctgtacgcggcgtcgaaggcgatcctgaaggaggccggttacgtcggtgccggcacggtggagttcctcgtcggcacggacggcacgatctcgttcctcgaggtcaacacccgtctgcaggtggagcacccggtgacggaggaggtcacggggatcgacctggtgcgggagatgttccggatcgcggacggtgaggagctcggctacggcgacccggagatccggggtcactccttcgagttccggatcaacggtgaggacccgggccgtggtttcctcccggcgcccggcaccgtcaccgagttcacgccgccgaccggtccgggtgtccgcctcgacgcgggtgtggagtcgggttccgtgatcggccccgcgtgggactcgctgcttgcgaacgtgatcgtgaccggtgcgagccgtgagcaggcgctgcagcgtgcggcgcgtgccgtggcggagttccgcgtcgagggcatggcgaccgcgatccccttccaccaggcggtggtgaccgacccggacttcaccgcggacccgttccgggtgcacacgcggtggatcgagacggagttcgtcaacgagatcaagccgttcgcgccggcgggggaggcggacgaggacgaggccggccgcgagacgatcgtggtcgaggtcggcggcaagcgtcttgaggtctccctgccgtcctcgctcgggatgacgctggcccggacggtcttgcggcgggtgccgaagccgaagcggcgggcgtcgaagaaggtccgggcttcggccgcctcgggtgacaccctcgcctccccgatgcagggcacgatcgtgaaggtcgcggtcgaggagggccaggaggtcaaggaaggcgatctgatcgtcgtcctggaggccatgaagatggaacagcccctcaacgcccaccgctccggcaccgtgaagggcctgaccgccgaagtcggcgcgtccgtcacctccggcgccaccatctgcgacatcaaggactga

SEQ ID NO: 5073 - protein, 584 aa, Streptomyces venezuelae
MRKVLIANRGEIAVRVARACRDAGIGSVAVYAEPDRDALHVRAADEAFALGGDTPATSYLDMAKVLQAAADSGADAVHPGYGFLSENAEFAQAVLDAGLTWIGPPPQAIRDLGDKVAARHIAQRAGAPLVAGTPDPVSGADEVVAFAEEHGLPIAIKAAFGGGGRGLKVARTLEEVPELYDSAVREAVAAFGRGECFVERYLDKPRHVETQCLADQHGNVVVVSTRDCSLQRRHQKLVEEAPAPFLSEAQNAELYAASKAILKEAGYVGAGTVEFLVGTDGTISFLEVNTRLQVEHPVTEEVTGIDLVREMFRIADGEELGYGDPEIRGHSFEFRINGEDPGRGFLPAPGTVTEFTPPTGPGVRLDAGVESGSVIGPAWDSLLANVIVTGASREQALQRAARAVAEFRVEGMATAIPFHQAVVTDPDFTADPFRVHTRWIETEFVNEIKPFAPAGEADEDEAGRETIVVEVGGKRLEVSLPSSLGMTLARTVLRRVPKPKRRASKKVRASAASGDTLASPMQGTIVKVAVEEGQEVKEGDLIVVLEAMKMEQPLNAHRSGTVKGLTAEVGASVTSGATICDIKD

SEQ ID NO: 5074 - DNA, 4391 bp, Drosophila melanogaster
  CDS (417)..(3962)
agtccgacggacagctttgaagtgaacggttcgcgagttcctgggcagaagagagaatcagagtgcagcagagcaaccgtttgcgaattcgcgctgttctacctacatagaccaaaaccaaaccaattccaagcaaaccaaaccaaacgcaaccccgagaccaaacgcaaaaaaaagaggccggcaagttgacaaaacctcgcgcacataggatacataggaaccgtgaatttgtatgtgctgagcgcggtacataagctaaagaaaccacgttgactcacgacccgtttgaaattgttttgtagtgctggagcagcgattacccactttgcgccaggacaacgacaataggcgcagagcgctccttcggaactttcgccatcaataaatacatttaagtcctaggcgggatcagcatgttcattccggccgcccagtccgcgtacaggacgctgcgcaagacccagccacgcgtccggctcaacgccatcttcaaaaatggctactccagcaaggtggagtacaagcccatccggtcagtgctggtggctaaccgcggtgagatcgccatccgagtgttccgtgcctgcacagagttgggcatcaaatcggtggcggtctactcggagcaggataagatgcacatgcaccgacaaaaggccgacgagtcgtacatagtgggcaagggtctgcccccggtggaggcctacctcaacattccagagctaattagggtgtgcaaggagaacgatgtggatgccgtgcatcccggctacgggttcctttcagagcgcagtgacttcgcccaagcggtgattgatgctggactgcgcttcattggcccctcacccgaagtcgtccagaagatgggtgataaggtggcggctcgtgtggcggccattgaagcgggtgtgcccattgtgcccggcaccgacggtccagtgaccaccaaggaggaggcactggagttctgcaagaagcacggactgcccgttatcttcaaggccgcttacggaggcggaggtcgcggcatgcgcgtcgtccgcaaaatggaggatgtggaggagagcttccagcgagccagttccgaggccaaggccgcctttggcaatggtgcgatgttcattgagaagttcatcgagcgaccgcgtcacattgaggttcaactgctgggagacaaggccgggaatgtagtgcatctgtacgaacgtgactgctccgtgcagcgtcgccaccagaaggtggtggagatcgccccagcgccacgcctgcccatcgaaatccgggacaagatgacggaggcagcagtgcgcttggcccgccatgtgggctatgaaaacgccggaaccgtggagttcctttgcgacgagtccggcaacttctacttcatcgaagtgaacgcccgtctacaagtggagcacacggtcaccgaggagataacaggcatcgatttggtgcagtcgcaaatccgcgtggccgagggcatgaccctacccgaattgggctacacgcaggacaagatcgtgccgcgtggctatgccattcagtgccgtgtgaccaccgaagatccggccaacgattttcagcccaacaccggtcgcttggaggtcttccgatctggcgagggtatgggcattaggttggacagtgcgtccgcctacgccggagccatcatttcgccatactacgactccctgctggtcaaggtgatctcgcacgccagcgatctgcagagctccgcctccaagatgaaccgtgccctaagggaattccgcattcgcggcgtcaagaccaatatccccttcctcctaaacgtgctggagaaccagaagttcctccacggcgttctcgacacctacttcatcgacgagcacccgcaactgttcaagttcaagccctcgctcaatcgcgcccagaagctgctcaactatatgggtgaggtgctggtcaacggaccccagactcctctcgccaccactctgaagcctgccctcgtctcgccccacgttcccgaggttccgctggttacggaaccaccgaagggactccgcgaggtcctggtgtgcgaaggtccggaggccttcgccaaggaggtgcgcaaccgtaaggaactgctactcatggacaccaccttccgcgatgcccaccagtcgctgctggccacccgcgtgcgttcccacgatctgctgaagatctccccctacgtgacgcacaagttcaacaacctgtattcgctggagaactggggcggagccaccttcgacgtggcgctgcgcttcctgcacgagtgcccgtgggagcgcctggaggagatgcgcaagcgcatcccgaacattcccttccagatgctgttgcgcggagccaacgccgtcggctacaccagctatccggacaacgtggtctacaagttctgtgagctggctgtgcagaccggcatggacatcttcagggtgttcgactcgctcaactacctgcccaacctgatcctcggcatggaagccgctggaaaggcgggcggcgtggtggaggctgccatctcctataccggagacgtcagcgatcccaagcgcaccaagtatgatctgaaatactacactaaccttgccgatgagctggtcaaggcgggcacccacgtgctctgcataaaggatatggctggtctgctcaagcccgaatccgccaggcttctgatcacagccattcgtgacaagcaccccgacatcccaatccatatccacacccacgacacctctggagcgggagtggcctccatgctggcatgcgccaatgccggagccgatgtggtggacgtggccgtcgactccatgagcggcatgacttcccagccgagcatgggtgccgtagtggcctccctgcaaggcactccgctggacacgaacttggatctgcgcacggtgtcggagtactccgcctactgggagcagacccgcaccctgtacgctcccttcgagtgcaccacaacaatgcggtcgggcaacgccgatgtctacctcaacgagattcccggcggccagtacaccaacctgcagttccaggccttctcgctgggtctgggcgacttcttcgaggacgttaagaaggcctaccgtgaggccaacctgttgttgggtgacattatcaaggtgacgccctcgtcgaaggtggtaggtgatcttgcccagttcatggtgcagaatgacctgaccgccgatcaagtgctggagcgggccgaggagctgtcgttccccaagtcggtggtggagtacttgcagggctctattggcattccgcacggcggattccccgagccgctgcgttcgcgagtgctcaaggacatgccccgcatcgagggacgtccgggagccgaactgaaggacttggactttgacaagctgaagaaggaactgcaggagtctcacacctgcgtcaccaaccgtgatgtcatgtcagctgccctctacccgcaggtgacgaatgatttcctaaacttccgcgaaaagtacggacccgtcgacaagctggacactcgcatcttcctcacgggtcccaaggtgggcgaggagttcgacgtacctctggagcgcggtaagacgctgagcgtgaaagctctggctgtgtccgccgatctcaagcccaacggtatccgcgaggtattctttgagttgaatggccagctgcgcgcggtccacatcctggacaaggaagccgttaaggagatccatgtccatcccaaagcgaacaagtcgaacaagagcgaggtgggcgcccccatgcccggaactgtcatcgatatccgcgtgaaggttggcgacaaagtggagaagggtcagcctctggtcgtgctctcggccatgaagatggagatggtggtgcagtcgccattggcgggcgttgtcaagaagctggaaattgccaacggaacgaagctggagggcgaggacctcattatgattatcgaatagacagtgccaccggatcaaaatgtccattgtctaagctgccaccgcacacacccaatgtaaaattaagtgaaaacagtgataatcttagggactctgtcagttcgattgatcataaaactgtccaaagtcgcctgtgtctatttttatatgaatcaaaatcattcatgtttccgtgtttccaggatcaatcgaccatgagtaactggtcaaattttttagctgtccctgccaaaatatatcggattgcataagttcgtgcccaagtatatttgtaaatttgtcgtagggcttttcccgcaagtcatttgaatcaaatttgtacgattatggaatttttaattcgcaaacacctgtgtcgagattccccctctagtaaatacgtaagtggttattaatgttatattaactattgtgtaataaacgttatac

SEQ ID NO: 5075 - protein, 1181 aa, Drosophila melanogaster
MFIPAAQSAYRTLRKTQPRVRLNAIFKNGYSSKVEYKPIRSVLVANRGEIAIRVFRACTELGIKSVAVYSEQDKMHMHRQKADESYIVGKGLPPVEAYLNIPELIRVCKENDVDAVHPGYGFLSERSDFAQAVIDAGLRFIGPSPEVVQKMGDKVAARVAAIEAGVPIVPGTDGPVTTKEEALEFCKKHGLPVIFKAAYGGGGRGMRVVRKMEDVEESFQRASSEAKAAFGNGAMFIEKFIERPRHIEVQLLGDKAGNVVHLYERDCSVQRRHQKVVEIAPAPRLPIEIRDKMTEAAVRLARHVGYENAGTVEFLCDESGNFYFIEVNARLQVEHTVTEEITGIDLVQSQIRVAEGMTLPELGYTQDKIVPRGYAIQCRVTTEDPANDFQPNTGRLEVFRSGEGMGIRLDSASAYAGAIISPYYDSLLVKVISHASDLQSSASKMNRALREFRIRGVKTNIPFLLNVLENQKFLHGVLDTYFIDEHPQLFKFKPSLNRAQKLLNYMGEVLVNGPQTPLATTLKPALVSPHVPEVPLVTEPPKGLREVLVCEGPEAFAKEVRNRKELLLMDTTFRDAHQSLLATRVRSHDLLKISPYVTHKFNNLYSLENWGGATFDVALRFLHECPWERLEEMRKRIPNIPFQMLLRGANAVGYTSYPDNVVYKFCELAVQTGMDIFRVFDSLNYLPNLILGMEAAGKAGGVVEAAISYTGDVSDPKRTKYDLKYYTNLADELVKAGTHVLCIKDMAGLLKPESARLLITAIRDKHPDIPIHIHTHDTSGAGVASMLACANAGADVVDVAVDSMSGMTSQPSMGAVVASLQGTPLDTNLDLRTVSEYSAYWEQTRTLYAPFECTTTMRSGNADVYLNEIPGGQYTNLQFQAFSLGLGDFFEDVKKAYREANLLLGDIIKVTPSSKVVGDLAQFMVQNDLTADQVLERAEELSFPKSVVEYLQGSIGIPHGGFPEPLRSRVLKDMPRIEGRPGAELKDLDFDKLKKELQESHTCVTNRDVMSAALYPQVTNDFLNFREKYGPVDKLDTRIFLTGPKVGEEFDVPLERGKTLSVKALAVSADLKPNGIREVFFELNGQLRAVHILDKEAVKEIHVHPKANKSNKSEVGAPMPGTVIDIRVKVGDKVEKGQPLVVLSAMKMEMVVQSPLAGVVKKLEIANGTKLEGEDLIMIIE

SEQ ID NO: 5076 - DNA, 9422 bp, Ovis aries
  CDS (320)..(7360)
gaagtccctcagactcttaaccctggacaaacctgcacggctgagcaaagtcgaagaacacagtgttctgatcaagtcttcttgtcttcttttttctcttatcttatgactagagcctccgttctggtcgaggcagtgacttccttgaagtctgtccatctgtgaagtatccttctggaggtttttgcctcccagacgcgacctgaagacggacaagcagacattggaagcagagaggtctctgagttctttttggaagtggatatctgctcagacaataagaattataagagctctgagggctcgttttgaaggaacaatgggtgaaccttcttccttggccaaacctctggagctgaaccagcactcccgattcataattggctccgtgtctgaagataactcggaggatgagattagcaacctggtgaagctcgacctactggaggagaaggagggctctctgtcaccagcctctgtcagctcagacacgctctctgacttggggatctcgagcctccaggatggtttggccttacacatgagatccagcatgtctggtttgcacctagtcaagcaaggtcgagaccgaaagaaaatagactcacagcgagatttcactgtagcctcgccagcagaatttgttactcgttttggtgggaataaagtgattgagaaggttctcatcgccaacaatggcattgcagctgtgaaatgcatgagatccatccgccggtggtcttatgagatgtttcgaaatgagcgtgcgatccggtttgttgtcatggtcacacctgaagacctgaaagccaacgcagaatacattaagatggcagatcactacgtgccagtgccaggaggccccaacaacaacaactatgcaaatgtggagttaattcttgacattgctagaaggatcccagtgcaagcagtttgggctggctggggtcatgcttctgagaatcccaagctcccagaacttcttttgaaaaatggcatcgccttcatgggtcctccaagccaagccatgtgggctttgggggataagattgcatcttccatagtggctcaaactgctggtatcccaactcttccatggagtggcagtggtctttgtgtggactggcacgaaaatgatttttcaaaacgaattttaaatgttcctcaggaactatatgaaaaaggttatgtgaaggatgtggatgatgggctgaaggcagcggaggaagttggatatccagtaatgatcaaggcctcagaaggaggaggagggaaggggatcagaaaagtcaacaacgcggatgacttccctaacctcttccgacaggttcaagctgaagttcctggatctcctatctttgtcatgagactagctaaacagtctcgtcatctggaggtgcagatcttagcagatcagtatggcaatgctatctctctgttcggtcgtgattgctctgtgcaacgcaggcatcagaagattattgaagaagctcctgccgctattgctactccagcagtatttgaacatatggaacagtgtgcggtgaagcttgccaggatggttggttacgtgagtgcggggactgtggaatacctctacagccaggatggcagcttctactttctggaactgaaccctcggctacaggtggagcacccctgtacagagatggtggccgatgtcaacctccctgccgcgcagctccagattgccatggggatccctctgtacagaatcaaggatatccgtatgatgtacggggtctctccctggggcgatgctcccattgattttgaaaattcggctcacgttccttgcccaaggggccatgttattgctgctcgtatcactagtgaaaatccagatgaggggtttaagcccagctcaggaacagttcaagagctgaattttcgcagcaataagaacgtttggggttatttcagtgttgctgctgcaggagggcttcatgaatttgctgattctcagtttggtcactgcttttcctggggagaaaaccgagaggaagcaatttcaaacatggtggtggctttgaaggagctgtccatccggggcgacttccggaccacagtcgagtacctgatcaaactgctggagacggaaagcttccagttgaataggattgacacgggctggctggacagactgatagcagaaaaagtacaggcggagcgacctgacaccatgctgggagttgtctgtggggctctccacgtggcagacgtgagcctgcggaatagcatctccaacttccttcactccttagagaggggtcaagtcctctctgctcatacacttctgaacacagtagatgttgaacttatctatgagggagagaagatagtactgaaggtgactcgacagtccccaaactcctacgtggtgatcatgaacggctcgtgcgtggaagttgacgtgcatcgactgagcgacggtggactgctcttgtcctatgacggcagcagttacaccacatacatgaaggaggaggtggatagatatcgcatcacaattggcaataaaacttgcgtgtttgagaaggaaaatgacccttcagtgctgcgctcaccctctgctgggaagttaatccagtacattgtggaggatggaggccatgtgtttgctggccagtgctatgctgagatcgaggtgatgaagatggtaatgaccttaacagccgcagagtctggctgtatccattacgtcaagcggcctggagcagctcttgacccgggctgtgtaatagccaaaatgcaactggacaaccccagcaaggtccagcaggctgagcttcacacaggcagtctgccacggatccagagcacagcactcagaggcgagaagctccatcgagtgttccactatgtcctggataatctggtcaacgtgatgaatggatactgccttccagatcctttctttagcagcagggtgaaagactgggttgaaggcttgatgaagaccctcagggacccctccttgcctctcctagaattgcaggatatcatgaccagcgtctctggtcgtatcccacccaacgtggaaaagtctatcaagaaggaaatggctcagtatgccagcaacatcacatccgtcctctgccagtttcccagccagcagattgccaacatcctagatagccatgcagccacactgaaccggaaatctgaacgggaagtcttcttcatgaacactcagagcatcgtccagctggtgcagaggtaccgcagtggcatccgaggacacatgaaggctgtggtgatggacctgctgcggcagtacctgcgagtagagactcagttccagaacggtcactatgacaaatgcgtgttcgccctccgggaggagaacaagagtgatatgaacactgtactgaactacatcttctctcacgctcaagtcaccaagaagaatcttctggtcaccatgcttatcgatcagctgtgtggccgggaccccaccctcactgatgagctgctgaatatcctcacggagctaactcaactcagcaagaccaccaacgcgaaggtggcactccgagcacgccaggttcttattgcttcccatttgccatcatatgagcttcgccacaaccaagtcgagtctatcttcctgtccgccattgacatgtacggacatcagttctgcatcgagaacctgcagaaactcatcttgtccgaaacgtcgatttttgatgtcctgccaaacttcttctatcacagcaaccaggtcgtgaggatggcagctctggaggtgtatgttcgaagggcttatatcgcctatgaacttaatagcgtacaacaccggcagctgaaggacaacacctgcgtggtggaattccagttcatgctgcccacatcacatccaaacagagggaacatccccacgctaaacagaatgtccttctcctccaacctcaaccactacggcatgactcacgtagccagtgtcagcgacgtgctgctggacaacgcgttcactccgccgtgtcagcggatgggcgggatggtctcttttcggacctttgaagattttgtcaggatctttgatgaagtgatgggctgcttctgtgattccccaccccaaagcccgacattccctgaggcaggtcacacgtctctgtatgatgaagacaaggtccccagggatgaaccaattcacattttgaatgtggctatcaaaacagactgtgacatcgaggatgacagtctagcagctatgttccgagagtttacccagcaaaacaaagctaccctggttgaacatgggatccgacgccttactttcctggttgcacaaaaggatttcaggaaacaggtcaactatgaagtggatcagagatttcatagagaatttcctaaatttttcacgttccgagcaagggataagtttgaggaagatcgtatctatcgtcacctggagcctgccctagctttccagttggagctgaaccggatgagaaattttgaccttactgccatcccatgtgccaatcacaagatgcacttgtatctcggggcagccaaggtggaagtgggcacagaagtgacagactacaggttctttgtccgtgcaatcatcaggcattcggatctggtcaccaaggaagcttcctttgagtatctacaaaatgaaggggagcggctcctcctggaagccatggatgagctggaagtcgcctttaacaatacaaatgtccggaccgactgcaaccacatcttcctcaactttgttcctacagtcatcatggacccatcgaagattgaggaatccgtgcggagcatggtgatgcgctatggaagtcggctgtggaagctgcgtgtcctccaggcagaactgaaaatcaacattcgcctgaccccaactggaaaagcaattcccatccgcctcttcctgacgaatgagtctggctattacttggacatcagcctgtacaaggaagtgactgattccaggacagcacagatcatgtttcaggcatatggagacaaacagggaccattacatggaatgttaatcaacactccgtatgtgaccaaagacctgcttcagtccaagaggttccaggcacagtccttagggacaacatacatatatgacatcccagaaatgtttcggcagtccctgatcaaactctgggaatctatgtcctctcaagcattccttccaccgccccctctgccttcagacatactgacgtacactgagctcgtgttggatgatcaaggtcaactggttcacatgaacaggcttccaggaggaaatgagattggcatggtagcttggaaaatgacccttaaaagtccagaatatccagatggccgagatatcattgttattggcaatgacatcacttaccgaatcgggtcctttggaccccaggaggatttgctgtttctcagagcttctgagcttgccagggcagagggcatcccacgcatctatgtagcagccaatagtggagcaagaattggactggcagaggaaattcgtcatatgttccatgtggcctgggtagatcctgaggatccttacaagggatacaaatatttatatctgacccctcaagattacaagagagtcagtgctctcaactctgtccattgtgaacatgtggaagatgaaggagaatccaggtacaagataactgacattattgggaaggaagaaggacttggagcagagaaccttcgagggtctggaatgattgctggggaatcctctttggcctacgacgagatcatcaccatcagcctggttacgtgcagggccattgggattggggcttacctcgtccgactgggacagagaaccatccaggtcgaaaattctcacttaatcctgacaggagctggggccctcaacaaagtcctcgggagggaagtatacacctcgaacaaccagctggggggcattcagatcatgcacaacaacggggtgacgcacagcaccgtctgtgatgactttgagggggtgttcaccgtcctgcactggctgtcttacatgccgaagagtgtatacagttcagttcctctcctgaattccaaggatccaatagacagagtcatcgagtttgtgcccacgaaggcgccgtatgaccctcggtggatgctggcaggccggcctcacccaacccagaaaggtcagtggttgagtggattttttgactacggctctttctcagagatcatgcaaccgtgggcacagactgtggtggttggcagagccaggctaggaggaatacccgtgggagtagttgccgtagaaacccgaacagtggagctgagtatcccggctgatcctgcaaacctggattctgaagccaagattatccagcaggctggccaggtttggttcccagactctgcgtttaagacatatcaggccatcaaggacttcaaccgtgaagggctgcctctgatggtctttgccaactggagaggcttctccggtgggatgaaagatatgtacgaccaagtgctgaagttcggcgcttacatcgtggatggcttacgggagtgctcgcagcccgtgatggtctacatccctcctcaggccgagctccgaggtggctcctgggtggtgattgaccccaccatcaacccgcggcacatggaaatgtacgcggaccgggagagcaggggatccgttctggagccggaagggacagtagaaatcaaattccgcagaaaggatctggtgaaaaccatgcgtcgggtggacccagtctacatccacttggctgagcgactgggcacccccgagctcagcgcacgcgagcggaaggagctggagagcaagctgaaggagcgggaggagttcctccttcccatctaccaccaggtggccgtgcagtttgcggacttgcacgacacccccggccgcatgcaggagaagggggtcattaatgacatcctggattggaagacttcacgcaccttcttctactggcggctgaggcggctgttgctggaggacctggtcaagaagaaaatccacaacgccaacccggagctgactgatggccagatccaggccatgttaaggcgctggtttgtggaggtggagggaactgtgaaggcctatgtttgggacaacaacaaggatctggtggagtggctggagaaacagctcacagaggaggacggtgtccgctcggtgatcgaggaaaacatcaagtacatcagcagagactacgtcctcaagcagatccgcagcttggtccaggccaacccggaggtcgccatggattccatcgtccacatgacacagcacatctcccccacccagcgagcagaagtcgttcgaatcctctcgacgatggactcgccctcaacgtaggaagagcttctgcccacccccgccctgcctccggagctgagggccagagcggcccgtcacaccggaaaccaccgcaacgagcaggcgcaggagaccggagctgcagtcacgtggctttttgcttcccctcgatgtgttccggttccgcatgacacgtcgggccgcgggcacaccaccccgttcagtatttattaccctggctgtggctgcaggcccctgtccccaccctgaactaaaaggcaatgacgggtacagcacgtaccacgaggccttcctacacccgagcggggccgccccggcccgcgctcggaggcagggtggtcggcaggcggcagcccgcgctcgcccctggccccgtgagcctgcggccactggcagcagaggagggccgggacaggagcggggagtggggatcctcgcgctgctgcctctccaccccgcacccggccgggcacacgctctcctcgcaccaaggcactgcttaggaaggcaaatcagagcgtgaggtctgcaggtccgtggaactcaaagacgggcaaaaccgtgatccgagaagcagagaaaccgagtcactgttgccctgtttcagggcccctggccgggtccccttctctgagaacaaccttggggaggttgacctgccgtggccccaggggccactgcgtggccagctgaggtgcccggggccccactggcggtgccgccgtccaggctggcagaggaggagccggggagctgcctcctgtccctgacggaaaccaggcattgagccgcggcgagggcgggcccgccagcctctgtaggatgcggaaggctggcagcgtccagccgggcgcctgcagggccggcctctgttcccaggtccacccttctagcagcagacactcctgctcgccccgggtctcgtctccttctcgaaggcacaggcagcacgcgcagcagtggaaaggcaccccgctgacatcagggccctcggctccaggaactggccttgcccgccgtgggggaacttccaggggacacaggacccacgggaccttaaggttgtccacgaccccctcctggtgctgctgtcctccgggctcatgggccgctccccggccagcggcctgtcactggtgatggagagtttcttttcaaccaccagtttattcaaggaaagagcctcccaattccgctgctggtgttcctaaagcaagagtggcaggtgagcagggctgggctagcatccggttcctacagcgcagctactgcatctgtcgctggtgacggaggagggactcagtaagacgcctgagaagcaggggtatgaacgctttcgtacccgctccagttttgagccttaacctccagttcacgcacaatttgagagcccctctccccgtccccgggaacagcctgtgcagagaggccccgtggggccgacgtgtggccacctggccccagagcctcagcccggcagccctgctgtggggttcagcgccatcctgggcacgagaaggtggggacaacgttcagtccaggaagagtgtccactgtggctggtatctgcttacccagcaagaattagatccatctttgaccagattattcctctacacttttctacaataaataaaattccacacgcctacaggtggtgtgagatcctgtgcttgccctggcgtttcttcaggggctgggtgggtgacgcgcgtttcgtctccaccaccgaactgcgactcgttaaatgaacgcttcctctcgagaagtcagtgatgctcactctccgcgcccagagcccccactttaggtctttattggacaggactcttgtctaaggacaagtcagcacagtccgtgtcacacacgaggccaccgctgcacacgcgaggctgccaaggcagaggcgtgacccgccgaggcccgcctgagctgagctcaccgcgccggccgtcccccagtcacaaagcagccttcgccggtctcactgacgagtcagtggacgcgcagcccgacgggcacggcgcttcagtctaatgtattcttttccctttctgttgcaataaacctccccactggc

SEQ ID NO: 5077 - protein, 2346 aa, Ovis aries
MGEPSSLAKPLELNQHSRFIIGSVSEDNSEDEISNLVKLDLLEEKEGSLSPASVSSDTLSDLGISSLQDGLALHMRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIARRIPVQAVWAGWGHASENPKLPELLLKNGIAFMGPPSQAMWALGDKIASSIVAQTAGIPTLPWSGSGLCVDWHENDFSKRILNVPQELYEKGYVKDVDDGLKAAEEVGYPVMIKASEGGGGKGIRKVNNADDFPNLFRQVQAEVPGSPIFVMRLAKQSRHLEVQILADQYGNAISLFGRDCSVQRRHQKIIEEAPAAIATPAVFEHMEQCAVKLARMVGYVSAGTVEYLYSQDGSFYFLELNPRLQVEHPCTEMVADVNLPAAQLQIAMGIPLYRIKDIRMMYGVSPWGDAPIDFENSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQLNRIDTGWLDRLIAEKVQAERPDTMLGVVCGALHVADVSLRNSISNFLHSLERGQVLSAHTLLNTVDVELIYEGEKIVLKVTRQSPNSYVVIMNGSCVEVDVHRLSDGGLLLSYDGSSYTTYMKEEVDRYRITIGNKTCVFEKENDPSVLRSPSAGKLIQYIVEDGGHVFAGQCYAEIEVMKMVMTLTAAESGCIHYVKRPGAALDPGCVIAKMQLDNPSKVQQAELHTGSLPRIQSTALRGEKLHRVFHYVLDNLVNVMNGYCLPDPFFSSRVKDWVEGLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNAFTPPCQRMGGMVSFRTFEDFVRIFDEVMGCFCDSPPQSPTFPEAGHTSLYDEDKVPRDEPIHILNVAIKTDCDIEDDSLAAMFREFTQQNKATLVEHGIRRLTFLVAQKDFRKQVNYEVDQRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSSQAFLPPPPLPSDILTYTELVLDDQGQLVHMNRLPGGNEIGMVAWKMTLKSPEYPDGRDIIVIGNDITYRIGSFGPQEDLLFLRASELARAEGIPRIYVAANSGARIGLAEEIRHMFHVAWVDPEDPYKGYKYLYLTPQDYKRVSALNSVHCEHVEDEGESRYKITDIIGKEEGLGAENLRGSGMIAGESSLAYDEIITISLVTCRAIGIGAYLVRLGQRTIQVENSHLILTGAGALNKVLGREVYTSNNQLGGIQIMHNNGVTHSTVCDDFEGVFTVLHWLSYMPKSVYSSVPLLNSKDPIDRVIEFVPTKAPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECSQPVMVYIPPQAELRGGSWVVIDPTINPRHMEMYADRESRGSVLEPEGTVEIKFRRKDLVKTMRRVDPVYIHLAERLGTPELSARERKELESKLKEREEFLLPIYHQVAVQFADLHDTPGRMQEKGVINDILDWKTSRTFFYWRLRRLLLEDLVKKKIHNANPELTDGQIQAMLRRWFVEVEGTVKAYVWDNNKDLVEWLEKQLTEEDGVRSVIEENIKYISRDYVLKQIRSLVQANPEVAMDSIVHMTQHISPTQRAEVVRILSTMDSPST

SEQ ID NO: 5078 - DNA, 7452 bp, Homo sapiens
  CDS (1)..(7452)
atggtcttgcttctttgtctatcttgtctgattttctcctgtctgaccttttcctggttaaaaatctgggagaaaatgacggactccaagccgatcaccaagagtaaatcagaagcaaacctcatcccgagccaggagccctttccagcctctgataactcaggggagacaccgcagagaaatggggagggccacactctgcacaaagacacccagccaggccgagcccagcctcccacaaaggcccaaagatccggtcggcggagaaactccctaccaccctcccgccagaagcccccaagaaaccccctttcttccagtgacgcagcaccctccccagagcttcaagccaacgggactgggacacaaggtctggaggccacagataccaatggcctgtcctcctcagccaggccccagggcagcaagctggtcccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgctgtgaagtgcatgcgctccatccgcaggtgggcctatgagatgttccgcaacgagcgggccatccggtttgttcgcatggtgacccccgaggaccttaaggccaacgcagagtacatcaagatggcggatcattacgggcccgccccaggagggcccaataacaacaactatgccaacgtggagctgattgtggacattgccaagagaatcccgttgcaggcggtgtgggctggctggggccatgctttagaaaaccctaaacttccggagctgctgtgcaagaatggagttgctttcttaggccctcccaggttgaggccaatggtgggtctaggagataagatcgcctccaccgttgtcgcccagacgctacaggtcccaaccctgcccaggagtggaagcgccctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccgggaaactgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgcgccgctggccatattcgagttcatggagcagtgtgccattcgcctggccaagaccgtgggctatgtgagtgcagggacagtggaatacctctatagtcaggatggtagcttccacttcttggagctgaatcctcgcttgcaggtggaacatccctgcacagaaatgattgctgacgttaatctgccggccgcccagctacagatcgccatgggtgccccactgcaccggctgaaagatatccggcttctgtatggagagtcaccctggggagactccccaatttcttttgaaaactcagctcatctcccctgcccccgaggccacgtcattgccaccagaatcaccagcgaaaacccagacgagggttttaagccgagctccgggactgtccaggaactgaatttccggagcagcaagaacgtctggggttacttcacggtggccgctactggaggcctgcacgagtttgcgatttcccagtttgggcactgcttctcctggggagagaaccggaaagaggccatttcgaacatggtggtggctttgaaggaactgtccctccgaggcgactttaggactaccgtggaatacctcattaacctcctggagaccgagagcttccagaacaactacatcgacaccgggtggttggactacctcattgctgagaaagtgcaaaagaaaccgaatatcatgcttggggtggtatgcggggcccttgaacgtggagatgcgatgttcagaacgtgcatgacagatttcttacactccctggaaaggggccaggtcctcccagcggattcactactgaacctcgtagatgtggaattaatttacgagggtgtaaagtacattctaaaggtgacccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgtaccatcggcaataagacgtgtgtttttgagaaggagaacgatcctacagtcctgagatccccctcggctgggaagctgacacagatcacagtggaggatgggggccacgttgaggctgggagacgctacgctgagatggaggtgatgaagatgatcatgaccctgaacgttcaggaaagaggccgggtgaagtacatcaagcgtccaggtgcggtgctggaagcaggctgcgtggtggccaggctggagctcgatgacccttctaaagtccacccggctgaaccgttcacaggagaactccctgcccagcagaacactgccgacctcggaaagaaactgcacagggtcttccacagcgtcctgggaagcctcaccaacgtcatgagtggcttttgtctgccagagccgttttttagcataaagctgaaggagtgggtgcagaagctcatgatgaccctccggcacccgtcactgctgctggacgtgcaggagatcatgaccagtcgtgcaggccgcatccccccccctgttgagaagtctgtccgcaaggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatggtgcagttggtccagaggtaccgaagtggaatccgcggtcatatgaaaacagtggtgatcgatctcttgagaagatacttgcgtgttgagaccattttcggcaaggcaagagatgctgatgccaactccagtgggatggtggggggcgtgaggagcctgagctttacctctgtgtgggtggttttgtctcccccagcccactacgacaagtgtgtgataaacctcagggaacagttcaagccagacatgtcccaggtgctggactgcatcttctcccacgcacaggtgaccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgatcgcctccccctcctacgagctgcggcataaccaggtggagtccattttcctgtctgccattgacatgtacggccaccagttctgccccgagaacctccagaaattaatactttcggaaacaaccatcttcgacgtcctgaatactttcttctatcacgcaaacaaagtcgtgtgcatggcgtccttggaggtttacgtggggggggcttacatcgcctatgtgttaaacagcctgcagcaccggcagctcccggacggcacctgcgtggtagaattccagttcatgctgccgtcctcccacccaaaccggatgaccgtgcccatcagcatcaccaaccctgacctgctgaggcacacgacagagctcttcatggacagcggcttctccccactgtgccagcgcatgggagccatggtagccttcaggagattcgaggacttcaccagaaattttgatgaagtcatctcttgcttcgccaacgtgccgaaagacccccccctcttcagcgaggcccgcacctccctatactccgaggatgactgcaagagcctcagagaagagcccatccacattctgaatgtgtccatccagtgtgcggaccacctggaggatgaggcactggtgccgattttacgtacattcgtacagtccaagaaaaatatccttgtggattatggactccgacgaatcccattcttgattgcccaagagaaagaatttcccaagtttttcacattcagagcaagagatgagtttgcagaagatcgcatttaccgtcacttggaacctgccctggctttccagctggaactcaaccggatgcgtaacttcgatctgaccgccgtgccctgtgccaaccacaagatgcacctttacctgggtgctgccaaggtggaaggaaggtatgaagtgacggaccataggttcttcatccgtgccatcatcaggcactctgacctgatcacaaaggaagcctccttcgaatacctgcagaacgagggtgagcggctgctcctggaggccatggacgagctggaggtggcgttcaataacaccaacgtgcgcaccgactgcaaccacatcttcctcaacttcgtgcccactgtcatcatggaccccaacaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagaggcgattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcgggagctccggggaggctcctgggtggtcatagatgccaccatcaacccgctgtgcatagaaatgtatgcagacaaagagagcaggggtggtgttctggaaccagaggggacagtggagattaagttccgaaaggaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctga

SEQ ID NO: 5079 - protein, 2483 aa, Homo sapiens
MVLLLCLSCLIFSCLTFSWLKIWEKMTDSKPITKSKSEANLIPSQEPFPASDNSGETPQRNGEGHTLHKDTQPGRAQPPTKAQRSGRRRNSLPPSRQKPPRNPLSSSDAAPSPELQANGTGTQGLEATDTNGLSSSARPQGSKLVPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVRMVTPEDLKANAEYIKMADHYGPAPGGPNNNNYANVELIVDIAKRIPLQAVWAGWGHALENPKLPELLCKNGVAFLGPPRLRPMVGLGDKIASTVVAQTLQVPTLPRSGSALTVEWTEDDLQQGKRISVPEDVYDKGCVKDVDEGLEAAERIGFPLMIKASEGGGGKGIRETESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGAPLHRLKDIRLLYGESPWGDSPISFENSAHLPCPRGHVIATRITSENPDEGFKPSSGTVQELNFRSSKNVWGYFTVAATGGLHEFAISQFGHCFSWGENRKEAISNMVVALKELSLRGDFRTTVEYLINLLETESFQNNYIDTGWLDYLIAEKVQKKPNIMLGVVCGALERGDAMFRTCMTDFLHSLERGQVLPADSLLNLVDVELIYEGVKYILKVTRQSLTMFVLIMNGCHIEIDAHRLNDGGLLLSYNGNSYTTYMKEEVDSYRTIGNKTCVFEKENDPTVLRSPSAGKLTQITVEDGGHVEAGRRYAEMEVMKMIMTLNVQERGRVKYIKRPGAVLEAGCVVARLELDDPSKVHPAEPFTGELPAQQNTADLGKKLHRVFHSVLGSLTNVMSGFCLPEPFFSIKLKEWVQKLMMTLRHPSLLLDVQEIMTSRAGRIPPPVEKSVRKVMAQYASNITSVLCQFPSQQIATILDCHAATLQRKADREVFFINTQSMVQLVQRYRSGIRGHMKTVVIDLLRRYLRVETIFGKARDADANSSGMVGGVRSLSFTSVWVVLSPPAHYDKCVINLREQFKPDMSQVLDCIFSHAQVTKKNQLVIMLIDELCGPDPSLSDELISILNELTQLSKSEHCKVALRARQILIASPSYELRHNQVESIFLSAIDMYGHQFCPENLQKLILSETTIFDVLNTFFYHANKVVCMASLEVYVGGAYIAYVLNSLQHRQLPDGTCVVEFQFMLPSSHPNRMTVPISITNPDLLRHTTELFMDSGFSPLCQRMGAMVAFRRFEDFTRNFDEVISCFANVPKDPPLFSEARTSLYSEDDCKSLREEPIHILNVSIQCADHLEDEALVPILRTFVQSKKNILVDYGLRRIPFLIAQEKEFPKFFTFRARDEFAEDRIYRHLEPALAFQLELNRMRNFDLTAVPCANHKMHLYLGAAKVEGRYEVTDHRFFIRAIIRHSDLITKEASFEYLQNEGERLLLEAMDELEVAFNNTNVRTDCNHIFLNFVPTVIMDPNKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEAIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIRPMRELRGGSWVVIDATINPLCIEMYADKESRGGVLEPEGTVEIKFRKEDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 5080 - DNA, 2546 bp, Homo sapiens
  CDS (133)..(2310)
cccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaaaaaaaaaaaaaaaaaa

SEQ ID NO: 5081 - protein, 725 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 5082 - DNA, 3953 bp, Homo sapiens
  CDS (39)..(3575)
gggttcttacccatttaaagtttgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatcaagatgtcccaggtcctgggaagtttactcaataaagctggctttcccctgccctc

SEQ ID NO: 5083 - protein, 1178 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 5084 - DNA, 4456 bp, Pichia pastoris
  CDS (700)..(4269)
gaaaattcatcccaatcagggaagaatagcccgtaccgatgtccagtctaattagccatgtatagtccgatttgtagatttcgcacacccccactcgaaaccttcaccccacctaattggttcttttttttttttttttttttcgatttcatcatcggtagtgcatgaaactcataatcttttttgggctaaaacacaccatcatcgtattggcctgcaccgacaatcctccgattacagcttgagccagctttgtgaatggatgaccaattattgactcattccgtagttttgccactcaaaagggagccaattgaaggacactttgccggcccttctctccccaaatcatcaaccgtacctgtatatagctcgctctctctccaaaccccatgtacccctgctgctgagattaagcaacgagaaggaacccccggtctcttctgtccaagcaaaaaaaaaagattatgacatactccccatcctctatctcgccctctcgctcgatcctcccaatatctttcacccgcacacgaccttcgcaaattgggcggtaaaaattccttggtatcgatatataaagatgtgagtgggtccagcaattttgcccaaccaatcttctggcttccataccttcttttttttttttaaccaccccgctaaattaaaagaaaggatatttattcaattccttcagttatggccgaagaagactacctccccgtgtaccagctgagacgtgactcgtcgcttttgggcacaatgaacaagattttggttgccaacagaggcgaaattccaattcgtatcttcagaacggcccatgagctctcaatgaacacagtggccatctactctcacgaggaccgtttgtccatgcacagactgaaggctgatgaagcctatgttatcggtgagcgtggccagtactctccagtccaggcctatcttgcaattgacgagatcatcaagattgcggtgaagcataacgtcaacatgatccacccaggttacggattttgctctgaaaattctgagtttgctagaaaagttgaggagaacggtattttgtgggtcggaccatccgataccgtcatcgacgctgttggagacaaagtttccgccagaaacttggcctacgctgccaacgttccaaccgtccccggtacaccaggtccaattgaagacgtcgctcaagccacagcttttgtcgaagaatacggttacccagttatcattaaggcagcctttggtggtggtggaagaggtatgcgtgtggttcgcgaaggagatgacatagaagatgctttcctgagagcttctagtgaggccaagactgcgttcggtaacggtaccgtcttcattgaacgtttcctggacaaaccaaagcacattgaagtccaactgttggctgataactacggtaatgttattcatttgttcgagagagattgttccgttcaaagaagacaccaaaaagttgctcgaaattgctccgcaaagacactcccagtcgaggtccgtaatgcaatcttgaacgacgctgtcaaattagccaagactgccaattatagaaacgctggtaccgccgagtttttggtggacagccagaacagacactactttatcgagattaaccctcgtattcaagttgagcacaccattaccgaggaaattactggtgtagatatagttgctgcccagattcaaattgctgctggtgcttcgttagagcaactcggcttattgcaagaaaaaattaccacccgtgggtttgccattcaatgtcgtatcaccactgaagaccccactaagaactttcaaccagacacgggaaagatcgaagtttatagatcctctggtggtaacggagtcagacttgacggtggtaacgggtttgctggtgccgtcatctcgccccattatgattcgatgttggtgaagtgttccacttctggctctaactacgagattcgtcgtcgtaagatgatcagagcgttagttgaattcagaattagaggtgttaaaactaacattcctttcttgttggctttattgactcaccctgttttcatgacctccgaatgttggactacatttattgatgatactccagaattgttcaagattttgacttcccagaacagagcccagaagctgctggcttacttaggtgatctggctgttaatggttcctcaatcaagggacaaataggtctgcctaaactacacaaggaggctgatattccttcaatcactgatataaatggagatgttattgatgtctctattcctcctcctgatggatggagacagtttttgttggagaagggtcctgagcaatttgctcagcaagtgcgtgctttccctgggttgatgattatggacactacctggagagatgctcaccagtctttgcttgcaactcgggttagaacccatgacttgctaaatattgcaccagctacgtcttatgccctacatcacgcttttgcactggaatgttggggaggtgccacttttgacgtctccatgcgtttcttgcacgaggacccatggcaaagactgcgcaaactgcgtaaagctgtaccaaatatcccattctccatgttattgagaggtggtaacggtgttgcttactattctcttccagataatgcaattgaccactttcttaagcaggccaaagatactggtgtcgatgtcttccgtgttttcgatgctttaaacgatattgagcaattgaaggtcggagttgacgccgtcaagaaggctgggggtgttgtcgaagctactatgtgttattccggagacatgttgaagccaggtaaaaagtataacttggaatactacatcaatctggcaactgaaattgttgagatgggtacccacatattagctgttaaggatatggctggtacattaaaacctaccgctgccaaacagttgatctctgctttgaggagaaagttcccttcgttgccaatccacgttcatactcacgactctgccggtacaggtgttgcctccatggtggcctgtgctagagctggtgctgatgttgtgactgtgcgtgttaactctatgtctggtatgacttctcaaccctcaatgtctgctttcattgcgtctttagatggagaaattgagactggtattcctgaagctaatgccagagagattgatgcttactgggctgagatgagacttttgtactcatgtttcgaagctgatctaaagggacctgacccagaagtttatcagcatgagattccaggtggtcaactgactaacttactgttccaagctcaacaggttggtctgggagaaaaatgggttgaaactaagaaagcatatgaggctgctaacagattgcttggtgacattgtgaaggtcacaccaacctctaaggtcgttggtgacttggctcaattcatggtatctaataagttgtcatccgaagatgtcgagagactggcatctgagttagatttcccagattctgttcttgacttttttgagggcttgatgggtactccatatggaggtttccctgagccattgagaactaatgtcatctcaggaaaaagacgaaagctaactagcagacctggtttgactttggagccatacaacattcctgccattagagaggatcttgaggctcgtttcagtaaggtcactgagaatgacgttgcctcttacaacatgtatcctaaagtttacgaggcttataagaagcagcaagaattatatggagacttgtctgtgcttccaaccagaaacttcctgtctcctcctaaaattgacgaagagagacatgtgaccattgtgaccattgaaacaaggaaaacactaatcatcaagtgtatggctgaaggtgagctatctcaatcatccggtactagagaagtgtactttgaattgaacggtgagatgagaaaggtcacagttgaggacaagaatggcgctgttgaaactatcaccagacctaaggctgatgctcacaaccctaacgagattggtgctccaatggctggtgtcgttgttgaggttagagtccacgaaaatggtgaagttaagaagggtgatccaattgcagttttatctgcgatgaagatggagatggttatctcctcccctgttgctggtcgtattggacagattgcagtcaaggagaacgattctgttgatgccagcgacctgatcccaaaatcgtcaaggctgagtaaactattgatgtttattattcttattatattatactaaaatatgttattacgattataccctctactgtttccttattgtggaccgtcttccataaactcttctttgaagcatttcctgtctttctcttttcttagcctgtgccagttgttcttgtttcagttcctgatccttttctcttcctaacttttcctgtatttctttttgcttcttcttttgaagatcc

SEQ ID NO: 5085 - protein, 1189 aa, Pichia pastoris
MAEEDYLPVYQLRRDSSLLGTMNKILVANRGEIPIRIFRTAHELSMNTVAIYSHEDRLSMHRLKADEAYVIGERGQYSPVQAYLAIDEIIKIAVKHNVNMIHPGYGFCSENSEFARKVEENGILWVGPSDTVIDAVGDKVSARNLAYAANVPTVPGTPGPIEDVAQATAFVEEYGYPVIIKAAFGGGGRGMRVVREGDDIEDAFLRASSEAKTAFGNGTVFIERFLDKPKHIEVQLLADNYGNVIHLFERDCSVQRRHQKVARNCSAKTLPVEVRNAILNDAVKLAKTANYRNAGTAEFLVDSQNRHYFIEINPRIQVEHTITEEITGVDIVAAQIQIAAGASLEQLGLLQEKITTRGFAIQCRITTEDPTKNFQPDTGKIEVYRSSGGNGVRLDGGNGFAGAVISPHYDSMLVKCSTSGSNYEIRRRKMIRALVEFRIRGVKTNIPFLLALLTHPVFMTSECWTTFIDDTPELFKILTSQNRAQKLLAYLGDLAVNGSSIKGQIGLPKLHKEADIPSITDINGDVIDVSIPPPDGWRQFLLEKGPEQFAQQVRAFPGLMIMDTTWRDAHQSLLATRVRTHDLLNIAPATSYALHHAFALECWGGATFDVSMRFLHEDPWQRLRKLRKAVPNIPFSMLLRGGNGVAYYSLPDNAIDHFLKQAKDTGVDVFRVFDALNDIEQLKVGVDAVKKAGGVVEATMCYSGDMLKPGKKYNLEYYINLATEIVEMGTHILAVKDMAGTLKPTAAKQLISALRRKFPSLPIHVHTHDSAGTGVASMVACARAGADVVTVRVNSMSGMTSQPSMSAFIASLDGEIETGIPEANAREIDAYWAEMRLLYSCFEADLKGPDPEVYQHEIPGGQLTNLLFQAQQVGLGEKWVETKKAYEAANRLLGDIVKVTPTSKVVGDLAQFMVSNKLSSEDVERLASELDFPDSVLDFFEGLMGTPYGGFPEPLRTNVISGKRRKLTSRPGLTLEPYNIPAIREDLEARFSKVTENDVASYNMYPKVYEAYKKQQELYGDLSVLPTRNFLSPPKIDEERHVTIVTIETRKTLIIKCMAEGELSQSSGTREVYFELNGEMRKVTVEDKNGAVETITRPKADAHNPNEIGAPMAGVVVEVRVHENGEVKKGDPIAVLSAMKMEMVISSPVAGRIGQIAVKENDSVDASDLIPKSSRLSKLLMFIILIILY

SEQ ID NO: 5086 - DNA, 3945 bp, Rattus norvegicus
  CDS (35)..(3571)
cgcggcggccacggcttgaggcgacggggcgaagatgctgaagttccaaacagttcgagggggcctgaggctcctgggtgtccgccgatcctccacagcccccgttgcctccccaaatgtccggcgtctggagtacaagcccatcaagaaagtaatggtggccaacagaggtgagattgccatccgagtgtttcgtgcctgcacagagctgggtatccgcacagtggctgtctactcggagcaggacacaggccagatgcaccggcagaaagctgatgaagcctaccttattggccgtgggctggctcctgtgcaagcctacctgcacattccagacatcattaaggtggccaaggagaatggtgtagatgctgtgcaccctggctatgggttcctctcagagagagcagactttgcccaggcctgccaagatgctggagtccgattcattggtccaagcccagaggtggtccgcaagatgggagacaaggtggaagcccgggccattgccattgctgcaggcgttccagtggtccctggcactaattcccccatcaattccctgcatgaggcacacgagttctctaacacctatggtttccctattatcttcaaggctgcctatggaggtgggggccgtggcatgagggttgtgcatagctacgaggagctggaagagaattacacccgggcctaccctgaggccttggcagcctttgggaatggggcattgtttgtggagaaattcattgagaagccaagacacattgaggtgcagatcctaggggaccaatatgggaacatcttgcacttgtatgagcgggactgctccatccagcggcggcaccagaaggtggtagagattgcccctgctacccacctggacccccaacttcggtcacgcctcaccagtgactctgtcaaacttgccaagcaggttggctatgagaatgcaggcactgtggagttcctggtggacaagcatggcaagcactacttcatcgaggtcaattcccgcctgcaggtggagcacacggtcactgaggagattacagatgtggacctggtccatgctcagatccatgtgtccgaaggccggagcctgcctgacctaggcctgcggcaggaaaacatccgaatcaatggttgtgccattcagtgtcgggtcaccactgaggaccctgcacgcagcttccagccagacactggccgcattgaggttttccggagtggtgagggcatgggcatccgcctggacaatgcctcagcattccagggagctgtcatatccccccactatgactccctgctcgtcaaagtcattgcccatggcaaagaccaccctacagctgccaccaagatgagcagagccctggcggagttccgtgtccgaggtgtaaagaccaacatccccttcctgcagaatgtgctcaacaaccagcagttcctagcgggcattgtggacacccagttcatcgatgagaaccccgagctgttccagctgcggcctgcacagaaccgggcccagaagttgctacattaccttggacacgtcatggtcaatggccctaccactccaatccccgtcaaggtcagtcccagccctgtggaccccattgttcctgtggtgcccataggcccacccccagctggtttcagagacatccttctgcgagaggggccagagggctttgccagagctgtgcggaatcaccaggggctgctgctaatggacacaaccttccgggatgcccaccagtcactacttgccactagagtgcgcacacacgatctcaaaaagattgcaccctacgttgcccacaacttcaacaacctcttcagcatagagaactggggaggagccacatttgacgtggccatgcgcttcttgtatgagtgcccctggcggcggctccaggagctccgggagctcatccccaacatcccattccagatgctactgaggggggccaatgctgtgggctacaccaactaccctgacaacgtggtcttcaagttctgtgaggtggccaaagagaatggcatggacgtcttccggatctttgactcccttaactacctgccaaacatgctgctgggcatggaagcagctggcagtgctgggggtgtggtggaagctgccatctcctacacgggtgacgtggctgaccccagtcgcactaaatactcactggagtactacatgggcttagctgaagaactggtgcgagccggcactcacatcctctgcattaaggacatggcaggcctgctgaagcctgcagcatgcaccatgctggtcagctccctccgggaccggttccccgacctcccactgcacatccatacccatgacacatcagggtcaggtgtggcagccatgttggcctgtgcacaagctggggctgatgttgtggatgtggcagtcgactctatgtctgggatgacctcacagcccagcatgggggccctggtggcctgtaccaaagggactcctctggacacagaggtacccctggagcgtgtgtttgactacagtgagtattgggaaggggctcgggggctgtatgcagcctttgattgcacggctaccatgaagtctggcaactcagacgtgtatgagaatgaggatccagggggccagtacaccaacctacacttccaggcccacagcatgggacttggctccaagttcaaggaggtcaagaaggcctatgtggaggctaaccagatgctgggggacctcatcaaggtgacaccatcctccaagattgtgggggatctggcccagttcatggtgcagaacgggttgagccgggcagaggcagaagctcaggcagaagagctgtccttcccccgctctgtggtggagttcctgcagggctacattggcattccccatgggggtttccctgaacccttccgttctaaggtgctaaaggacctgccaaggatagaaggagggcctggagcctccctccctcccttgaacctgaaggagctggagaaggacctgattgataggcatggagaggaggtgaccccagaggacgttctctctgcagccatgtaccctgatgtctttgctcagttcaaagacttcacggctacctttggccccctggatagcctgaatactcgtctctttcttcaaggacccaaaattgcagaggagtttgaggttgagctggaacggggcaagaccttgcacatcaaagccctggctgtaagcgacctgaaccgtgctggccagaggcaggtgttctttgaactcaatgggcagcttcgatccattctggttaaagacacccaggccatgaaggagatgcacttccatcccaaggccttgaaggatgtgaagggccaaattggggcccctatgcctgggaaggtcatagacgtcaaggtggcagcaggagccaaggtggttaagggccagcccctctgtgtgctcagcgccatgaagatggagactgtggtgacttcgcccatggagggcactatccgaaaggttcacgtgaccaaggacatgactctggaaggcgatgacctcatcctagagattgagtgatcttactccagactggcagcctggccaaccctaccccaagcctctcaacagaagctgtgcagccagggcaggcccaggcagtacctgagggctaggccttgaggtcctgtcccatgggacagcacacacactacctgcaatggccctcccattcccttcagctatttgtccttgtcttgctggcaggcagttctcacatattcatctcttgccaaataagggtctgctcctcgtgggagaccacaggtgtacagtaggtggccttgtacctgggagaggggttctacctctgggggtagagggaagaagacctaattcataggtcctgggaaatttgctcaataaaagtggccttcccttgccctccacaaaaa

SEQ ID NO: 5087 - protein, 1178 aa, Rattus norvegicus
MLKFQTVRGGLRLLGVRRSSTAPVASPNVRRLEYKPIKKVMVANRGEIAIRVFRACTELGIRTVAVYSEQDTGQMHRQKADEAYLIGRGLAPVQAYLHIPDIIKVAKENGVDAVHPGYGFLSERADFAQACQDAGVRFIGPSPEVVRKMGDKVEARAIAIAAGVPVVPGTNSPINSLHEAHEFSNTYGFPIIFKAAYGGGGRGMRVVHSYEELEENYTRAYPEALAAFGNGALFVEKFIEKPRHIEVQILGDQYGNILHLYERDCSIQRRHQKVVEIAPATHLDPQLRSRLTSDSVKLAKQVGYENAGTVEFLVDKHGKHYFIEVNSRLQVEHTVTEEITDVDLVHAQIHVSEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIPFLQNVLNNQQFLAGIVDTQFIDENPELFQLRPAQNRAQKLLHYLGHVMVNGPTTPIPVKVSPSPVDPIVPVVPIGPPPAGFRDILLREGPEGFARAVRNHQGLLLMDTTFRDAHQSLLATRVRTHDLKKIAPYVAHNFNNLFSIENWGGATFDVAMRFLYECPWRRLQELRELIPNIPFQMLLRGANAVGYTNYPDNVVFKFCEVAKENGMDVFRIFDSLNYLPNMLLGMEAAGSAGGVVEAAISYTGDVADPSRTKYSLEYYMGLAEELVRAGTHILCIKDMAGLLKPAACTMLVSSLRDRFPDLPLHIHTHDTSGSGVAAMLACAQAGADVVDVAVDSMSGMTSQPSMGALVACTKGTPLDTEVPLERVFDYSEYWEGARGLYAAFDCTATMKSGNSDVYENEDPGGQYTNLHFQAHSMGLGSKFKEVKKAYVEANQMLGDLIKVTPSSKIVGDLAQFMVQNGLSRAEAEAQAEELSFPRSVVEFLQGYIGIPHGGFPEPFRSKVLKDLPRIEGGPGASLPPLNLKELEKDLIDRHGEEVTPEDVLSAAMYPDVFAQFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDVKVAAGAKVVKGQPLCVLSAMKMETVVTSPMEGTIRKVHVTKDMTLEGDDLILEIE

SEQ ID NO: 5088 - DNA, 3858 bp, Xenopus laevis
  CDS (33)..(3566)
cccacgcgtccggttgaagtggtcagcccataatgttgcagctccgttttgtcaagggaggcctgaccttcctcggtgtgaaacgcatctctgtgctcaatgctgcctttcagagcacccaacgtgtggagtacaagcctatcaaaaaagttttagtggccaacagaggtgagattgccacacgtgtctttagagcatgcacggaactggggataaggactgtagctgtctattcagagcaggatacaggccaggtacatagacagaaagcagatgaggcttatctcattgggaaaggattgccgccagtccaggcctacttaagcatacccgatatcatcaaggttgctaaggcgaatgaggttgatgcggttcaccctggttatggtttcctttctgagcgctctgattttgctcaggcctgcacagatgcaggcgtaagattcattggaccctctgctgaggtggtacgcaagatgggtgacaaagtggaggctagagccattgcggttagcgcaggggtgccggttgttccaggcacagacgctccaatcagctgcctgacagaggccaaggaattctctaacaaatatggcttccctataatattcaaggctgcatatggaggtggtggacgtggtatgagagtagtgcggagctatgaggagctggaggaaaattacaccagagcctactctgaagccctctctgcctttggaaatggagcattgtttgtggaaaaatttattgaaaaacctcgccacattgaagttcagatactcggtgataaatatggaaatgtggtacatttgtatgaaagagactgttcagtccagagaaggcaccagaaggtggttgaaatagccccagctgcacagctggaccttcagctcagagacagactgacccatgactctgtaaaactggcaaaacaggtgggttatgagaatgccggcactgtggagttcttggtggataaacatggcaagcattacttcatagaagtcaactccagactccaagttgagcatacagtaacggaagaaattacagatgttgacctagtccatgcccagatccatgttgcagagggaaaaagccttcctgaccttggcctcaagcaagagaacatccgtatcaatggttgtgccattcagtgcagagtcacaacagaagacccttcacgtgggtttcagcctgatactggtcggattgaggttttccggagtggagaaggaatgggaatccgactagacagtgcttcagcttttcaaggagctgtcatttccccacattatgactcccttctggtcaaggttattgcacacggaaaagaccatcaagttgccgccacaaaaatgagcagagctttggcagagttccggattaggggtgttaagaccaatattcccttcctgcaaaacgtcttgaacaataatcagtttctccatggtacagtagacactcagtttattgatgaaaatccagacctcttcaatttgaaacccgtgcaaaacagagctcaaaaactcctgcattatctaggtcatgtaatggtcaatgggccaactacgccgataccagttaaggcaagtccatcctctgtagaccctgtcatacctccaatcccaatgaatgagccacctcctggcttccgtgatattctcctgcgtgagggtcctgaaggttttgctaaagctatacgacagcataaaggcttattacttatggatacaaccttcagagatgcccaccagtctcttcttgcaacccgtgtacgcacacatgaccttaaaaagattgctccttttgtgtcgcataacttcaacaatcttttcagcttagaaaactggggaggtgccacatttgatgttgcaatgcgctttctttatgaatgtccatggaaacgcttacaggagttaagggaactcattcccaatattcccttccaaatgctacttagaggagcaaatgccgtaggttataccaactacccagataatgcagtcttcaaattttgtgaggttgcaaaagaaaatgggatggatatctttagggtctttgactctcttaactacctgcctaacatgatcctgggtatggaagcagccggtcgggcaggtggagtggtagaagctgccatctcctacacaggtgatgtggctgatccaacccgcactaaatatactctggactactatgtgaacctggcagaagagctggttaaagctggaactcacatcttgtgtatcaaggatatggctggacttctaaaacccaaagcttcagacatgctgatccgtgcattgcgagacaagtttcccaatgttcccatccatgtccacacacatgacactgcaggagctggtgtggcatctatgttggcatgtgcacatgcaggagcggacattgtagatgtggcagttgattctatgtctgggatgacctcacagcctagcatgggagcacttgtggcatgtgctaagggcacagatcaggacacaggcattcaacttgagaaagtgttcgattacagtgaatactgggaagtagcccgtggtctttattccgcttttgactgcactgccaccatgaaatctggcaatgccgatgtgtatgaaaatgaaatccctggaggccagtacaccaaccttcacttccaggcccacagtatgggactaggcaacaaattcaaggaagtaaagaaggcttatgctgaagccaataaaatccttggggatgtcattaaggttacaccctcctctaagattgtcggagacctggcgcaatttatggtgcataatgacctaaatcgggaaaatgtggaaacaatggccgatgaactctccttccccctctctgtggtggaatatttgcaaggctatgttggaatcccttatggaggatttccagagcctttccgttctaaggttcttaaagatctgccccgcattgagggtaggcctggggcaacactcccacccatggacttttcaaaactggagacaaaactgaaaggcaaatatgatgacattaccccagaagatattatgtcagcggcgatgtacccaaaagtgtttgaggaatacaaggatttcggtactcagtttgggccagttgaatgtcttaacacacgtctctttttggaaggacctaagattgcagaagaatttgaggtggaattagaaagaggaaagaccttacacatcaaagcacttgccttgggagatcttaataaagctggtcagagggaagtcttcttcgaactcaatggtcaactcagatctgtccttgtcaaagacactcaggccatgaaggagatgcatttccaccccaaagccctgaaagatgtgaaaggccagataggtgccccaatgccaggcaaggtcattgacatcaaagtcaaggagggggctaaagttgaaaagggacagcctctctgtgtgctcagtgccatgaagatggagacattggtcaactcaccagttactggaacagtcaagaaagtccatgtaaaactggatatgcatctggaaggcgaagaccttttactggaaattgaataaacattcagatgaacataaatactggaagatgatgtcagatgctatgtgcaagtcccccctctctccttggaagcaggagtgttatgtcctctcatcttgtgcttgtggacattgttggtatgagtctatgctggtttaggaccgaagtctattatgggagttttttccttgaaaggctgatctttttttccccttccttgagaagtatttgctggaaagtcttttatcaacttgtattatattactcaagtgtcagattaaaactaagagctttaaaaaaaaaaaaaaaaaa

SEQ ID NO: 5089 - protein, 1177 aa, Xenopus laevis
MLQLRFVKGGLTFLGVKRISVLNAAFQSTQRVEYKPIKKVLVANRGEIATRVFRACTELGIRTVAVYSEQDTGQVHRQKADEAYLIGKGLPPVQAYLSIPDIIKVAKANEVDAVHPGYGFLSERSDFAQACTDAGVRFIGPSAEVVRKMGDKVEARAIAVSAGVPVVPGTDAPISCLTEAKEFSNKYGFPIIFKAAYGGGGRGMRVVRSYEELEENYTRAYSEALSAFGNGALFVEKFIEKPRHIEVQILGDKYGNVVHLYERDCSVQRRHQKVVEIAPAAQLDLQLRDRLTHDSVKLAKQVGYENAGTVEFLVDKHGKHYFIEVNSRLQVEHTVTEEITDVDLVHAQIHVAEGKSLPDLGLKQENIRINGCAIQCRVTTEDPSRGFQPDTGRIEVFRSGEGMGIRLDSASAFQGAVISPHYDSLLVKVIAHGKDHQVAATKMSRALAEFRIRGVKTNIPFLQNVLNNNQFLHGTVDTQFIDENPDLFNLKPVQNRAQKLLHYLGHVMVNGPTTPIPVKASPSSVDPVIPPIPMNEPPPGFRDILLREGPEGFAKAIRQHKGLLLMDTTFRDAHQSLLATRVRTHDLKKIAPFVSHNFNNLFSLENWGGATFDVAMRFLYECPWKRLQELRELIPNIPFQMLLRGANAVGYTNYPDNAVFKFCEVAKENGMDIFRVFDSLNYLPNMILGMEAAGRAGGVVEAAISYTGDVADPTRTKYTLDYYVNLAEELVKAGTHILCIKDMAGLLKPKASDMLIRALRDKFPNVPIHVHTHDTAGAGVASMLACAHAGADIVDVAVDSMSGMTSQPSMGALVACAKGTDQDTGIQLEKVFDYSEYWEVARGLYSAFDCTATMKSGNADVYENEIPGGQYTNLHFQAHSMGLGNKFKEVKKAYAEANKILGDVIKVTPSSKIVGDLAQFMVHNDLNRENVETMADELSFPLSVVEYLQGYVGIPYGGFPEPFRSKVLKDLPRIEGRPGATLPPMDFSKLETKLKGKYDDITPEDIMSAAMYPKVFEEYKDFGTQFGPVECLNTRLFLEGPKIAEEFEVELERGKTLHIKALALGDLNKAGQREVFFELNGQLRSVLVKDTQAMKEMHFHPKALKDVKGQIGAPMPGKVIDIKVKEGAKVEKGQPLCVLSAMKMETLVNSPVTGTVKKVHVKLDMHLEGEDLLLEIE

SEQ ID NO: 5090 - DNA, 3468 bp, Agrobacterium vitis
  CDS (1)..(3468)
atgtctatttccaagatcctagttgccaatcgctccgaaatcgccattcgcgtgtttcgggctgccaatgaactcggcataaaaacggtcgccatctgggctgaggaggacaagctctccctgcatcgcttcaaggcggacgaaagctatcaggtcggtcgcggcccgcatctgaagcgggatctcggcccgatcgaaagctatctttccattgaggaaatcatccgtgtcgccaaactgtcaggcgcggacgccatccatccgggctatggccttctgtccgaaagtcccgaatttgtcgatgcctgtaacgatgcaggtctgattttcatcggcccgacctccgatacgatgcggcaattgggcaacaaggtcgctgcccgcaatctggcggtagacgtcggcgttcccgtggtgccagccacagaaccgctgcctgatgacatggacaccgtggccaaaatggcaggcgagatcggctatccgctgatgcttaaggcatcctggggcggtggcgggcgcggcatgcgggtgatccgctccgaaagcgatctggcccgcgaagtcacggaggccaagcgcgaggcaaaggcggccttcggcaaggatgaagtctatctggaaaagctggtggaaaatgcccgccatgtcgaaagccagatcctgggtgatacccatggcaatgccgtgcatctgttcgaacgcgattgctcggtgcagcgccgcaaccagaaagtcgtggaacgggcacccgccccctatctttccgaggagcagcgccaggaacttgccgcctattcgctgaaaattgccagagccaccggctatatcggtgccggcaccgtagaatatctgatggatgccgatactggaaaattctacttcatagaggtcaacccgcgcattcaggtggagcataccgtcaccgaagtggtgaccggtatcgacatcgtcaaggcacagatccatatcctcgaagggtttgcgatcggcacgccggaatcgggcgttcccccgcctgaggatatccgcctgcatggccatgccctgcaatgccgtgttacgaccgaggaccccgagcataatttcattcccgattacggccgtatcaccgcctatcgctcggcggcaggtttcggcatccggcttgatggcggaactgcatataccggcgcgatcatcacccgtttctatgatccgctgctggtcaaagtgaccgccgcaggcagctcgccacaggaagcgattagccggatggatcgggcgctgcgcgaattccgtatccgcggtgtcgccaccaatctgaccttcctggaagcgatcatcggacacccgaaatttcgcgacaacacctatacgacgcgcttcatcgataccacaccggaactgttcgcccaggtcaagcgccaggaccgcgccaccaagctgctgacctatctggccgacgtgaccgtcaacggccacccggaaaccaaaggccgtcccaagccctcggacaaggcggcaaagccggtcattccctatatcgatgccagtatcaccgatggcaccaagcagaagcttgatgcactggggccaaagggctttgccgagtggatgcgcaacgaaccgcgtgtgcttttgaccgatacgaccatgcgcgacggccatcaatcgctgctggccacccggatgcgcactcatgacattgcccggatcgccagcgtctacgcccgcgccctgcccaatctactctcgctggaatgctggggcggcgcgacctttgacgtgtcgatgcggttcctgacagaagatccgtgggagcggctggcactgatccgcgaaggcgcacccaacctgctgctgcaaatgctgctccgcggcgcaaacggtgtcggctataccaattaccccgacaatgtcgtcaaatattttgtccgccaggcggcaaagggtggcatcgacctgttccgggtgtttgattgcctgaactgggtcgataatatgcgcgtctccatggatgccgtgcaggaagaaaacaagctgtgcgaggcggcaatctgctataccggcgatctcctgaacagcgccagaccgaaatatgatctgaaatattatacggctctcgccgccgaactggaaaaagcaggcgcccatatcattgccgtcaaggatatggccgggttgctcaaacccgcagccgcgaaagtgctattcaaggcgttgcgtgaggcgaccatcctgccgatccatttccacacccatgacacatcgggcatttccgccgccaccgtgctggcagccattgatgccggtgttgatgccgtggatgccgccatggacgcgctgtcgggcaacacgtcccagccctgcctcggctcgatcgttgaggctctggccggaaccgagcgcgatccggggctcgatccggaatggattcgtcggatttccttctattgggaatcagtccgcggccaatatgcggccttcgaaagcgatctcaagggtccggcctccgaagtctatctgcatgaaatgcccggcggccagttcaccaacctgaaggaacaggcccgttcgctggggctggaaacccgctggcacgaggtggcgcaggcctatgccgacgtcaaccagatgttcggtgatatcgtcaaagtcacgccttcttccaaggtggtgggcgatatggcgctgatgatggtggcacaggacctgacggtggacgatgtcgagaatccggataaggatattgccttccctgattcggtcgtctcgatgctgaagggtgacctcggccaaccacccggcggctggccgcagagcctacaaaagaaagcgttgaagggcgaaaaaccatatacggctgtgccgggctcgcttttaccgcccgccgatctcgatgccgaacgcaagaccatcgaggacaagctggagcgcagtgtcagtgatttcgaattcgaattcgcgtcctacctgatgtatccgaaagtgttcaccgatttcgccctggcctccgatacctatggcccggtctcggtcctgccgacccattcctatttctacggcatgggcgatggcgaggaattgtttgccgaaatcgaaaaaggcaagacgcttgttatcgtcaaccaagcggccagtgctcccgatgcccagggcctggtgacgatgtttttcgagctgaacggtcagccacgccgcatcaaggtgccggaccgcagccatggagcgtccggggccgccgcccgccgcaaggcggaagccgccaatgccgcccatatcggcgcaccgatgcctggtgtcatctcgcgggtcttcgtttccgcaggacaggcggtcaaagccggggacgttctactgtccatcgaagcaatgaagatggaaaccgcgctgcatgccgaacacgatggcaagattgccgaagtgctggtgaaagccggtgaccagatcgacgccaaggacctgctgatcggccttgaggcataa

SEQ ID NO: 5091 - protein, 1155 aa, Agrobacterium vitis
MSISKILVANRSEIAIRVFRAANELGIKTVAIWAEEDKLSLHRFKADESYQVGRGPHLKRDLGPIESYLSIEEIIRVAKLSGADAIHPGYGLLSESPEFVDACNDAGLIFIGPTSDTMRQLGNKVAARNLAVDVGVPVVPATEPLPDDMDTVAKMAGEIGYPLMLKASWGGGGRGMRVIRSESDLAREVTEAKREAKAAFGKDEVYLEKLVENARHVESQILGDTHGNAVHLFERDCSVQRRNQKVVERAPAPYLSEEQRQELAAYSLKIARATGYIGAGTVEYLMDADTGKFYFIEVNPRIQVEHTVTEVVTGIDIVKAQIHILEGFAIGTPESGVPPPEDIRLHGHALQCRVTTEDPEHNFIPDYGRITAYRSAAGFGIRLDGGTAYTGAIITRFYDPLLVKVTAAGSSPQEAISRMDRALREFRIRGVATNLTFLEAIIGHPKFRDNTYTTRFIDTTPELFAQVKRQDRATKLLTYLADVTVNGHPETKGRPKPSDKAAKPVIPYIDASITDGTKQKLDALGPKGFAEWMRNEPRVLLTDTTMRDGHQSLLATRMRTHDIARIASVYARALPNLLSLECWGGATFDVSMRFLTEDPWERLALIREGAPNLLLQMLLRGANGVGYTNYPDNVVKYFVRQAAKGGIDLFRVFDCLNWVDNMRVSMDAVQEENKLCEAAICYTGDLLNSARPKYDLKYYTALAAELEKAGAHIIAVKDMAGLLKPAAAKVLFKALREATILPIHFHTHDTSGISAATVLAAIDAGVDAVDAAMDALSGNTSQPCLGSIVEALAGTERDPGLDPEWIRRISFYWESVRGQYAAFESDLKGPASEVYLHEMPGGQFTNLKEQARSLGLETRWHEVAQAYADVNQMFGDIVKVTPSSKVVGDMALMMVAQDLTVDDVENPDKDIAFPDSVVSMLKGDLGQPPGGWPQSLQKKALKGEKPYTAVPGSLLPPADLDAERKTIEDKLERSVSDFEFEFASYLMYPKVFTDFALASDTYGPVSVLPTHSYFYGMGDGEELFAEIEKGKTLVIVNQAASAPDAQGLVTMFFELNGQPRRIKVPDRSHGASGAAARRKAEAANAAHIGAPMPGVISRVFVSAGQAVKAGDVLLSIEAMKMETALHAEHDGKIAEVLVKAGDQIDAKDLLIGLEA

SEQ ID NO: 5092 - DNA, 1341 bp, Geobacter sulfurreducens
  CDS (1)..(1341)
atgtttcataaagttctgattgcaaatcgtggcgaaatcgccctgagggtcatccgggcctgcaaagagctgggaatcaagaccgttgccgtctactcgacagcggacagggattcgctccatgtgaagctcgcggatgagagtgtctgcatcggtcccgcgccgagcctgcagagctatcttaatattaacgccatcatttcggctgccgaattgaccgatgccgaggcaatccaccccggctacggttttctgtcggaaaatgccgcttttgccgaaatctgtgaaaactgcggtataaccttcatcggcccctcttcacaaagcatgcgcatcatgggcgacaagatcagcgcccggcaggcggtgatcaaggaaaatgtgccgatcctgcccggcaccaaggagggggttaacgacgtcaacgaggcggtgaagatcgccaagaagatcggcttccccgtcatcatcaaggcgactgccggaggcggtggccgggggatgaagatcgtgcactccccggcggccctccccaacgcctttgccacggctcgcgccgaggctcaggccggtttcggcaaccctgaggtctacattgagaagtattgcgagaagccgcgccacgttgagatccaggtcatggccgacaagcacggtaacgtgattcacctgggtgagcgggactgctccatccagcgtcgccaccagaagatcatcgaggagtcgccgtgcccggtcatgactcctgcactccgcaaggccatgggtgatgcggctgttcgcgcgtccaaggcagtggggtacgacagtgtcggcaccgttgagttcctggtggacaaggacctcaacttctatttcatggaaatgaatacccgggtgcaggttgagcatccggtgaccgaaatggtgaccggcatcgacatcgtccgggagcagatccgttctgcagccggtctcaagcttcgttacaagcaaagcgacattaaactgcacggtcacgctattgaatgccgtatcaatgctgaagatccggtgaagttcaccccgtcgccgggcaagatcgtcggttaccataccccgggaggtctgggtgtgcggatcgattctttcgtctatgatcagtattccgtggtcccccactacgactcgctcatagcgaagctgatcgtccacgcagagaccagggaagacgccatccgccgcatggcccgcgcccttgacgagtacatcattgagggcatcaagaccacaatccccttccataagaggatcatggacaacaaagactttatggaggggaatgtcgacaccggcttcctcgagcgaatcgtgctggagtag

SEQ ID NO: 5093 - protein, 446 aa, Geobacter sulfurreducens
MFHKVLIANRGEIALRVIRACKELGIKTVAVYSTADRDSLHVKLADESVCIGPAPSLQSYLNINAIISAAELTDAEAIHPGYGFLSENAAFAEICENCGITFIGPSSQSMRIMGDKISARQAVIKENVPILPGTKEGVNDVNEAVKIAKKIGFPVIIKATAGGGGRGMKIVHSPAALPNAFATARAEAQAGFGNPEVYIEKYCEKPRHVEIQVMADKHGNVIHLGERDCSIQRRHQKIIEESPCPVMTPALRKAMGDAAVRASKAVGYDSVGTVEFLVDKDLNFYFMEMNTRVQVEHPVTEMVTGIDIVREQIRSAAGLKLRYKQSDIKLHGHAIECRINAEDPVKFTPSPGKIVGYHTPGGLGVRIDSFVYDQYSVVPHYDSLIAKLIVHAETREDAIRRMARALDEYIIEGIKTTIPFHKRIMDNKDFMEGNVDTGFLERIVLE

SEQ ID NO: 5094 - DNA, 3447 bp, Geobacter sulfurreducens
  CDS (1)..(3447)
atggaaaagagaaagttcagaaaagtaatggccgccaaccgcggagagatcgcgatccgcatcttccgggcctgcactgagctggggatcagcacggtggccatctactcggaggaggacaagctgtccctccaccgctacaaggcggacgaggcctacctggtgggcaaggggaaagcccccatcgatgcctacctggggatcgacgaaatcatctccattgccaagcgggcggacgtggacgccattcacccgggctacggcttcctttcggagaatgccgagttcgccgaggcgtgcgagcgggccggcatcgccttcatcggtccccgggccgagatgcagcgggccctgggcgacaaggtctcggcccgcaaggtggccattgccgccgaggtgcccgtggttcccggaaccgaggagcccatcgagcacgaggaagaagcgctcatcttcgccaagcagcacggctatcccatcatcatcaaggcggctgccggcggcggcgggcggggcatgcgggttgcccgcaacaagaaagagctgctggaggggctggtggcggcccgcagcgaggccaaggccgccttcggcaacccggcggtcttcctggagcgctacctggagaatcccaagcacatcgaggtgcaggtgctgggggaccaccacggcaacctggtccacttctacgagcgcgactgctccatccagcgccgtcaccagaaggtggttgagttcgcgccgtcgctctccctgacccagaagctgcgggacgagatctgcaacgcggccctcaagatcgcgggtcaggtgggctacgtgaacgccggcaccgtggaattcctgctggaccaggaggggagctggtacttcatcgagatgaacccccgaatccaggtggagcacacggtcaccgagatgatcaccggcaggaacctggtgcaggcccagatcctcatcgccgaggggaagaagctctcggacccccccatcaacgtcccgaaccagtcggccatcgccatgcggggctacgccatccagtgccggatcaccaccgaggacccggccaacaactttgccccggatttcggcaccatcaccacctaccgctcctcggccggcttcggggtgcggctcgacgcgggcaacgccttcaccggttcggtcatcaccccccattacgactcgcttctggtgaaggtcacctcgtgggggctcaccttcgacgaggcggcccacatcatgaaccgctccctccaggagttccgggtccggggcgtgaagaccaatatcccgttcctggagaacgtggtcacccacccggtcttcctggccggtacctgcgatacgtcattcatcgagaagcaccccgagcttctggccattagcgagaagaaagaccgggccaccaaggtgctcaatttcctgggcgacgtcatcgtgaacggctcccccggcgttgccaagcccctcaagtcggcggagatgatcgaggcccgggtgcccgaggttgactatacggttccccggcccgccggctcccgcgacctgttcatgaagctcggcgccgaggggctctccaagtggatcctggagcagaaaaagctcctgatcaccgacaccaccatgcgggatgcccaccagtcgctcctggcgacccgggtccgcacctatgacctgctaaagatcgccgagcccacctcgtacctgggtgccgggctcttctcgctggagtgctggggcggcgccaccttcgacgtctccatgcgcttcctgaaggaggatccctggcagcggctccacaagctctcggaggcgatccccaacatcctcttccagatgctcctgcggggctccaacgccgtgggctacaccaactatcccgacaacgtggtgcagcgcttcgtggaggaggccgccgccagcggcgtcgacatcttccgggtcttcgattccctcaactggacccgggggatgaccgtggccatggaggcggtgcgcaagaccggcaagatctgcgaggcggccatctgctacaccggcgacatcaccgatcccaagcgggacaagtatccgctggaatactacgtggccatggccaaggaactggagcagatgggcgcccacatcctggccatcaaggacatggcggggctgctcaagcccatggccgcccacaagctggtgaaggccctcaaggagaacatcggcatcccggtccacctccatacccacgatacctcctccaacggcaacgccacgctgctcatggcctgccaggccggggtcgacatcgtggacgcggccctctcctccatctccggcctcacggcccagccgaacctgaacgcgctcctggccgccctcaaggggaccgagtgggacccggccctggacgacgaggggctccagcacctggccaactactgggagacggtgcgggactactacacccccttcgaatcggggctcaagagcggcactgccgaggtctaccaccacgagatccccggcggccagtactccaactacaagccccaggtggccggtctcggcctgctggaccggtgggaggagtgcaaggagatgtacttcaaggtcaacaggctctttggcgacatcgtcaaggtgaccccctcctccaaggtggtgggcgacatggccatgttcctggtgaaaaacaacctggacgtggacgacgtcttcaccaagggggacgagctcagcttccccgagtcggtagtggggatgttcaaggggatgctgggccagccctaccaggggtggcccgctgagctgcagaagatcatcctcaagggagaagagccgatcacctgccgccccggcgagctcctggagccggccgacttcgaagagaagcgcctggaggccgagaccaaggtggggcacgcggtgaacgacaaggatctcatgtcgtacctgctctaccctcatgtctaccccgagttcgacaagcaccgtcaggagtattcggacacctcggtcatcccgacccccatcttcttctacggcctggagccggggcaggagacctccatcgacatcgagccgggcaagaccctcatcatcaagctcaacgccgtcggcaaggtgcatccggacggtacccgccacatcttcttcgagcttaacggccaacagcggcaggtggtggtgcgcgaccaatcggtgcagaccgacgaggccgagcgggaaaaggccgacaaggggaacgccaagcatatcggcgcgcccatgcccggcaaggtcctgaagctcaatgtgaaggcgggcgacgtcgtgaaggcgggagacgtcctcatggttaccgaggccatgaagatggagaccaacatcaaggcgaaagaagacggcgccgttgccgaggtgaagttcaaggaaggcgacaaggtggaaaaagaagatctggtgatcgtgatggcatag

SEQ ID NO: 5095 - protein, 1148 aa, Geobacter sulfurreducens
MEKRKFRKVMAANRGEIAIRIFRACTELGISTVAIYSEEDKLSLHRYKADEAYLVGKGKAPIDAYLGIDEIISIAKRADVDAIHPGYGFLSENAEFAEACERAGIAFIGPRAEMQRALGDKVSARKVAIAAEVPVVPGTEEPIEHEEEALIFAKQHGYPIIIKAAAGGGGRGMRVARNKKELLEGLVAARSEAKAAFGNPAVFLERYLENPKHIEVQVLGDHHGNLVHFYERDCSIQRRHQKVVEFAPSLSLTQKLRDEICNAALKIAGQVGYVNAGTVEFLLDQEGSWYFIEMNPRIQVEHTVTEMITGRNLVQAQILIAEGKKLSDPPINVPNQSAIAMRGYAIQCRITTEDPANNFAPDFGTITTYRSSAGFGVRLDAGNAFTGSVITPHYDSLLVKVTSWGLTFDEAAHIMNRSLQEFRVRGVKTNIPFLENVVTHPVFLAGTCDTSFIEKHPELLAISEKKDRATKVLNFLGDVIVNGSPGVAKPLKSAEMIEARVPEVDYTVPRPAGSRDLFMKLGAEGLSKWILEQKKLLITDTTMRDAHQSLLATRVRTYDLLKIAEPTSYLGAGLFSLECWGGATFDVSMRFLKEDPWQRLHKLSEAIPNILFQMLLRGSNAVGYTNYPDNVVQRFVEEAAASGVDIFRVFDSLNWTRGMTVAMEAVRKTGKICEAAICYTGDITDPKRDKYPLEYYVAMAKELEQMGAHILAIKDMAGLLKPMAAHKLVKALKENIGIPVHLHTHDTSSNGNATLLMACQAGVDIVDAALSSISGLTAQPNLNALLAALKGTEWDPALDDEGLQHLANYWETVRDYYTPFESGLKSGTAEVYHHEIPGGQYSNYKPQVAGLGLLDRWEECKEMYFKVNRLFGDIVKVTPSSKVVGDMAMFLVKNNLDVDDVFTKGDELSFPESVVGMFKGMLGQPYQGWPAELQKIILKGEEPITCRPGELLEPADFEEKRLEAETKVGHAVNDKDLMSYLLYPHVYPEFDKHRQEYSDTSVIPTPIFFYGLEPGQETSIDIEPGKTLIIKLNAVGKVHPDGTRHIFFELNGQQRQVVVRDQSVQTDEAEREKADKGNAKHIGAPMPGKVLKLNVKAGDVVKAGDVLMVTEAMKMETNIKAKEDGAVAEVKFKEGDKVEKEDLVIVMA

SEQ ID NO: 5096 - DNA, 7496 bp, Homo sapiens
  CDS (120)..(7496)
cagctagcaggcttagattcaggccctcagcaaacaaggaacctggaaaatgtaaccctgaatgcacggtggggaggacatggcaagagaaaagcggcaggaataaagtgattttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggattgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctctgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaaccagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgacgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggtgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgtcgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctga

SEQ ID NO: 5097 - protein, 2458 aa, Homo sapiens [sequence omitted]

SEQ ID NO: 5098 - DNA, 2172 bp, Emericella nidulans
  CDS (1)..(2172)
atgccgctctcatctcttctccgcacttccgcccgcctggggcagacggttgttgctcgacgctcacgacgaactgcttccacagtaacctccaattcctcgagtaactttcgcgcattagactcgattttaattgccaacaggggagaaatcgctctacgagttggtaggactgcggcccagcatggaattcgagtcactacgctctatacggatccagattcccaagcgcagcatgctttgagtacaccatatgcattcaatctcggctccgtgtccgcgtacctcgatggagaccgtatcattgaaatcgcaaaggcccaaggatgccagggaatacaccccggctacggcttccttagtgagaactcagagttcgcacgaaaatgtacagaagcagggctggtctttattggaccgccgtggaaagctatcgaggatatgggagataagaggtgctctaagcatatcatgactgccgctggagtgccctgtgtccccagctaccacggtgaaaaccaagaccctaatttcctcgaagcggaggccgataaaatcaaatacccagtgctcatcaaagcaatcaagggcggtgggggcaaaggaatgagaatcgctcgttcaaaggaagagtttcaagcgcagcttcagtcggcgaagtcggaggctatgaactcttttggggatgaccatgtcctagtcgagaaatatatcacaacaccgcgacacattgaggtccaagtctttgctgacaaacacggaaattgtgtagcgctgggagagcgagattgcagcatccaacggcgacaccaaaaaatcctggaagagtcaccggctcctcacctgcctgatgccacaagaaaagacatatgggcaaaggctcggtcggccgcgttagccgttcgctacgagggcgccggtacagttgagtttatcttcgacaacgacacgggagagttcttcttcatggaaatgaatactagacttcaggtggagcatcccgtaaccgagatggtcactgggcaagatttggtgcattggcagctgaaggtcgcggagggcgccgagcttccattaacgcaggaagaagtggaagccaatatagctacccatggtcatgcgatcgaagcgagaatctacgctgagaaccctgcgcagggcttcattccagattccggtgctcttctccatgtccgcactcccgccaccaccgaggacgttcgaatcgacgccggatttgtgcaaggtgacgaggtttcggcgcactatgatcccatgattgcgaaactaatcgttcggggcgccgaccgacaagaagctattcgcaagcttgcttgcagcattggaagagtcgaggtggccggcccagcgacgaatatcgagttcttgaaatcagtttgcaaaagtgccgacttcatctctggcaaagtcgaaacgggttacattgagaagcatcacgacgagctattcgcccaatcgccaattgagccggaagtgctggcacaagtagcactggcttgcttgcatgacgacgctcgtctcgccgcgcaaaaagcaaccaattttcaaggctccgcagtgggatttgggccaggcttccaacaacaccacatgaccttcacgaactcagcatcagcaaacaacgaggcctttgacgtcaaagttcaacaaaccggagagaacgtgttcaatgtaaagattggcgagcacactttcgagcaggtgaccagccaccctaatgcggacttccgcatcatcacctcgttcttcccgcacacccgtttggacaccactgtcatccgcgacggcgattcaatcgtcgtatttcagcgcggcaggcaataccgccttactacaccacgggcgaaatggatggaaaaagcactcggcatgaaagacgtcacaaatagtgtactcgccccaatgccctgcaaagtcctccgtgtcgaggtccaagccggcgatactgtagaaaaggaccagccacttgtggtgattgagagcatgaaaatggaaacagtcatccgcagcccacaaagagggaaattgccaaagtcgtccatcaaaaaggagaccaatgcaaaagcgggacaccgcttgtggagtttgctggtgaagacgaagaggcgtcgaaatagatatggaaggattgaagctatgctgcaccaatag

SEQ ID NO: 5099 - protein, 723 aa, Emericella nidulans
MPLSSLLRTSARLGQTVVARRSRRTASTVTSNSSSNFRALDSILIANRGEIALRVGRTAAQHGIRVTTLYTDPDSQAQHALSTPYAFNLGSVSAYLDGDRIIEIAKAQGCQGIHPGYGFLSENSEFARKCTEAGLVFIGPPWKAIEDMGDKRCSKHIMTAAGVPCVPSYHGENQDPNFLEAEADKIKYPVLIKAIKGGGGKGMRIARSKEEFQAQLQSAKSEAMNSFGDDHVLVEKYITTPRHIEVQVFADKHGNCVALGERDCSIQRRHQKILEESPAPHLPDATRKDIWAKARSAALAVRYEGAGTVEFIFDNDTGEFFFMEMNTRLQVEHPVTEMVTGQDLVHWQLKVAEGAELPLTQEEVEANIATHGHAIEARIYAENPAQGFIPDSGALLHVRTPATTEDVRIDAGFVQGDEVSAHYDPMIAKLIVRGADRQEAIRKLACSIGRVEVAGPATNIEFLKSVCKSADFISGKVETGYIEKHHDELFAQSPIEPEVLAQVALACLHDDARLAAQKATNFQGSAVGFGPGFQQHHMTFTNSASANNEAFDVKVQQTGENVFNVKIGEHTFEQVTSHPNADFRIITSFFPHTRLDTTVIRDGDSIVVFQRGRQYRLTTPRAKWMEKALGMKDVTNSVLAPMPCKVLRVEVQAGDTVEKDQPLVVIESMKMETVIRSPQRGKLPKSSIKKETNAKAGHRLWSLLVKTKRRRNRYGRIEAMLHQ

SEQ ID NO: 5100 - DNA, 3384 bp, Mycobacterium paratuberculosis
  CDS (1)..(3384)
atgttagcgaaagtcctggtcgccaaccgcggggagatcgcgatccgcgcgttccgcgcggcctacgagctggaaatggccaccgtggcggtgtatccctacgaggaccgcaattcggtgcaccggttgaaggccgacgagtcctaccagatcggtgaggaaggtcacccggtccgcgcctacctgtccgtcgacgagatcgtcgacacggcgctggcctgcggcgcggatgcgatctaccccggctacggcttcctgtcggagaaccccgatctggcggcggcgtgcgcggcggccggcatcacgttcgtcggccccagcgccgaggtgctcgagctcaccggcgacaagtcgcgggccatcgcggcggcgcgggccgcgggtcttccggtgctggcctcctcgccgccgtcgacctccgtgcaggagctgctgagcgccgccgagacgatgacgttcccgctgttcgtcaaggcggtcgccggcggcggcggccgcgggatgcgccgagtcaccgatccgggggcgctggccgaggcgatcgaggcggccagccgtgaggccgagtccgcgttcggggacgcctcggtgtttctcgaacaggcggtgatcaatccgcggcacatcgaggtccagatcctggccgacacgcacggcaacgtgatgcacctctacgagcgggactgcagcgtgcagcgccggcaccagaaggtgatcgagatcgccccggcgcccaacctggatccggcgctgcgcgaacgtatctgcgccgacgcggtggcgttcgcacgcagcatcggctacacctgcgcgggcacggtggagttcctgctcgacgaacgcggcaaccacgtgttcatcgagatgaacccgcgcatccaggtggagcacacggtgaccgaggagatcaccgacgtcgacctggtgtccgcgcagctgcgcatcgcctccggccagacgctggaagagattggcctgagccaggattcggtcatcccgcgcggcgcggccctgcagtgccggatcaccaccgaggaccccgccaacggtttccgcccggacaccggccgcatcaccgcctaccgcaccccgggcggcgcgggcatccggctggacggcggcaccacgctgggcgccgagatcagcgcgcacttcgattcgatgctgatcaagctgacctgccggggacgcgacttccccacggcggtgcgacgggcgcggcgcgcggtcgccgaattccgcatccgcggcgtatcgacgaatatcccgttcctgcaagcggttatggacgacctggattttcaggccgggcgcatcaccacctcgttcatcgaacaacggccgcagttgctcaccgcgcgcagttcggccgaccgcggcaccaagatcctcaactacctggccgacgtgaccgtcaacaagccgcacggcgagcgcccgtcggcggtgtacccgcatgacaagctgcccgacatcgacctggcggcgagcccgccggcgggctccaagcagcggttgaccgaactcggtccggagcgattcgcggcctggctgcgcgagtcgggcggcgtcggcgtcaccgacaccacgttccgcgacgcgcaccagtcgctgctggcgacccgggtccgcaccagcgggctgctcaaggtggcgccctacatcgcacggaccatgccgcagctgttgtcggtggagtgttggggcggggcgacttacgacgtggcgctgcggtttctcaaggaggacccgtgggagcggctggcggcgctgcgcgaggcgatgccgaacatctgccttcagatgctgctgcgtgggcgtaacaccgtggggtacacgccctatccggagacggtcacgacggccttcgtcgcggaggcgaccgacaccggcatcgacatcttccgcatcttcgacgcgttgaacaacgtcgactcgatgcgcccggccatcgccgcggtccgcgaaaccggaagcgccatagccgaagtggcgatgtcctacaccggcgacctgtccgatccggccgaaaagctgtacacgctggactattacctgaagctggccgaccagatcgtcgaagcgggcgcacacgtgctggcgatcaaggacatggccgggctgctgcgcgcaccggcggccgcgacgctggtgtcggcgctgaagtcgcggttcgacctgccggtgcacgtgcacacccatgacacgccgggcggacagctggcgacctacgtggcggcctggcaggccggggccgacgcggtcgacggcgccgccgcgccgctcgccggaaccaccagccagccggcactgtcgtcgatcgtggccgccgcggccaacacggagtatgacaccgggttgtccctgccggcggtgtgcgatctggagccgtactgggaggcgctgcgaaaggtatacgctcccttcgaatccgggcttccggcgccgaccgggcgggtgtatcaccacgagatcccgggcggccaattgtcgaatctgcgtcagcaggcgattgcgctgggactcggcgaccggttcgaggacatcgaaaacgcctacgccggcgccgacgcgattttgggacacctggtcaaggtcaccccgtccagcaaggtggtgggcgacctggcgctggccctggtgggtgcgggtgtgggcgcgcaggacttcgccgaagacccctcccgctacgacatcccggattcggtgatcggctttctgcgcggcgagctcggtgacccgccgggcggctggccggagccgttgcgcaccaaggccttacagggtcggggaccggccaagccggagcagccgctgacggccgaggacaaagcggcgttggccgccccgggtgcgcgacggcaggcggcgctgaaccggctgctgttcccgggaccgaccaaggagctcgaggagcaccgcgagcagtatggtgacacctcggggctgagcgccaaccagttcttctacggattgcggcagggcgacgaacaccgcgtcgaactcgagcgcggcgtggagttgctgatcggcctggaggccatctccgatcccgacgaacgcggcatgcgcactgtgatgtgcattctcaacgggcagctgcggccggtggtggtgcgcgaccgcagcatcgccatcgacgtgcccgccgcggagaaggccgaccgcgccaacccggaccacatcgccgccccgttcgccggggtggtgacggtcgccgccgaggtcggccggcaggtcgaggccggccagaccatcgcgacgatcgaggcgatgaagatggaagccgcggtcaccagcccgaagtcgggcaaggtggcgcgcatcgccgtgtcgcggaccgctcaagtcgagggcggcgacctcctgatggtgatcgactag

SEQ ID NO: 5101 - protein, 1127 aa, Mycobacterium paratuberculosis
MLAKVLVANRGEIAIRAFRAAYELEMATVAVYPYEDRNSVHRLKADESYQIGEEGHPVRAYLSVDEIVDTALACGADAIYPGYGFLSENPDLAAACAAAGITFVGPSAEVLELTGDKSRAIAAARAAGLPVLASSPPSTSVQELLSAAETMTFPLFVKAVAGGGGRGMRRVTDPGALAEAIEAASREAESAFGDASVFLEQAVINPRHIEVQILADTHGNVMHLYERDCSVQRRHQKVIEIAPAPNLDPALRERICADAVAFARSIGYTCAGTVEFLLDERGNHVFIEMNPRIQVEHTVTEEITDVDLVSAQLRIASGQTLEEIGLSQDSVIPRGAALQCRITTEDPANGFRPDTGRITAYRTPGGAGIRLDGGTTLGAEISAHFDSMLIKLTCRGRDFPTAVRRARRAVAEFRIRGVSTNIPFLQAVMDDLDFQAGRITTSFIEQRPQLLTARSSADRGTKILNYLADVTVNKPHGERPSAVYPHDKLPDIDLAASPPAGSKQRLTELGPERFAAWLRESGGVGVTDTTFRDAHQSLLATRVRTSGLLKVAPYIARTMPQLLSVECWGGATYDVALRFLKEDPWERLAALREAMPNICLQMLLRGRNTVGYTPYPETVTTAFVAEATDTGIDIFRIFDALNNVDSMRPAIAAVRETGSAIAEVAMSYTGDLSDPAEKLYTLDYYLKLADQIVEAGAHVLAIKDMAGLLRAPAAATLVSALKSRFDLPVHVHTHDTPGGQLATYVAAWQAGADAVDGAAAPLAGTTSQPALSSIVAAAANTEYDTGLSLPAVCDLEPYWEALRKVYAPFESGLPAPTGRVYHHEIPGGQLSNLRQQAIALGLGDRFEDIENAYAGADAILGHLVKVTPSSKVVGDLALALVGAGVGAQDFAEDPSRYDIPDSVIGFLRGELGDPPGGWPEPLRTKALQGRGPAKPEQPLTAEDKAALAAPGARRQAALNRLLFPGPTKELEEHREQYGDTSGLSANQFFYGLRQGDEHRVELERGVELLIGLEAISDPDERGMRTVMCILNGQLRPVVVRDRSIAIDVPAAEKADRANPDHIAAPFAGVVTVAAEVGRQVEAGQTIATIEAMKMEAAVTSPKSGKVARIAVSRTAQVEGGDLLMVID

SEQ ID NO: 5102 - DNA, 1992 bp, Mycobacterium paratuberculosis
  CDS (1)..(1992)
atgggaatcacgcgagtactggttgccaaccgcggcgaaatcgcccgacgggtgttcgctacctgccgacggctgggggtgagcaccgtcgccgtctacaccgaccccgacgccggcgcgccgcatgtcgccgaagccgacgcccgggtgcggttgccgaacaccaccgactacctcaacatcgaggccatcatcggcgccgcccgcgcggccggcgccgacgcgctacatcccggatatggattcctctccgagaacgccgatttcgcgaccgctgtcgccgacgccggactgacttgggtcggtccgccggtggatgcggtgcgcgcgatgggctccaagatcgagtcgaaaaagctgatggccgccgccggagtgccggtgctcgacgagctcgaccccgacaccgtcaccgaggcccaactgccggtgctggtcaaggcgtccgcgggcggtggcggccgtggcatgcgggtggtgcacgaattgtccgccctgcgtggcgaagtggaggccgcgcgccgggaggcgcagtccgcgttcggtgatccgacggtgttctgcgaacgctatctgcccaccggtcaccacgtcgaggttcaggtgctggccgacgcccacggcacggtgtgggcggtcggcgaacgcgaatgttcgattcagcgccgtcaccagaagatcatcgaggaggccccctcaccgctggtggagcgcacaccggggatgcgcgccaagctgttcgaggcggcccggctggccgccggcgccatcggctacaccggggccgggacggtcgagttcctcgccgatgacgacggagagttctacttcttggagatgaacacccggctgcaggtcgaacacccggtcaccgaggagaccaccgggctggacctggtcgagctgcagctcgcggtcgccgacggcgcccgcctggatgcggaaccccctgctgcccagggttattcgatcgaggcccggctgtacgccgaggacccggcccgcggttggcagccgcaggccggcgtggtgcacgcgttcgcggtgccctcggtccgggccgagttcggctcactggggcggcggatcggcatccggctggacgcgggtatcaccgacggattcgcggtgtcgatccactacgacccgatgctggccaaggtcatctcctacgcgccaacccgccgtcaggcggcgctggtgctggccgacgcgctcacccgcacccgggtgcacggcgtgcgcaccaaccgcgatctgctggtgaacgtgctgcggcatccggcgttcctcgacggcgccaccgacacagcgtttttcgacacccacggcctggccgagctggcggcgccgctgggcgacgcggcggcggtgcgcctgtcggcggtcgcggccgctctcgccgacgccgcgcgcaaccgggctcacgccccggtgctgggcgccgtccccagcggctggcggaacctgccgtcgggctttcagctcaaggactaccgcgacgacgagggccacgagcatcgggtccaataccgtttcaccagaaccggtttggttctgcccgacgacccgtcggtgcagctggtgtcggccacggccgacgacgtggtgctgcgcaccgacggtgtcgagcacaacttctcggtgcgccgctaccacggcgccgacgccgacgtgtatgtcgattcggcgcgcgggccggtgcacctgaccgtgctgccgcgcttccccgagcccggttcgaccgtcgaaaagggctcgctggtggcgcccatgcccggcaacgtcatccggctcggtgccgcgatcggggacaccgtcaccgccggtcagtccctgatctggctggaagccatgaagatggagcacaccatcgccgacccagtcgacggggtgctcgccgagctcaatgtcaaaaccggtcagcaagtcgaagtcggcgctgtgctggcaagagtggaagcgccgcaatcagaaggagatgcacagtga

SEQ ID NO: 5103 - protein, 663 aa, Mycobacterium paratuberculosis
MGITRVLVANRGEIARRVFATCRRLGVSTVAVYTDPDAGAPHVAEADARVRLPNTTDYLNIEAIIGAARAAGADALHPGYGFLSENADFATAVADAGLTWVGPPVDAVRAMGSKIESKKLMAAAGVPVLDELDPDTVTEAQLPVLVKASAGGGGRGMRVVHELSALRGEVEAARREAQSAFGDPTVFCERYLPTGHHVEVQVLADAHGTVWAVGERECSIQRRHQKIIEEAPSPLVERTPGMRAKLFEAARLAAGAIGYTGAGTVEFLADDDGEFYFLEMNTRLQVEHPVTEETTGLDLVELQLAVADGARLDAEPPAAQGYSIEARLYAEDPARGWQPQAGVVHAFAVPSVRAEFGSLGRRIGIRLDAGITDGFAVSIHYDPMLAKVISYAPTRRQAALVLADALTRTRVHGVRTNRDLLVNVLRHPAFLDGATDTAFFDTHGLAELAAPLGDAAAVRLSAVAAALADAARNRAHAPVLGAVPSGWRNLPSGFQLKDYRDDEGHEHRVQYRFTRTGLVLPDDPSVQLVSATADDVVLRTDGVEHNFSVRRYHGADADVYVDSARGPVHLTVLPRFPEPGSTVEKGSLVAPMPGNVIRLGAAIGDTVTAGQSLIWLEAMKMEHTIADPVDGVLAELNVKTGQQVEVGAVLARVEAPQSEGDAQ

SEQ ID NO: 5104 - DNA, 2016 bp, Mycobacterium paratuberculosis
  CDS (1)..(2016)
atgttcgaaacggtattggtggccaaccgcggcgagatcgcggtgcgggtgatccgcaccctgcaccggctgggcatccggtcggtcgccgtctacagcgatcccgacgccactgcgcggcatgtgctcgaggccgacgaagcggtgcggctggggccggccgcggcgcgggacagctacctgaacatcgacaaggtcgtcgaggcggcgacgcgcaccggggcgcaggcgatccatcccgggtacggattcctctccgagaacgccgatttcgctgcggcatgcgaacgggccggggtggtgttcctcggcccgccggcacgggcgatccaggtgatgggcgacaagatcaccgccaagaacgccgtcgccgaattcgacgtcccggtggtgcccggggtggccaaactggggctgggcgacgacgaattggtggccgccgccgacgagatcggctacccggtgctgatcaagccgtcggcgggcggcggcggcaagggcatgcgcctggtggaagaaccgggcaggctgcgcgaggcgctggtgggcgcgcggcgcgaggccgcctcgtcgttcggcgacgacacgctgtttctggaacggtttatgttgcgccccaggcacatcgaggtgcagatcctggccgacgcgcacggcaacgtcgtgcatctcggcgaacgcgagtgcagcctgcagcggcgccatcaaaaggtcatcgaggaggcgccgtcgccgctgctcgacccggagacgcgggcgcggatcggggcggccgcctgcaataccgcccgcagcgtcgactacgtcggcgccggcacggtggagttcatcgtctccgccgatcggcccgacgagttcttcttcatggagatgaacacccggctgcaggtcgagcatccggtcaccgaggcggtgaccgggctggacctggtggaatggcagctgcgggtggccgccggcgagaagctggtgttcgcccaggacgacatcgaactgcgtgggcacgcgatcgaggcccgggtgtacgccgaggatccggcgcggggcttcctgcccaccggcggccgggtgctcggcgtcttcgagccgtccggtgacggcgtgcgggtcgactcgtcgctgctgcccggcaccgtggtgggcagcgactacgacccgatgctgagcaaggtgatcgcccacggggccgaccgcgacgaggcgctggccagactcgaccgggcgttgagccacaccgcgatcctgggcgtccagaccaacgtcgagttcctgcgcttcctgctggccgacgaacgggtacgcgccggcgatctggacaccgcgctgctcgatgcgcggctggccgacttcgcgccgctgcccgcacccgacgacgtgctcgccgcggccgggctgtaccggcaatcggcgctggccgcccgggcccgccgcttcgccggcaacccctgggcggcgccgacggggtggcgggccggcggtagcccggcgccggtccgcaccgacatgcgcaccgcgctgcgcaccgagacggtgtcggtgtgggggccacccgaggccgccgaagtacaggtcggtgccggcgaaaggctttcggccagcgcgcatctcgggccggaccggatcagtgtgacgctggacggccggcgccgcgactaccgctgggccgaggccgaccggcacctgtggatcgccgacgagcgcggaacctggcacctgcgcgaggccgaacagaccaccattcaccgcgccgccggcccgcagcgggccgagatcctcagcccgatgccgggcagcgtgatcgccgtccaaaccccttcgggcagcgacgtttccgaaggcgacgtggtggtcgtcgtggaggcgatgaagatggagcactcgctggccgcgccggtttccggacgggtggaggtgctggtctgcgtcggcgaccaggtgagcgtggaccaggtgctggcccgggtggtgcccgaggaatccgacccgccggccgattcgagtaaggacgagacatga

SEQ ID NO: 5105 - protein, 671 aa, Mycobacterium paratuberculosis
MFETVLVANRGEIAVRVIRTLHRLGIRSVAVYSDPDATARHVLEADEAVRLGPAAARDSYLNIDKVVEAATRTGAQAIHPGYGFLSENADFAAACERAGVVFLGPPARAIQVMGDKITAKNAVAEFDVPVVPGVAKLGLGDDELVAAADEIGYPVLIKPSAGGGGKGMRLVEEPGRLREALVGARREAASSFGDDTLFLERFMLRPRHIEVQILADAHGNVVHLGERECSLQRRHQKVIEEAPSPLLDPETRARIGAAACNTARSVDYVGAGTVEFIVSADRPDEFFFMEMNTRLQVEHPVTEAVTGLDLVEWQLRVAAGEKLVFAQDDIELRGHAIEARVYAEDPARGFLPTGGRVLGVFEPSGDGVRVDSSLLPGTVVGSDYDPMLSKVIAHGADRDEALARLDRALSHTAILGVQTNVEFLRFLLADERVRAGDLDTALLDARLADFAPLPAPDDVLAAAGLYRQSALAARARRFAGNPWAAPTGWRAGGSPAPVRTDMRTALRTETVSVWGPPEAAEVQVGAGERLSASAHLGPDRISVTLDGRRRDYRWAEADRHLWIADERGTWHLREAEQTTIHRAAGPQRAEILSPMPGSVIAVQTPSGSDVSEGDVVVVVEAMKMEHSLAAPVSGRVEVLVCVGDQVSVDQVLARVVPEESDPPADSSKDET

SEQ ID NO: 5106 - DNA, 3228 bp, Mycobacterium paratuberculosis
  CDS (1)..(3228)
atgaccgcgagcctgctggtcgccaaccgcggcgagatcgcacttcgaatcatccgcaccgcaacagaactgggtatgcgaaccgtcgccgtgtacgccgcggacgacgcgcacagcccgcacgtgcacgccgccgacgaggcgatgccgctgcccggcagcggcccgcccgcctacctgaaccaggctgccctgctggccgtggccgagaacaccggcgcaacgctgattcatccgggctacggattcctttccgagaacgccgaattcgccaaggcctgcgccgccgccagtcacaccttcgtgggccccgacgggcgcgtgctcgagctgctgggcaacaagacggcggcccgccgcgccgcgatcgccgccggggtgccgacgctggccgccaccgacggcccgagcggcgtcgaggacatcgaggcgttcttcgccgcgcaccccggcggcatcatgatcaaggcgctggccggcggcggcgggcggggaatgcgcaaggtgcacaacgccgctcaaatcgccggcgcctaccaacgctgcgccgcggaggcgcggctggggttcggcgacccggcgctgttcgccgaggcgctgctcggcgacgcccgccacatcgaggtgcaggtggtcgccgcgccggccgggcaccaaacgcacgccctggcggtgggcgaccgcgactgcagcatgcagcggcgctaccagaagctgatcgaaatcgcgcccgcccaagggctttcggaggagctgcgccgcgcgctgcaccaggcggccgtgcggttgtgcgcccgcgtcgggctgcgcgggctggccaccgtggagttcctggtcagcggcgagcgtttcgtcttcctggaggtcaacccgcgaatccaggtggagcacaccgtcaccgaacagaccaccgggctcgacctggtcgccgtgcagctggcgatcgccggcggcgagtcctactaccggctgggcctgccggccggaatcgcctcggacggcaccgaagtcatcggcgagccggccgcccagcggggcatcgcgatccagctgcgggtcaacgcggagacgttcggcgccgacttctccgtgctgccgtccgccggcacgctcaccgcgttctgcccgcccagcggaccgggagtgcgggtcgacacctacggccggcccggactggtggtgagcccgcagtacgactcgctgctggccaaggtgatcgtcgcggtgcacggatcctcgtggcgggcggcgatgcgcaaggccgacaccgccctgtccgaattcggcgtcgagggcgtggccaccaacatcgggttcctgcgccggctgctggccgaacagcgactcgaaaccggctgggtgaacaccgatttcgtggacgagaagcttcccgagttggccgccgccgcgctgacccatcagcccggcccgcagccgggcgccgtcgagctgtatcccggcgaggacgcgctgcgggcgcagctggccggcaccgtggtcgaggtggcgcccgagggcgcggactaccccgcgggcgcccagctggtcgtcctggaagcgatgaagatgcagcacgtcctcgccgcgccggacgcgctgcgcaccgtccgggtgctggtgacccccggccaggtcgtcgggaccggcgatccgctgctggtcttcacccgcaccacgggcggtgacgacggtgaatccgaaacggcggcaaccgatctcgacctaacccgcgccgacctggacgaggtgattgagcggcacgcccggaccctggacgaggggcgcccggacgccgtcgccaaacggcaccggcagggcaggcgcaccgcccgggagaacatcgacgacctcgtcgaccccggcagcttcgtcgaatacggcgccctggccatcgccgcgcagcgcagccggcgctccgaggaggacctgatcgccaacaccccggccgacggtctggtcgccggcctggccaccgtcggcgccgaccggttcggcccggccgccgcgcaggccgtcgtggcctcctacgactacaccgtgctggcgggcacccagggcatgcgcaaccacgccaagaccgaccgcgtcttcgacctggccgcccggaaacggctgccggtggtgcttttcgccgagggcggcggcggacggcccggcgacaccgacgtcggcggcgccgcggggctggacgtgccgaccttccggatgctggccgggctgcgcgggcgggtgccgctggtgtcggtcgtctcgggccggtgcttcgccggcaacgccgcgctggccggggtgtgcgacgtcatcatcgcgaccccggacgccaacatcgggatgggcgggccggcgatgatcgaaggtggcgggctgggcgtctacccgcccgaggcgatcgggccgatcgccgtgcagcgccgcaacggggtggtcggcctggtcgcccgcgacgaggcgcacgcggtgtcgctggccaagcaatacctctcctactttcagggccgcctggaccggtggcaggcgcccgacccgcgggtggcccgacatgtggtgccgcagaaccgattacgcgcctacgatgtgcaccgcgccatcgaggcgatcgtcgatgtcgggtcggtgctggagctgcgccccgactacggggtgggcatcgtcaccgcgctggtgcgcgtcgagggcgtgccctacgggctgatcgccaacagcacccatcacctcggcggcgccatcgacgccgaggccgccgacaaggccggcgacttcctggcgttgtgcgaatcctttgggctgccggtgatctcgctgtgcgacacccccggcttcatggtggggcccgacgccgagacccaggccgcggtgcgccggttcggccggatgttcgtgctgggcgcgcggctgacggtgccgctgggaatgatcatcctgcgcaagggatacgggctcggcgcgatggccatggccggcggttcgttccgcgcaccgcaattcaccgtcgcctggccgacgggcgagatcggcggcatgggcctggagagcgcggtgcggctcggctaccgcaaggagctggccgccgtcaccgatccggccgaacggcaaaacctcttcgaccgcctggtggcggccgcctaccagcacggcaaggcgctgcgggcggcgaccaccttcgagctggacgacgtcatagacccagcagcctcccgggcctggatcaccaggctctcgggaggctga

SEQ ID NO: 5107 - protein, 1075 aa, Mycobacterium paratuberculosis
MTASLLVANRGEIALRIIRTATELGMRTVAVYAADDAHSPHVHAADEAMPLPGSGPPAYLNQAALLAVAENTGATLIHPGYGFLSENAEFAKACAAASHTFVGPDGRVLELLGNKTAARRAAIAAGVPTLAATDGPSGVEDIEAFFAAHPGGIMIKALAGGGGRGMRKVHNAAQIAGAYQRCAAEARLGFGDPALFAEALLGDARHIEVQVVAAPAGHQTHALAVGDRDCSMQRRYQKLIEIAPAQGLSEELRRALHQAAVRLCARVGLRGLATVEFLVSGERFVFLEVNPRIQVEHTVTEQTTGLDLVAVQLAIAGGESYYRLGLPAGIASDGTEVIGEPAAQRGIAIQLRVNAETFGADFSVLPSAGTLTAFCPPSGPGVRVDTYGRPGLVVSPQYDSLLAKVIVAVHGSSWRAAMRKADTALSEFGVEGVATNIGFLRRLLAEQRLETGWVNTDFVDEKLPELAAAALTHQPGPQPGAVELYPGEDALRAQLAGTVVEVAPEGADYPAGAQLVVLEAMKMQHVLAAPDALRTVRVLVTPGQVVGTGDPLLVFTRTTGGDDGESETAATDLDLTRADLDEVIERHARTLDEGRPDAVAKRHRQGRRTARENIDDLVDPGSFVEYGALAIAAQRSRRSEEDLIANTPADGLVAGLATVGADRFGPAAAQAVVASYDYTVLAGTQGMRNHAKTDRVFDLAARKRLPVVLFAEGGGGRPGDTDVGGAAGLDVPTFRMLAGLRGRVPLVSVVSGRCFAGNAALAGVCDVIIATPDANIGMGGPAMIEGGGLGVYPPEAIGPIAVQRRNGVVGLVARDEAHAVSLAKQYLSYFQGRLDRWQAPDPRVARHVVPQNRLRAYDVHRAIEAIVDVGSVLELRPDYGVGIVTALVRVEGVPYGLIANSTHHLGGAIDAEAADKAGDFLALCESFGLPVISLCDTPGFMVGPDAETQAAVRRFGRMFVLGARLTVPLGMIILRKGYGLGAMAMAGGSFRAPQFTVAWPTGEIGGMGLESAVRLGYRKELAAVTDPAERQNLFDRLVAAAYQHGKALRAATTFELDDVIDPAASRAWITRLSGG

SEQ ID NO: 5108 - DNA, 1824 bp, Mycobacterium paratuberculosis
  CDS (1)..(1824)
atgccgatatgccaaacaggaggcgcagtggccagtcacgccagctcgaggatctccaaggtgctcgtcgccaaccgcggcgagatcgctgtccgggtgatccgcgcggcccgcgatgcgggcctgtccagcgtggcggtgtacgccgaaccggatgccgacgcgccgcacgtccggctggccgacgaggcgttcgctctgggtggtcagacgtcggccgagtcctacctggacttcggcaagctgctcgacgcggccgccaagtccggggccaacgccatccaccccggctacggcttcctgtccgagaacgccgacttcgcccaggccgtgatcgacgccgggctgatctggatcggccccagcccgcagtccatccgcgacctcggtgacaaggtcaccgcccgccacatcgccgcccgcgcgcaggcgccgctggtgcccggcacccccgacccggtcaaggacgccgacgaggtggtggccttcgccaaggagtacggcgtgccgatcgccatcaaggccgcgttcggcggcggcggcaagggcatgaaggtggcccgcaccatcgaggagatccccgagctctacgagtcggcggtgcgcgaggccgtcgcggcgttcggccgcggcgagtgcttcgtcgagcgctacctggacaagccgcgccacgtcgaggcccaggtgatcgccgaccagcacggcaacgtcgtcgtcgccggcacccgcgactgctcgctgcagcgccggttccagaagctggtcgaggaggcgccggcgccgttcctgtcggacgcgcagcgcaaggagatccacgagtcggccaagcggatctgcaaggaggcccactactacggcgccggcaccgtcgaatacctggtcggccaggacggcctgatctccttcctggaggtcaacacccgtctgcaggtcgagcacccggtcaccgaggagaccgccggcatcgacctggtgctgcagcagttcaagatcgccaacggcgacaagctggacatcaccgaggacccggagccgcgcgggcacgccatcgagttccggatcaacggcgaggacgcgggacgcaacttcctgcccgcgcccggcccggtcacccgctacgacattcccaccgggcccggggtgcggctggactccggcgtcgaggccggctcggtgatcggcgggcagttcgactcgatgctgtccaagctgatcgtgtacggcgccgaccggcagcaggcgctggcccgcgcccgccgcgccctggacgagttccacgtcgagggtctggccaccgtcatcccgttccaccgcgccgtggtgcgcgacccggccttcatcggtgacgacaacgggttcgcggtgcacacccgctggatcgagaccgagtggaacaacaccgtcgagccgttcaccggcggcgagcccctggacgacgaggacgcccgcccccgccagaaggcggtggtggaggtcggcggccgccggctcgaggtgtcgctgcccggggatctggccctgtccaacgggggctcggccgacccggccggcgtgatccgcaagaagcccaagccgcgcaagcggggcgggcacggcggcgcgacggcctccggcgacgcggtcaccgcacccatgcagggcaccgtggtcaaggtcgcggtcgaggagggccaggaggtctccgccggcgacctggtggtggtgctcgaggcgatgaagatggagaacccggtcaccgcgcacaaggacggcgtcatcaccggccttgcggtcgaggccggcgccgccatcacccagggcacggtgctcgccgagatcaagtag

SEQ ID NO: 5109 - protein, 607 aa, Mycobacterium paratuberculosis
MPICQTGGAVASHASSRISKVLVANRGEIAVRVIRAARDAGLSSVAVYAEPDADAPHVRLADEAFALGGQTSAESYLDFGKLLDAAAKSGANAIHPGYGFLSENADFAQAVIDAGLIWIGPSPQSIRDLGDKVTARHIAARAQAPLVPGTPDPVKDADEVVAFAKEYGVPIAIKAAFGGGGKGMKVARTIEEIPELYESAVREAVAAFGRGECFVERYLDKPRHVEAQVIADQHGNVVVAGTRDCSLQRRFQKLVEEAPAPFLSDAQRKEIHESAKRICKEAHYYGAGTVEYLVGQDGLISFLEVNTRLQVEHPVTEETAGIDLVLQQFKIANGDKLDITEDPEPRGHAIEFRINGEDAGRNFLPAPGPVTRYDIPTGPGVRLDSGVEAGSVIGGQFDSMLSKLIVYGADRQQALARARRALDEFHVEGLATVIPFHRAVVRDPAFIGDDNGFAVHTRWIETEWNNTVEPFTGGEPLDDEDARPRQKAVVEVGGRRLEVSLPGDLALSNGGSADPAGVIRKKPKPRKRGGHGGATASGDAVTAPMQGTVVKVAVEEGQEVSAGDLVVVLEAMKMENPVTAHKDGVITGLAVEAGAAITQGTVLAEIK

SEQ ID NO: 5110 - DNA, 1320 bp, Treponema denticola
  CDS (1)..(1320)
atgattaaaaaaatacttatcgccaacagaggcgagatagccgtgagggttatccgctcctgccgcgaaatgggaataaaaaccgtcgccgtttactctacggcggacaaggactgtcttcatgtgcttttagctgatgaagcagtctgcataggcccgcccccctcggctaaaagctatcttaacaaagaagctcttatcacggcagccctttgcacttcctgtgaggcagtgcatccgggggtaggctttttatcggaaaatgcaggtttcgcccgcgaggtagaaaatgcagggctcttttggatagggccaaaacccgacacaatcgaaatgctcggcgataaggtccgcgctcgcgaaacagccgtaaaaagcggacttcccgtgacacccggttcggatggagctataaaggagttggctgaagccaaaaaaacggccgaaaaatgcggctatcccgtaatcattaaagctgcctcaggcggcggcggaaaagggatgcgcatcgtttataaagaatcggaattagccgaaaacctaaaaatcgcttccgccgaagccgaagccaattttgccgacggcacggtttatatcgaaaaatatctggtagatccgcgccatgtagagcttcaaattctgggcaatggtaaaggagccgtttccgttttgggtgaaagggattgctcggttcaaaaaaatcatcagaagttgatagaagaaagcccctctccggccgtaagcgaggaaatgcgggaagccatgtgtaagggggctgtcagccttttttcttcccttaaataccgcggggcgggaacaatcgagttcctagtatcaggcaataatttctactttatggaagtaaacgcccgaattcaggtagagcatcccgtttcggagatgattaccggcaccgatataattgcagaacaaatccgtgtttgtacaggggaaaacatgaagtttgcccaagggattttgcctactaaaggctgggctatcgaggctagaataaacgcccgctctccagggctcataaagaatttaagggttcccggaggaaacggagtgcgttttgacagctttttgtaccaaggctattcggtagttccgttttatgactcgatgacggctaaactcatcgttcacggggctgacagggccaatgctatccaaaagctgctttgcgccctcgatgagcttaaaattgaaggcattacctgcaatatcgaagaacaaaagattatacttaactcaaaaaagttcaaatcgggtgttttcggtacagggctctatgaagagctttttggaaataagtaa

SEQ ID NO: 5111 - protein, 439 aa, Treponema denticola
MIKKILIANRGEIAVRVIRSCREMGIKTVAVYSTADKDCLHVLLADEAVCIGPPPSAKSYLNKEALITAALCTSCEAVHPGVGFLSENAGFAREVENAGLFWIGPKPDTIEMLGDKVRARETAVKSGLPVTPGSDGAIKELAEAKKTAEKCGYPVIIKAASGGGGKGMRIVYKESELAENLKIASAEAEANFADGTVYIEKYLVDPRHVELQILGNGKGAVSVLGERDCSVQKNHQKLIEESPSPAVSEEMREAMCKGAVSLFSSLKYRGAGTIEFLVSGNNFYFMEVNARIQVEHPVSEMITGTDIIAEQIRVCTGENMKFAQGILPTKGWAIEARINARSPGLIKNLRVPGGNGVRFDSFLYQGYSVVPFYDSMTAKLIVHGADRANAIQKLLCALDELKIEGITCNIEEQKIILNSKKFKSGVFGTGLYEELFGNK

SEQ ID NO: 5112 - DNA, 2076 bp, Wolbachia pipientis wMel
  CDS (1)..(2076)
atgatagaaaagaagtacagtaagattttaatagcaaacagaggagagattgcctgcaggattatcagaactgcccataagatgggtatatcttgtgtgtgcatatactcggatgcagatgtaaattctgtgcatgtaagacaagcagatgagtcaagatatatcggcccttcgccatcttgcctcagttatttaaacattgaaaaaatatgtgaagtagcagttgaaacaggtgctgaggcagttcatcctggctatggttttttagcagagaatccagattttccacgtgctcttcaaaaacataatatagacttcatcggtcccagtgcagaaacaatagaagttacagccaacaaaataacagcaaaagaagctgcaagaaaagctggagtgaatgtagtgccaggatatatgggtaagatcagcaatgctgcccacgcagctcaagttgctaaagaggtcggttttcccgttatgctcaaagctgcatcaggcggtggtggcaaaggaatgcgaattgtaaactccaaaaaagaaattgaactagcatttacatcagccacaaatgaagcagagaaaagttttaaggatggcagtatctttatagagaaatatatagagttgccaagacatattgaaatacaaatcatagcagataaatatggcaatatagtttgtcttggagaaagagaatgctcgatacaaaggaataatcagaaaataatagaagaaacgccaagtccattcattagtgaagaagtaagacaaaaaatgtatgttcaatgtgtttctctggcaaagcaagttggctatttttcagcaggcactgttgagtttgttgtagatcaagaccaaaacttctattttcttgaggtaaatacgagattgcaagttgagcatccagtaacagaatttataactggaatagacatagtagaagaaatgattagaacttcctgtggagagaaattgagattcaatcaggatgatattaaacttactggttctgcaatagaaagtagaatttgcgctgaagacccatcgaagaaatttttcccttccagcggaagaataaaatattacgataaaccgggtgaaaatgattatgtaagaatagatgatggagttgctgcaggttcagaaattagcatgttctatgattcgatgattgccaaagtgataacatatggaaaagatagagtagaagcgatcagcagaatgcaaaaagcattgtctgaatgctatatagaaggagtaacaaataatatagaatttctagaatccatcttccatcacccaaattttatcgcagcaaagctccatacgagattcattccagatcattaccctagtgggtttcacggcgattttgttacagaggagtatattaaaatatttattttcactgcgttatatgttcatttggaaaatgaagaaaggtaccatcataaagcagtgaatgaaacatctcaggtgtcattccagtgcgtgacactggaatctagtaaaaaagaaggggcaccagtatcagctactcggatggcaggtgaccgtgcaagagatttattcatagtgaatataaatgacaatgagtactccgtaaatgcaaaataccaagataatatattaataacggtatataatcacaataaatactccgttataggcaagtggaaatcaagttatagattgctatatatcacaattaatgacgataccaatatagcacttaaaatagaaagacaaggcagcaagtacttcataaggcatgcaggcatgaaagctgagtgttgtatatttaagcctcatgtagctgaattaagtaggttaatgctaaataatgaaacagaagggatttcagcagatgctgtaaaatccccaatatctggtttattagttaaattgcacgtaaatgtaggagatcaggtggaaataggacaacctttatttgtggtggaggcaatgaaaatggaaaatatcatatgtgctgaagcagcaatggtgataaaaaatattcccgttcaagaaggaaaaaatgtgcagattggtgatgtagtctgctttcttaaataa

SEQ ID NO: 5113 - protein, 691 aa, Wolbachia pipientis wMel
MIEKKYSKILIANRGEIACRIIRTAHKMGISCVCIYSDADVNSVHVRQADESRYIGPSPSCLSYLNIEKICEVAVETGAEAVHPGYGFLAENPDFPRALQKHNIDFIGPSAETIEVTANKITAKEAARKAGVNVVPGYMGKISNAAHAAQVAKEVGFPVMLKAASGGGGKGMRIVNSKKEIELAFTSATNEAEKSFKDGSIFIEKYIELPRHIEIQIIADKYGNIVCLGERECSIQRNNQKIIEETPSPFISEEVRQKMYVQCVSLAKQVGYFSAGTVEFVVDQDQNFYFLEVNTRLQVEHPVTEFITGIDIVEEMIRTSCGEKLRFNQDDIKLTGSAIESRICAEDPSKKFFPSSGRIKYYDKPGENDYVRIDDGVAAGSEISMFYDSMIAKVITYGKDRVEAISRMQKALSECYIEGVTNNIEFLESIFHHPNFIAAKLHTRFIPDHYPSGFHGDFVTEEYIKIFIFTALYVHLENEERYHHKAVNETSQVSFQCVTLESSKKEGAPVSATRMAGDRARDLFIVNINDNEYSVNAKYQDNILITVYNHNKYSVIGKWKSSYRLLYITINDDTNIALKIERQGSKYFIRHAGMKAECCIFKPHVAELSRLMLNNETEGISADAVKSPISGLLVKLHVNVGDQVEIGQPLFVVEAMKMENIICAEAAMVIKNIPVQEGKNVQIGDVVCFLK

SEQ ID NO: 5114 - DNA, 1338 bp, Bacillus cereus
  CDS (1)..(1338)
atgtttcaaaaaatattaattgctaatcgcggggaaatcgcagttcgtattatgaaaacttgtcaaaaacttggcattcgcactgttgctatttattctgaggcagatgaaaatgccttgcatgtaaaaatggcaaatgaagcttacttagtaggtgggccgcgtgtccaagaaagctatttaaaccttgaaaaaattattgaaatagctaagaagacaaatgctgaagcaatccatccggggtatggattattatctgagaatccatcttttccggttcgttgtaaagaagaaggaatcgtatttatcggtccatcagaagaaatcattacgaagatgggaagtaaaatcgaatcacgtattgcgatgcaagctgcagatgtcccagtagttccaggtattactacaaatattgaaactgctgaagaagcaattgaaattgctaaacaaattggttacccattaatgttgaaggcatccgcaggcggcggaggcattggaatgcagttgatggaaactgagcaaacgctcaccaaagcatttgaaagcaacaaaacaagagcacaaaacttcttcggtaacggagaaatgtatttagagcgctatattgcagatgcacatcatattgaaattcagcttttagcagatacacatggtaacacagtgtatttatgggagcgtgaatgttcagtacagcgccgaaatcagaaagtaattgaagaagcaccttcaccatttttagatgaaggtacacgaaaagcgatgggtgaagttgctgtacaagctgctaaagcacttggttatacaaatgcaggtacagtggagtttcttgtagatgatcagaaaaacttctatttcttagagatgaatacgagattacaagtagagcatccagttacagaagaaattactggtttagatcttgtagaacaacaacttctaattgcatatggtgaaaaattatcgtttacacaagatgatgtaaaacgtagtggtcatgccatcgaggcacgtatttatgcagaagatccgaaaactttcttcccatcacctgggaaaattacagatttaacgcttccaacaaatgtacgtattgatcactttttggagaatcaagtaacgattacacctttctatgatccaatgattgcgaaagtcattgctcatggtgaaacgcgtgaagaagcaatttccaaattacacgatgcattagaagaattaaaagtagaaggtattaaaacgaacacgccaatgctacttcaagtattagaggacgaagtgtttaaagagggcatttatacaacaagttttgtaacgaaacaacttgttaaaaaataa

SEQ ID NO: 5115 - protein, 445 aa, Bacillus cereus
MFQKILIANRGEIAVRIMKTCQKLGIRTVAIYSEADENALHVKMANEAYLVGGPRVQESYLNLEKIIEIAKKTNAEAIHPGYGLLSENPSFPVRCKEEGIVFIGPSEEIITKMGSKIESRIAMQAADVPVVPGITTNIETAEEAIEIAKQIGYPLMLKASAGGGGIGMQLMETEQTLTKAFESNKTRAQNFFGNGEMYLERYIADAHHIEIQLLADTHGNTVYLWERECSVQRRNQKVIEEAPSPFLDEGTRKAMGEVAVQAAKALGYTNAGTVEFLVDDQKNFYFLEMNTRLQVEHPVTEEITGLDLVEQQLLIAYGEKLSFTQDDVKRSGHAIEARIYAEDPKTFFPSPGKITDLTLPTNVRIDHFLENQVTITPFYDPMIAKVIAHGETREEAISKLHDALEELKVEGIKTNTPMLLQVLEDEVFKEGIYTTSFVTKQLVKK

SEQ ID NO: 5116 - DNA, 6696 bp, Ashbya gossypii
  CDS (1)..(6696)
atgagcgaagggagttttacagaggccatggagtcacagaaacggtacgagttcacagactactcggccaagcacgcccggctagcgcctcacttcatcggtctgaataccgtggaacaggcggaggcgtcgccgctgcgcgactacgtgcggcttcacggcggccacacggtcatctcgaagatcctgattgcgaacaacgggattgctgcggtaaaagagatcagatcagtgcgtaagtgggcgtatgagacgttcggggacggaaaagttgttcagtttgttgtcatggcaacaccggaagatctagaggcgaataccgagtatattcgcatggccgaccagtacgtggaggtacccggcggcacaaataacaataactacgcaaatgtcgacctgatcgtcgatgttgcagagcgtgctgacgttgatgcagtttgggccggatggggtcacgcttcggagaatccgctccttcctgagaagctggcccggtcgaagcggaaggtagtgttcattggccctccagggagcgctatgcgctctttgggagataaaatttcttccacgattgtcgcacaacacgccaaggtgccctgcatcccatggtcgggtactggcgtggaccaggtcgaaatagatccgcacactaagctcgtatcggttgcggacgatatctaccagaaggggtgctgcttgtcccccgaagatggcctaaacaaggctaaacagatcggctttccagttatggtgaaggcatctgaaggtggcggaggtaagggtattcgtaaggttgtgagggaggaagactttatttctctgtaccagcaggctgcaaatgaaataccaggatctcctatttttattatgaagttggcaggaaaggctcgtcatctagaggttcaactgctggccgaccaatatggtacaaatatctccctatttggtcgcgactgctctgttcaacggcggcaccagaagattatagaagaagccccagtgacgatcgctaaaccagatacgtttgccgaaatggagagggctgcagtgagattgggtaaattagtcggctacgtttctgcgggaacagttgagtacctatattcgcacgaagaagacaagttctatttccttgagctgaatccaagacttcaggtggaacatcctaccaccgaaatggtcacaggtgtaaatttgcctgcagcacagcttcagatcgcaatgggcataccgctgcatagaatcagagatatacgcttattctacggccttgacccacatactgctacagagattgattttgagttttcttcagcggatgctttgcagacgcaaagaaggcccatccccaagggccactgtacagcatgtagaataacgtcagaggatccaaatgagggtttcaaaccgtcgggtggctctttacacgagttgaacttccgttcctcttccaacgtctggggttatttttctgttggtaacaacggtggaattcattcattctctgattcgcaatttggccacatctttgcgtttggtgagaacaggcaggcatcgaggaaacacatggttgttgctttaaaggaattatccataagaggtgactttagaactacagtggaatatctaataaaactgcttgagactgaagattttgaggataacactattactactggttggttggatgatttgatctctcaaaagatttcagccgaaaaaccggatcctatgttggcggtaatctgtggcgctaccaccaaggcgcacattgcatcagagcaagcgctgcaggaatatgcatcctatctcaagcgtggtcaagttcctaataagaacatgctgaaaacgatgtatcctgttgagtttatacacgaagagaagaggtataaattcaccgtcgcgaagtccgctgatgataggtataatcttttcatcaatggatctaggtgcgaagttggtcttcggaaattgtcagatggcgggctattgatagctgctggtggtaagtcccatacagtttactggaaagaggaagtcgctgcaacaagactgtctatagaccaccagacaacgctgttggagacagagaacgatcccacgcagctgcggactccgtcgccgggtaagttagtgaactttttggtcgaatcaggcgatcatctcgaggcaggccaaccgtatgctgagatcgaggtcatgaaaatgcaaatgcctctcatcgcccaggagagcggtgtcctgcaactactaaggcaacctggctctacgttggccgctggtgacattctagccattttaacgcttgatgatcctagtaaggtaaaatatgccatgccttttgaaggtatgcttcctgatcttggtgccccagtgattgaaggaacgaagccagcgtacaaattcagatctctagtttcgaccctagagaatgtcttaaaaggctacgacaatcaagtgattatgaatgcgtcattacaaaagctaatagaggtccttagagacccgcagttaccttattcagagtggaaaatgcaagtatctgctttacactccaggttaccacaggccttggatcagcaattagagcaattggtcgagcgttgccataaaaggtctgcggatttccctgcaaagcagctgggaaagattttagaaaacgctatcaacgagcggaaatcagacccattgttccagactgttgtggaacccttgacaagtatcacaactcgttacaagactgggttacaggaccatgagcacgccgttttgggaagctttttggaaaattactattcagttgagaagctattctctggctctaaggttaatgaagaggatgttatcctcaagttacgggatgaaaacgccgatgacctaaataaggtagtcatgactgtcctttcacattctcgtgtttctgcgaagaataatttgatatctgccattctaaagcattaccgtcctctatgcaaattatcatccgaggtggcggctaagatatctgttcccttgaaacatatcgttcagttggaatccaaagcaactgctaaggtagcccttcaagcaagggagatattgattcaggcagctctaccttcggtcagagaaaggacagaacaactagagcacatattgaaaagttctgtggttaagcctacttatggtgctaccgagatgaaccatacggatccgaacattgaggttttgaaagacctcattgattccaattacgtggtatttgacgttttgactcaatttttaaatcacagggataaatatgtgattgcagcagcagcagaagtttacattcgccgggcctatagagtctataccgtcggtgatatcaagtaccattctggctttgatactccaatttttgaatggaagttccaattgccatctgctgccttcacttcgcgcccgcaggttacttcgaggctgggtgtgaacagagctatttccatctcagatttgacatacgtatctgaggctgaaaaccaaccttctagaacaggactactagtgcccgccccacatttggatgatgtcgactctattctatcgaatgctctgagcgtaattcctatgcaattgtcccattccggtcctttgccagataggtctgcggcggctaacccatcattgtcaaatgtagtaaatgtggtaatttcttctacggaaggtttcgactccgaggcagaagttttggacagattgaaggaaattttggagctaaataaaagcgaacttctcgcttcagcaatcagacgcattacatttgtctttggatacagggatggctcttatccaaagtactatactttcaggggatctgactatgtcgaagataaaactattcgtcacattgaaccagcactagcctaccagttggagttgggtagaatgtcaaatttccacattaagcctatcttcacagaaaatagaaatatccatgtctatgaagcgataggtaaaaactcacctgttgataaacgttttttcaccagaggcattattaggacgggccgcatcagggatgatatcactattcaagaatatttgacttctgaagcgaatagattaatgagtgatattttggataacttggaggtcactgatacctctaattcagacttaaaccatatctttatcaatttctctgccgtctttgacgtttcgccagcagacgttgaggcagcgtttggaggcttcttggaaagatttggtaagagacttctaaggcttcgtgttgctgcggcagaaattcgtatcatgataaaggatccgggatctgggactccggttgccctaagagcgttaattaataacgtttctggttacgttgtgagaactgaattgtatactgaggttaagaatgcgaacggagatagaattttcaaatcattggataagcctggttcgatgcacttgaggccaattgcaacgccatatcctgtgaaggaatggctacagccaaaacgttacaaggctcatttgatgggtactacgtacgtgtatgacttcccagaactgttccggcaagctacattaagccaatggaggaaacattcgccgaagatgcagttatccgatgatttcttcattgcgaatgagttgatctctgacgagaatggtgaactaacagaagttgaccgcgagcccggtactaatagtattggtatggtagctttcaaggttactgttaagacacctgaatatccccatggccggcaattcgttattatcgctaacgatattacctacatgattgggtcctttgggccacaagaagatgaattctttgagaaagttaccaactatgctagaaagcgtggtattcccagaatttatctgtcagcgaactcaggagcaagaattggtattgctgaagaacttgttccaatgttctccgtggcttggaagacccctggtaatcctgaaaaaggctttgactatctatatttcacgacagaaatgtatgaaacgttgaagcagtctggtaaagaaaatgtcgtaattactgaaagaattgtggaagatggagaagagagatacgccatcaaggcaatcataggatcagaagatggtctaggtgttgagtgtctaaggggttctggcttgattgcaggtgcaacctcaaaagcatacaaggatatttttacgataaccttagtgacatgcagatcggtaggtattggcgcttatttggtcagattaggccagcgtgcgatccaagtggaaggacaacctataattctaacaggtgcacctgctattaacaaagttcttggcaaggaagtttactcttctaacttgcaactaggtggcacacaaattatgtacaacaacggtgtgtcccacttgaccgcgcaggatgatctagcaggtgttgaacagataatggaatggctctcctatattccagctaaacgtaatatgcccgtacctatactgcagtcagaggacaactgggatagggatgttgaatacacaccaacactttcacagccttatgatgtacgctggatgattgaaggccgccaaggacctgatggatttgaatatggtctgtttgacaagggttccttccaggaaacattatcaggctgggcgagaggcgtcgttgtaggcagagctcgcatgggtggtatcccgctcggtgttattgccgttgacactcgtacaattgaaactgtgatccctgccgatccggcaaaccctgcatccacagaaactttgattcaggaggcaggcttagtttggtatcctaactcagcatttaaaactgcgcaggccatagctgatttcaaccacggagaacaacttccactcatgatattagcaaactggagagggttttctggtggtcaaagagatatgtacaatgaggtcttgaaatatggctccttcattgttgatgctctagtggattataaacagcctgtattcgtatacatacctccaacaggtgagttgagaggtggttcctgggttgtggtggatcctacaattaactctgaccagatggagatgtatgctgattccgactcgcgggcaggtgtgctagaacctgctggtatggttggtataaagtacaggagagaaaagcttttgaaaacaatggagaggttagatgcaaagtacaaagaattgaaggattccttgtcagattcatcactctcctctgaggaacatcagaagctcgccaacgagttggctgcccgtgagaagctactcttgccaatttaccagcaagtcagtatccaatttgcaggcttacacgataaggcaggcagaatgctggcgaaaggcgtgatcagaaaggaactacaatgggtgaatgcgagacgtttcttcttctggagactcaggagaagattaaatgaggaatacctcattagaagactcgaatcggagctacctaacgccagtagactggagaagttcgcaagactaagatcctggtaccctgcttctgtggaccaggaaaacgaccaacaggtcgccacctggatcgaagaaaactaccaagtcttggaagattacttgcaggctttgaagttggaatcatttgcccaaaacctcgccaaggccatccgtagtgatcacgacaacgcgataacaggtctcgctgaagttttgaagctactctcggcggaggataaggaaaagataatgaagagtctgaagtag

SEQ ID NO: 5117 - protein, 2231 aa, Ashbya gossypii
MSEGSFTEAMESQKRYEFTDYSAKHARLAPHFIGLNTVEQAEASPLRDYVRLHGGHTVISKILIANNGIAAVKEIRSVRKWAYETFGDGKVVQFVVMATPEDLEANTEYIRMADQYVEVPGGTNNNNYANVDLIVDVAERADVDAVWAGWGHASENPLLPEKLARSKRKVVFIGPPGSAMRSLGDKISSTIVAQHAKVPCIPWSGTGVDQVEIDPHTKLVSVADDIYQKGCCLSPEDGLNKAKQIGFPVMVKASEGGGGKGIRKVVREEDFISLYQQAANEIPGSPIFIMKLAGKARHLEVQLLADQYGTNISLFGRDCSVQRRHQKIIEEAPVTIAKPDTFAEMERAAVRLGKLVGYVSAGTVEYLYSHEEDKFYFLELNPRLQVEHPTTEMVTGVNLPAAQLQIAMGIPLHRIRDIRLFYGLDPHTATEIDFEFSSADALQTQRRPIPKGHCTACRITSEDPNEGFKPSGGSLHELNFRSSSNVWGYFSVGNNGGIHSFSDSQFGHIFAFGENRQASRKHMVVALKELSIRGDFRTTVEYLIKLLETEDFEDNTITTGWLDDLISQKISAEKPDPMLAVICGATTKAHIASEQALQEYASYLKRGQVPNKNMLKTMYPVEFIHEEKRYKFTVAKSADDRYNLFINGSRCEVGLRKLSDGGLLIAAGGKSHTVYWKEEVAATRLSIDHQTTLLETENDPTQLRTPSPGKLVNFLVESGDHLEAGQPYAEIEVMKMQMPLIAQESGVLQLLRQPGSTLAAGDILAILTLDDPSKVKYAMPFEGMLPDLGAPVIEGTKPAYKFRSLVSTLENVLKGYDNQVIMNASLQKLIEVLRDPQLPYSEWKMQVSALHSRLPQALDQQLEQLVERCHKRSADFPAKQLGKILENAINERKSDPLFQTVVEPLTSITTRYKTGLQDHEHAVLGSFLENYYSVEKLFSGSKVNEEDVILKLRDENADDLNKVVMTVLSHSRVSAKNNLISAILKHYRPLCKLSSEVAAKISVPLKHIVQLESKATAKVALQAREILIQAALPSVRERTEQLEHILKSSVVKPTYGATEMNHTDPNIEVLKDLIDSNYVVFDVLTQFLNHRDKYVIAAAAEVYIRRAYRVYTVGDIKYHSGFDTPIFEWKFQLPSAAFTSRPQVTSRLGVNRAISISDLTYVSEAENQPSRTGLLVPAPHLDDVDSILSNALSVIPMQLSHSGPLPDRSAAANPSLSNVVNVVISSTEGFDSEAEVLDRLKEILELNKSELLASAIRRITFVFGYRDGSYPKYYTFRGSDYVEDKTIRHIEPALAYQLELGRMSNFHIKPIFTENRNIHVYEAIGKNSPVDKRFFTRGIIRTGRIRDDITIQEYLTSEANRLMSDILDNLEVTDTSNSDLNHIFINFSAVFDVSPADVEAAFGGFLERFGKRLLRLRVAAAEIRIMIKDPGSGTPVALRALINNVSGYVVRTELYTEVKNANGDRIFKSLDKPGSMHLRPIATPYPVKEWLQPKRYKAHLMGTTYVYDFPELFRQATLSQWRKHSPKMQLSDDFFIANELISDENGELTEVDREPGTNSIGMVAFKVTVKTPEYPHGRQFVIIANDITYMIGSFGPQEDEFFEKVTNYARKRGIPRIYLSANSGARIGIAEELVPMFSVAWKTPGNPEKGFDYLYFTTEMYETLKQSGKENVVITERIVEDGEERYAIKAIIGSEDGLGVECLRGSGLIAGATSKAYKDIFTITLVTCRSVGIGAYLVRLGQRAIQVEGQPIILTGAPAINKVLGKEVYSSNLQLGGTQIMYNNGVSHLTAQDDLAGVEQIMEWLSYIPAKRNMPVPILQSEDNWDRDVEYTPTLSQPYDVRWMIEGRQGPDGFEYGLFDKGSFQETLSGWARGVVVGRARMGGIPLGVIAVDTRTIETVIPADPANPASTETLIQEAGLVWYPNSAFKTAQAIADFNHGEQLPLMILANWRGFSGGQRDMYNEVLKYGSFIVDALVDYKQPVFVYIPPTGELRGGSWVVVDPTINSDQMEMYADSDSRAGVLEPAGMVGIKYRREKLLKTMERLDAKYKELKDSLSDSSLSSEEHQKLANELAAREKLLLPIYQQVSIQFAGLHDKAGRMLAKGVIRKELQWVNARRFFFWRLRRRLNEEYLIRRLESELPNASRLEKFARLRSWYPASVDQENDQQVATWIEENYQVLEDYLQALKLESFAQNLAKAIRSDHDNAITGLAEVLKLLSAEDKEKIMKSLK

SEQ ID NO: 5118 - DNA, 3516 bp, Ashbya gossypii
  CDS (1)..(3516)
atggggtcccaactggctggttttcgccggcattcaaacctgctgggcgagaagaacaaagtcctggtagcaaacagaggcgaaataccaattcgtatcttccggacggcacatgagctctcaatggcgacagtggcagtctactcgtacgaagaccggctgtcgatgcatcggcaaaaggcggacgaggcgtacatgatcgggcgcgagggccagtacacgccggtcggcgcgtacctggccatcgacgaaattctgcggatagcgcgagaccacgacgtggatttcatccacccaggctacgggtttctttctgagaacgctgaatttgcggcgaaggtggagggggccggcatcacgtggataggaccgccagcgtctgtaatcgaggccgtgggtgacaaggtgagcgcgcgcaatcttgcggcggtggccgatgtgccgaccgtcccgggaacggaaggccctataagctcagtggaagaggcggaggagtttgtgcagaagtacgggtaccctgtgatcatcaaggcggccttcggcggtggtggacgcgggatgcgcgtggtgcgggagggtgacgatatccgcgatgccttccagcgtgcgcgctccgaggcggaaacagcctttggcaatggcacctgctttgtggaacgttttctagaccaacccaagcacattgaggtgcagctgcttgcagacaactatggcaatgtggtgcacctctttgagcgtgattgctccgtacagagacgccaccagaaggttgttgaagttgcgccggctaaaacgctatctaaggaagtgcgcgacgcgatcctcacagatgcagtgaagttggccaaggcgtcggggtaccggaatgcgggtactgctgagtttttggttgataaacaaaacagacattatttcatcgagatcaatccacgtatccaggtggagcatactataacagaggagattacgggtgtggatatagttgctgcgcaaattcaaattgcagcaggtgcttctttagaacaactggggctaatgcaggatcgcataacaacgcgtggttttgcgatccagtgccgtattactaccgaggacccctcgaagaacttccagcctgacacgggaagattagacgtttacaggtctgctggtggtaacggtgtgcgcttggatggtggcaatgcgtttgctggggctgtcatatccccccactacgattccatgctggtcaagtgctcatgctcgggctctacatatgagattgttcgtaggaagatgctgcgtgcgctaattgagttcagaattagaggcgttaagacgaacatcccctttctgctgacgctgctgacgcatcctgtattcatttccggcgactactggaccacgttcatcgacgatactccacagctctttgagatggttgcttcgcaaaatagagcacagaaactactgcagtacctttctgatcttgcagttaacggttcttccatcaagggacaaatgggcgtaccgaagctcttagcccagccaagtatcccacagctgcacaatgctaagggtgaggtaattgatgttcagtcccagccccccgcgggctggcggcaggtgctactagagcatggcccagaagtatttgcgaagaaggtgcgtgaattcgatggaacattgcttacagacactacatggagagatgcccatcaatcattgttggcaactagggtgcgtacttatgacctagctgctattgcacctaccactgcacatgcattagcaggagcctttgcattagagtgttggggtggcgctacgtttgacgttgccatgcggtttttgcacgaagacccatgggagcgcttgaggacactgcggaaattggtgccaaacatcccattccagatgttgcttcgtggtgccaacggtgttgcttactcctctctgcctgataatgcgattgaccatttcgtcaaacaagcaaaggagaatggtgtcgatattttcagagtgttcgatgcgttgaatgacctagaacagctgaaggtgggtgtcgacgccgtgaagaaagcggaagggttggttgaggccactatctgttactcaggtgatatgctacagccaggcaagaagtacaaccttgattactacctggagttgactgaaaagattgttgccatgggcacacatatcttgggtattaaagatatggccggcaccatgaagcccggtgcagcaaagctactgattggctcgatcagggcaaagtatccagacctcccaattcatgtgcatacacatgattctgcaggcacaggtgtcgcatcaatggtccaatgcgccatctctggcgccgatgttgtggacgtcgccaccaactcgatgtctggcttaacgtcccagccctccattacggctttgcaggcctcattgggtggcgatatcgcgacgggtgtagaccccgatcatgcgatcgaactagacgcatactgggcggagatgagactgttgtactcatgcttcgaagcggacctcaagggccccgacccagaggtgtacaaacatgaaattcctggtggtcagctcacaaacctgttgttccaggcacagcagcttggtcttggagaacagtgggcagagaccaagcgcgcttatgccgaggccaaccagctgctcggtgatcttgtgaaggtcacccctacatcgaaggttgtcggcgatcttgcccagtttatggtcagcaaccgtctaaactccgatgatgtacgcagacttgcaagctcgcttgacttcccagactctgtcatggacttttttgaaggtctcataggccaaccttacggagggttccccgaacccctcagatcagatgttctcagaaacaaacgcaggaaactgaaggtcagaccaggtttggagctggcaccattcgatctcgacaagatccgcgaggaactgcgctctcggttcgacaacatcgatgagtgcgatgtcgcatcctacaacatgtacccgaaggtgtatgaagactttagaaagatcagagagacctacggagacctgtcggtactgcccacacataacttcctgtctccgccaaagatcggcgaggaaatcattgtcaccatcgagcagggcaaggtgctcatcatcaagctccaagccatcggcgacctgaacaaggagactggcaagcgcgaggtctatttcgagctaaatggtgagctgcgtaaagtatcagtcgcggacaagtcgcaaaaacttgaaaccgtgtcgaagctcaaggcagatgcccacgaccagttccaggtcggcgcgcccatggccggcgtcatcatcgaggtgaaggtgcacaagggctccgcagtgacgaagggccaacccgtcgcagtcctgagcgccatgaaaatggagatggttatctcctcgcccagcgacgggcaagttaaggacgttttcgtttcggacggcgagacagtggaggcatcggatctgctcgtccagctggaagtctcccaaccctaa

SEQ ID NO: 5119 - protein, 1171 aa, Ashbya gossypii
MGSQLAGFRRHSNLLGEKNKVLVANRGEIPIRIFRTAHELSMATVAVYSYEDRLSMHRQKADEAYMIGREGQYTPVGAYLAIDEILRIARDHDVDFIHPGYGFLSENAEFAAKVEGAGITWIGPPASVIEAVGDKVSARNLAAVADVPTVPGTEGPISSVEEAEEFVQKYGYPVIIKAAFGGGGRGMRVVREGDDIRDAFQRARSEAETAFGNGTCFVERFLDQPKHIEVQLLADNYGNVVHLFERDCSVQRRHQKVVEVAPAKTLSKEVRDAILTDAVKLAKASGYRNAGTAEFLVDKQNRHYFIEINPRIQVEHTITEEITGVDIVAAQIQIAAGASLEQLGLMQDRITTRGFAIQCRITTEDPSKNFQPDTGRLDVYRSAGGNGVRLDGGNAFAGAVISPHYDSMLVKCSCSGSTYEIVRRKMLRALIEFRIRGVKTNIPFLLTLLTHPVFISGDYWTTFIDDTPQLFEMVASQNRAQKLLQYLSDLAVNGSSIKGQMGVPKLLAQPSIPQLHNAKGEVIDVQSQPPAGWRQVLLEHGPEVFAKKVREFDGTLLTDTTWRDAHQSLLATRVRTYDLAAIAPTTAHALAGAFALECWGGATFDVAMRFLHEDPWERLRTLRKLVPNIPFQMLLRGANGVAYSSLPDNAIDHFVKQAKENGVDIFRVFDALNDLEQLKVGVDAVKKAEGLVEATICYSGDMLQPGKKYNLDYYLELTEKIVAMGTHILGIKDMAGTMKPGAAKLLIGSIRAKYPDLPIHVHTHDSAGTGVASMVQCAISGADVVDVATNSMSGLTSQPSITALQASLGGDIATGVDPDHAIELDAYWAEMRLLYSCFEADLKGPDPEVYKHEIPGGQLTNLLFQAQQLGLGEQWAETKRAYAEANQLLGDLVKVTPTSKVVGDLAQFMVSNRLNSDDVRRLASSLDFPDSVMDFFEGLIGQPYGGFPEPLRSDVLRNKRRKLKVRPGLELAPFDLDKIREELRSRFDNIDECDVASYNMYPKVYEDFRKIRETYGDLSVLPTHNFLSPPKIGEEIIVTIEQGKVLIIKLQAIGDLNKETGKREVYFELNGELRKVSVADKSQKLETVSKLKADAHDQFQVGAPMAGVIIEVKVHKGSAVTKGQPVAVLSAMKMEMVISSPSDGQVKDVFVSDGETVEASDLLVQLEVSQP

SEQ ID NO: 5120 - DNA, 5460 bp, Ashbya gossypii
  CDS (1)..(5460)
atgacagatcacagtagcacagtggggtggacctcacagcagtggcgcgagttccatcgccgcgcgtctgcggacgcatcgctcgccaggctgctggcgctagcacacgccgagcgtgacgccggggcggcgtggatttccgtcgcttccgacgagcacatagagcaccaatggcgcgtcctgcaatcgcgtggcgaccgtcagcggctacctctgtacggtgtgccggtcgcggttaaggacaatatcgacgtgcgcgggcttgcgacgactgctgcatgccccagctttgcatacacggcggcgcaggacgcgacggcggtgcgcctgctgcgtgatgcgggcgcggtcattctcggcaagaccaacatggaccagtttgcgacggggctcgtaggcacgcggtccccatacggcagcgtggcgagtgcgttcagcagcgcacacgctgcgggcggttcgtccagcggctccgccgtggtcgtggcgcgcggcgcggtaccgcttactctaggtacggacacggctgggtccggacgggtgcctgctgcgctcaacaacctggtgggggtcaagcccacgcgcggcactgtgtcatgtactggcgtggtgcctgcctgccgctcgttggattgtgtgtccgtctttgcgcgggatgtcgcggacgcccaccggtgtctgcgtatcctggcgcggcccgatgggtcagatccatacagccggccttccccggcggacgcgccgcgccgtttgagcacatgcccagtggtcggcgttccgcgcgagccggagtggtttggtgagtcgcagaacgccaagctgtttgcgacggcctgccagcgcatgcgcgccacgggcgctcgtgtggtgaaggtggacccgcagccgcttctggacctcggccggtcgctgtacgagggcccgtgggtggcggagcggtacgctgcgatgcgggcgttctactccggacagcccccgagggatacgctggaccctactgtgacggggataatcacatctgccgggggctacagcgcggcggacgtgtttgaccatggacttcggcggcaaaaactcgtggcggctatcgaggccgagctggcgggcgtggatgcgctgctggtgccgacctgcccgctgaacccgacattggcggctatcgcggccgagccgctactggtgaacgcgcggcagggcatgtggacgaacttcgtgaacctggcagacctcgctgcggtggcaattccggcggggttccggcgtgacgggctgccgcagggcgtgacgctggtgggccggaagttcagcgacctcgcgctgctggagctcgggagccggctgctacgcgtggaggacgcggagccgcggcgctgcggggcgcttcccgcgggccaggccctgtgcgaggacgaggtcgttagcgggagcgaggagcgggacagcacagttctgctagcagtggtgggcgcgcacctgcgcggcctggcgctgcactggcagctggacgaggtgcaggccgagtttgtgcgcgaagcgcgcacggcgccgtcgtataggctctatgctctgccaaagacggggcctgtgcttaagccggctctgcggcgcgtatgcgcgggcaagggtgcggcaatcgagcttgaggcgtactcggtccccgaggcgacattcggccgttttgtcgcgatggtgcccgcgccgctggccatcgggtccgtggagctcgagtcgggggagtacatcaaatcgtttgtctgcgaagaggacgggtacatccaagacggcacagtcgacatcacgcacttgggcggcttccgcagatacgtggaacatctgaggcggcagagggacgtagacaagccctttgacacggttcttgtggcgaatcggggcgagatcgccgttcgcattatccgcactttgaagcggctcggaatacgctctgtcgcggtctattccgatccagatagacattcccagcatgtgcgtgacgctgatgtggcggtagcgctgggcgggagctccgcggccgaaacatacctggacatcgacaaaatattggcggctgccaagaagacggacacacaggccatcattcctggatacggttttctctccgaaaatgctacgtttgcggaacgctgtggggcagagggtatagtgtttgtcgggccgtctggagactcaattcgcaagctcgggctgaaacattgggcgcgtgaactcgccgcatcggctggcgtgccgctgacgaagggcactggattgctgcagagtgcgagtgctgctcttgaggctggtgaggagatcggttatcctctgatggtgaagtcgacagctggtggtggaggcatcggtttgcaacgagtagactctgccgctgagcttgccgccgcctttgagcaggtccagcgtcagggcgaactgtacttcactgactccggtgtatttctagagtccttcattgcacgtgcaaggcatgtggaggtacagattatgggggatgggcacggtaggactgttgcacttggtgaacgcgattgttcgctgcagcgcaggaaccagaagattattgaggagactcctgctcctaacctacctgctcatacacgacagaagatgcgtcaggctgcgcagcgtttgtgttctgcagtgaagtataagtgcgcaggtaccgtggagttcatgtatgatgagcagaaggacgagttttatttcttggaagtgaatactcggctgcaggttgagcatccaatcacagaaatggtgactggtcttgatttggtggaatggatgctgcgcatagcagccaataccccaccagactttgatgcgggagtcgaaatagaaggcgtttccatggaggctcgtgtctatgtagaaaatcccgtcaaggggttcaccccgtcaccggggctgctgaccgaggtggtattcccgtcttgggctagagtagatacgtggatattgaagggaacacgtgtggcggccgagtatgatccgaccttggcgaagatcattgttcatggaaaggaccgtgaggacgctgtgagtaaactactcctggcactgagtgagacgcgtattgcgggttgcatgaccaacctcgactatctcaaatcaattgcctcttcggaggaattccgtaaggcttcggttttcacgaggcttctcaacgactttgaatataccccaacggcttttgaggtgaagatccccggtgcatatactacaatacaagactatcctggccgtgttggatattggcgtattggggtgccaccttcggggccaatggattcctattcattccggttggcaaatagagtagttggaaacgactccaaggcagctgccctggagataacgctgaatgggccagagttgaagttccattcagatgcagttatagccgtcacaggtggcgctgttccagttaccttgaatgggaagccagtcctacagtacgtcccgctcaccctagagaagggagatgtgctcaagatcggaaaactcgagagcggatcgagggcttatctagcagtacggggtggcatagatgttcccgaattcttggggtccaggtcaacttttgccatgggtggtatcggcggccataatggtcgcgtgttagctcctggcgacgtactatttattaataaagattcctccgtcgccgttggtgacacggtgacaataccttcgggtttgcaacccgtaataccccgcgaatcatggaaaattgggctagtatgtgggcctcatggctctccagattttttcaagcgtgaggcactggaagaattcttctccagtccttggaaggttcactataactccaacagatttggcatcaggcttattggtcctaagcccaagtgggctagatctgatggtggtgaagccggattgcatccttcgaacacacatgactatgtttactccgtgggcgctattaactttaccggagacgaaccagttattatagccgctgagggtccatctctaggagggttcgtttgcgcggcagttgttcccgaagcagaattgtggaaggttgggcagttgaaacctggagacactattaagtttgtaccaatcagcgtggataccgctagagcgctaaaaagatcacaagatgctgcggtagatgccctagatatcctttcgtcgataaaattggatgattctatggtgttgcccagctatcaggatcctgtgcttctgagacttgccaagagatcaggactatgtcctaaggtgacgttccggcaatcgggggataggtatattctcattgagtatggtgaaaacgagatggatatcaatatctcgtacagaatcaagcagcttcaagagatggtgactaagaataaggtcaccggtattgttgagatgtcacaggggattaggtccctgctggtggaatacaatggttatacgatatcccaggaagacttgctaagtgtgctgtccgcatatgagctggaaataaattttgatgttgattggaaggtaaaggccaagctattcagactgccaatggctttcgaggacagcaaaaccctagaagcagtcaggcggtaccaggagaccattcggtcggacgcgccctggctacccagtaacgctgattttgttgccaatgtcaatggtattacacgagccgacgtcagagacttgctgtattccgccacatttatggttttggggcttggtgatgttttcttgggtgctccttgcgccgtgccgctagacccacggcagagactactaggcaccaaatacaatccttcaagaacatacactccgaatggagtcgttggcatcggcgggatgtatatgtgcatatactgcacagacagcccgggcggctaccagttgatggggaggacaattcccatctggaaccgtttgcagctgggagaggcatggaaagatcatccgtggctgttgactccgtttgatcaggtggaattttatcctgtttcggaggagcgtataaatgagctcactgaggaggtcgagaatggcacgttcgagcttgaggttaaggaaacggtctttgataacggggcatacaacagatggcttgaagataacagggagtctattcaggctttcaaggaggggcagagtggcgagcgtgccgcggagtttgcgcggctgatcaaagtcgcgaactcagatctggagacggctgtccgaaaggaggcggaacctgtggagtaccctgaagatgcccatatggtatactccgaatacgcgggccggttttggaagcaggtggtctccgtcggggataaagtcaaagagggcgacaaactagtcattatcgaggcgatgaagacagaaatggtcgtctcggcaacagctgatggagaggttataaatattctccatgccaatggagatatggtggatgctgggaacctggtggtggtgttgaaaaattgttag

SEQ ID NO: 5121 - protein, 1819 aa, Ashbya gossypii
MTDHSSTVGWTSQQWREFHRRASADASLARLLALAHAERDAGAAWISVASDEHIEHQWRVLQSRGDRQRLPLYGVPVAVKDNIDVRGLATTAACPSFAYTAAQDATAVRLLRDAGAVILGKTNMDQFATGLVGTRSPYGSVASAFSSAHAAGGSSSGSAVVVARGAVPLTLGTDTAGSGRVPAALNNLVGVKPTRGTVSCTGVVPACRSLDCVSVFARDVADAHRCLRILARPDGSDPYSRPSPADAPRRLSTCPVVGVPREPEWFGESQNAKLFATACQRMRATGARVVKVDPQPLLDLGRSLYEGPWVAERYAAMRAFYSGQPPRDTLDPTVTGIITSAGGYSAADVFDHGLRRQKLVAAIEAELAGVDALLVPTCPLNPTLAAIAAEPLLVNARQGMWTNFVNLADLAAVAIPAGFRRDGLPQGVTLVGRKFSDLALLELGSRLLRVEDAEPRRCGALPAGQALCEDEVVSGSEERDSTVLLAVVGAHLRGLALHWQLDEVQAEFVREARTAPSYRLYALPKTGPVLKPALRRVCAGKGAAIELEAYSVPEATFGRFVAMVPAPLAIGSVELESGEYIKSFVCEEDGYIQDGTVDITHLGGFRRYVEHLRRQRDVDKPFDTVLVANRGEIAVRIIRTLKRLGIRSVAVYSDPDRHSQHVRDADVAVALGGSSAAETYLDIDKILAAAKKTDTQAIIPGYGFLSENATFAERCGAEGIVFVGPSGDSIRKLGLKHWARELAASAGVPLTKGTGLLQSASAALEAGEEIGYPLMVKSTAGGGGIGLQRVDSAAELAAAFEQVQRQGELYFTDSGVFLESFIARARHVEVQIMGDGHGRTVALGERDCSLQRRNQKIIEETPAPNLPAHTRQKMRQAAQRLCSAVKYKCAGTVEFMYDEQKDEFYFLEVNTRLQVEHPITEMVTGLDLVEWMLRIAANTPPDFDAGVEIEGVSMEARVYVENPVKGFTPSPGLLTEVVFPSWARVDTWILKGTRVAAEYDPTLAKIIVHGKDREDAVSKLLLALSETRIAGCMTNLDYLKSIASSEEFRKASVFTRLLNDFEYTPTAFEVKIPGAYTTIQDYPGRVGYWRIGVPPSGPMDSYSFRLANRVVGNDSKAAALEITLNGPELKFHSDAVIAVTGGAVPVTLNGKPVLQYVPLTLEKGDVLKIGKLESGSRAYLAVRGGIDVPEFLGSRSTFAMGGIGGHNGRVLAPGDVLFINKDSSVAVGDTVTIPSGLQPVIPRESWKIGLVCGPHGSPDFFKREALEEFFSSPWKVHYNSNRFGIRLIGPKPKWARSDGGEAGLHPSNTHDYVYSVGAINFTGDEPVIIAAEGPSLGGFVCAAVVPEAELWKVGQLKPGDTIKFVPISVDTARALKRSQDAAVDALDILSSIKLDDSMVLPSYQDPVLLRLAKRSGLCPKVTFRQSGDRYILIEYGENEMDINISYRIKQLQEMVTKNKVTGIVEMSQGIRSLLVEYNGYTISQEDLLSVLSAYELEINFDVDWKVKAKLFRLPMAFEDSKTLEAVRRYQETIRSDAPWLPSNADFVANVNGITRADVRDLLYSATFMVLGLGDVFLGAPCAVPLDPRQRLLGTKYNPSRTYTPNGVVGIGGMYMCIYCTDSPGGYQLMGRTIPIWNRLQLGEAWKDHPWLLTPFDQVEFYPVSEERINELTEEVENGTFELEVKETVFDNGAYNRWLEDNRESIQAFKEGQSGERAAEFARLIKVANSDLETAVRKEAEPVEYPEDAHMVYSEYAGRFWKQVVSVGDKVKEGDKLVIIEAMKTEMVVSATADGEVINILHANGDMVDAGNLVVVLKNC

SEQ ID NO: 5122 - DNA, 1347 bp, uncultured marine gamma proteobacterium EBAC20E09
  CDS (1)..(1347)
atgtcatttaaagtcttaatagccaatagaggagaaatagcattaagagctctaagagcatgcagagaacttggtataaaaactgttggagtctactcagaaggtgatagagatttaaaacatcttagatttgtagacgaatctgtatgcattggtccagcatcccctgcagatagttatcttaatataccttccattttatcagctgcagaacttacagaagttgacgctatatatcctggttatggatttcttgctgaaaaccatgaatttgctgagcagtgtaacaagagtggatttaaatttattgggccaagctcagaaactatcaagacaatgggagataaaattactgccaaaaattttgtagagaaatttaacataccaactgtacctggttattcaaaagatttaccagacgatgaatcaaggttaaagaaaattgttgatgggattggatatccaataattttgaaggccacggccggtggaggcggcaggggaatgagagttgtaactaatgaaaatgatttattagattcattaaaaattacaaaacaagaagcgcttaatgcatttggaaatgacaaagtttatatagaaaaatttattcaaaaacctcgtcatatagaagttcagattattggagatggaaaaggaaatgcaatccatttggggactagggactgtagccttcaaagaagacatcaaaaaataattgaggaggctcctgcattggatcttgatgctgatagtctcaaaatcttgctggatgcatgtgttcatttatgtaaagaaattaattatgaaggcgcaggaacacttgagtttttatatgaaaataaggagttttactttattgaaatgaatacaagaatccaagtagagcatcctgtaactgaaatgataactggatttgatatcgttaaagctcaaataaaaatagcgctcggcataaattatgatttagaccaaaggctcataacattcaaaggtcactcaattgaatgcagaattaatgcagaagatccagaaacttttgaaccttgtccaggaaaaattacgaagatgcatacagcaggaggctttggaataaggtatgattcgcatatttatggaggttacaatgttagtcctttctatgattctttgctcgcaaaaataattacgcaggcaaattctagaaaaactgctataaaaagaatgctatctgctttggatgaattttatgttgaaggcattaagactaaccattctcttcatgaaaagatattaaaagatgaaacattcatagaaaacaaacatacgattaattaccttgaaaaagaatttttaaagaaaaaatga

SEQ ID NO: 5123 - protein, 448 aa, uncultured marine gamma proteobacterium EBAC20E09
MSFKVLIANRGEIALRALRACRELGIKTVGVYSEGDRDLKHLRFVDESVCIGPASPADSYLNIPSILSAAELTEVDAIYPGYGFLAENHEFAEQCNKSGFKFIGPSSETIKTMGDKITAKNFVEKFNIPTVPGYSKDLPDDESRLKKIVDGIGYPIILKATAGGGGRGMRVVTNENDLLDSLKITKQEALNAFGNDKVYIEKFIQKPRHIEVQIIGDGKGNAIHLGTRDCSLQRRHQKIIEEAPALDLDADSLKILLDACVHLCKEINYEGAGTLEFLYENKEFYFIEMNTRIQVEHPVTEMITGFDIVKAQIKIALGINYDLDQRLITFKGHSIECRINAEDPETFEPCPGKITKMHTAGGFGIRYDSHIYGGYNVSPFYDSLLAKIITQANSRKTAIKRMLSALDEFYVEGIKTNHSLHEKILKDETFIENKHTINYLEKEFLKKK

SEQ ID NO: 5124 - DNA, 1338 bp, Thermus thermophilus
  CDS (1)..(1338)
atgaagaaggtcctgatcgccaaccggggtgagatcgccttaaggatcatccgggcggcccgggagctcgggatcaagacggtggtggcccactccaccgccgacgagaagagccttcccgtcctcctcgccgacgaggccatctgcatcgggccgcccccctcggggcagagctacctcaacatccccaacatcctctccgcggccatcgtcaccggggccgacgccatccatccgggctacggcttcctggcggagaacgccaccttcgccgagatgtgccgggagcacgggatcaccttcatcggccccaccccggagaacatgaaggccctgggggacaaggccacggcgaggaaggtggcccgggaggcgggggtgcccacggtgccgggcacggacgagctgagcagcgtggaggaggccaagcgggcggcccaggagatcggctaccccgtgatcctcaaggcgagcgcgggaggcgggggccggggcatgcgcgtggtccacacggaggaggagctggagcgggcggtgctccaggcccaggaggaggcccgggccgccttcgggaaccccgccgtctacctggagaagtacattgaggagcccaagcacattgagatccaggtcctgggggacggggaacgggtggtccacctttgggagcgggactgctccatccagcgccgccaccagaagcttctggaggaggccccgagcctcctccccgaggagacccgccgggccatcgccgaggcggcgcggcgcctcgccgagcgcgtgggctacgtgtcggcaggcacgatggagttcctggtggacaaggaggggaacttctacttcattgagatgaacacccgcatccaggtggagcaccccgttaccgagatgatcacggggattgacctggtccaggcccagttccgcatcgcccagggggagaagctctggctcaagcaggaggagatccaggtccgggggcatgccatagaggtccgggtgaacgccgaggacccggagaagggcttcaggccctccatcggcaaggtggaaaccctcctcttccccggggggcccggggtgcgggtggacagccacctctacacgggctaccagatccctccccactacgacagcctcatcgccaagatcatcgtctgggcccccacccgggaggaggccataaggcgcatggagcgggccctctccgagacggtgattgaggggccgggcctcaagaccaccatccccttccaccagaaggtcctccagaacgccttcttccgcaggggggccgtgtacaccaacttcgtggcccggcggatggagatgtag

SEQ ID NO: 5125 - protein, 445 aa, Thermus thermophilus
MKKVLIANRGEIALRIIRAARELGIKTVVAHSTADEKSLPVLLADEAICIGPPPSGQSYLNIPNILSAAIVTGADAIHPGYGFLAENATFAEMCREHGITFIGPTPENMKALGDKATARKVAREAGVPTVPGTDELSSVEEAKRAAQEIGYPVILKASAGGGGRGMRVVHTEEELERAVLQAQEEARAAFGNPAVYLEKYIEEPKHIEIQVLGDGERVVHLWERDCSIQRRHQKLLEEAPSLLPEETRRAIAEAARRLAERVGYVSAGTMEFLVDKEGNFYFIEMNTRIQVEHPVTEMITGIDLVQAQFRIAQGEKLWLKQEEIQVRGHAIEVRVNAEDPEKGFRPSIGKVETLLFPGGPGVRVDSHLYTGYQIPPHYDSLIAKIIVWAPTREEAIRRMERALSETVIEGPGLKTTIPFHQKVLQNAFFRRGAVYTNFVARRMEM

SEQ ID NO: 5126 - DNA, 3678 bp, Desulfovibrio vulgaris
  CDS (1)..(3678)
atggaagaggttcggggcaaggctattctggttgcaaaccggggcatcccggcacgccgtatatgccgctccatacgcgaacgtttcgacgccgtggctgtcatgaccgccactgatgtcgacaagacctctccggccgcctccgccgctcaggaactcctgctgctcggtgccgaccccagagcgtatctcgatatcgaccgcatcatcagcctcgcaaagcagcgtggcgtggtcgctatccatcccggttggggtttcgcctccgaagacgaccgttttccctccaagtgccacgaggcggggctgaccttcatcggttccaccgccgaggccatgaacctgctcggcaacaaggtgcaggttcgcaaactcgcccgcaagctcggtgtgcctgtcgtaccggggtctgaaggtgcagtcgacatccccacggcccgcaagctcatcgacgagatcggcctccccatcatgctcaaggcggaagggggcggtggcggtcgtggtattttcgccatccgtgacgagagcgaactcgacgatgccttcttcaaggcgtccaccatggcgcaggcgtcgttcggcaatccgcggctcttcgtcgagaagtatctcgaatcggtgcgccatatcgagattcaggtcattgccgacatgtacggcaatgccttcgcctttgacgaacgcgactgttccatccagcgcaatcaccagaagctcatcgagatcacgccttcgccgtggccgggcatcaccccggagctgcgcgaaaagctcaaggaatactcgaagatgctcgtccgtgaggtcggctaccactcgctggcgacggtcgagttcctggtcaccgcctctggcgaggcctatctcatcgaggtcaatacccggcttcaggtcgagcatggcatcaccgaatgccgctacggcatcgaccttgtggaagagcagattgccgtggccttcggtgcacagctgcgcctcacggaagagaacaccaagcccgtccaccacgccatgcaggttcgcatcaactgcgaagacccgcaggcgggcttctcgcccaactccgggcttgtcagccgctatgtttcgcccggcggccccggtgtgcgcctcgactcgaacatgtgcgctggctacgagtttccgcccaactacgactcggcgggctcgctgctcatcacgtacgggcagggctggcagaaggtcctgggcatcatggagcgttgtctgtccgaatacatcatcggcggactcaagacgaccatcccgttctacaagcaggtgatgaagcacccgcgtttccgcgctggcgacttcgacaccaacttcatcgccgagacccctgaactgatgtgctacaccgacctcgcccccgaaggcgaacggcttgcgcgtcttgtggcggagatatccgccaagggcttcaacccctatgtccagctgggcgagtaccgcacccgtgaaacccctcggatgcccaagttcgagccggtgttgccgcacattcccggacaggttcgacgcaacccttcgccgtatccgcatggtgaccggggagctttgctcgactacctgcgtgacgccggacatgtgcatttcaccgacaccacggcgcgtgacatcacccagtcgaacagcggcaaccgcttccgccttgccgaagatgcgctcatggggccgtatctcgacaactgcaacttcttctcgcttgagaacggtggcggagcacacttccatgtcgccatgatggcgaacatgacctatccgttcagtgaagccgccgaatggaacaagttcgcccccaagacgctcaagcagatactcatccgctcgaccaacgtgctgggctacaagccccagccccgcaacctcatgcgcatcaccggcgagatgatctgtgaacattaccaggtcatccgctgtttcgacttcctcaaccacgttgagaatatgcgccccttcgccgaggtcgcactcaaccggaacgacgtggtgttcgagcctgcgctctcgctctcatgggcgcgtggcttcgatgtggcgcattacgtgggcgtgacggaggcgattctgcgcatggtgggcgatgtcgcgggcttcggtcccgaacaggcatcccgttccatcatcctcggcctcaaggacatggcgggtgtgtgccccccccggttcatgaccgaactggtcagcacgcttcgcaagcgttggccgtcccttgtcctgcattgtcatcgccactacacggacggactgttcgtgcccgcggtgggggcggctgccaaggccggggcccacatcgtcgacacggccataggtgcgtcggtccgctggtacgggcagggcgatgtgctttccatggctgcctaccttgaggatgaactcggcctgcggaccaacctcaacaagaccatgatccgcgactgcaacttcgtgctcaagcaggtgatgcccttctacgacaggtactgcgcaccctacttccagggcatcgattacgacgtggtcgagcacggcatgcccggcggggcgacgtcgtcgtcacaggcaggggccatgaagcagggctacatccacctgttgccctacatgctcaagttccttgcgggtacgcgcaagatcgtgcgctaccacgacgtgacgcccggttcccagattacctggaatacggcgttccttgccgtcaccggtgcccacaagcgcggtggcgaagatgaggttcgctaccttcttgaagtcctcgacaacgtgacgcggcatcccgagagcgacctgtctgaagacatgaagaaggcgcgtctcgccatctatcaggactgcaacgacgccttccgcgaccttctgctcggcaagttcggcaggctgcctctcggcttccccgacgagtgggtgtaccgcagcgccttcggcaatgaatggcgcaaggccatggcaagcagaaccgaagcctctccgcttgactcgcttgcccctgtcgatctcgcactggaagaacgcgggttcatcgacatcgtgcggcgcaagcccaccgaggaagagttcgtcatgtacctgaaccaccccggtgacgccatcaagaccatccagttcaaggcacggttcggcaatgccaacaacctgccccttgatgtctggttcgaaggccttcagcccggcgaggaactcaacttcaccgacagcagcggcaagccgcatcatctcgtcatcctcagcatctcgcgtcccaacgacgcagggtacagcgtcatccgctatgtgctcgactccgagatcatgagttgcgaggcgcaggtgaagcagtccagcgtcgccgacatcaagggcgttgagatggccgacagggccaatcccatgcatgtggctgcgccgagcaacggagacctgtgggtgatgtacgtccaccccggtgatgtggtaaagaagggcgaagagttgttcaacgtgtccatcatgaagcaggagaaggcggtacttgcccccatggacgccatggtcaagcgcgtgctcaagaccgccgactaccgcgagagcaagcagatggtggccgtccgcgaaggtgaactcgtcgtcgagctctgccccatccccaaaatgtgccctaatcatgcgtgtggacatcccataacgcttgacggaatcgatttctgcccctactgcggagaacgtctcgacgcgtag

SEQ ID NO: 5127 - protein, 1225 aa, Desulfovibrio vulgaris
MEEVRGKAILVANRGIPARRICRSIRERFDAVAVMTATDVDKTSPAASAAQELLLLGADPRAYLDIDRIISLAKQRGVVAIHPGWGFASEDDRFPSKCHEAGLTFIGSTAEAMNLLGNKVQVRKLARKLGVPVVPGSEGAVDIPTARKLIDEIGLPIMLKAEGGGGGRGIFAIRDESELDDAFFKASTMAQASFGNPRLFVEKYLESVRHIEIQVIADMYGNAFAFDERDCSIQRNHQKLIEITPSPWPGITPELREKLKEYSKMLVREVGYHSLATVEFLVTASGEAYLIEVNTRLQVEHGITECRYGIDLVEEQIAVAFGAQLRLTEENTKPVHHAMQVRINCEDPQAGFSPNSGLVSRYVSPGGPGVRLDSNMCAGYEFPPNYDSAGSLLITYGQGWQKVLGIMERCLSEYIIGGLKTTIPFYKQVMKHPRFRAGDFDTNFIAETPELMCYTDLAPEGERLARLVAEISAKGFNPYVQLGEYRTRETPRMPKFEPVLPHIPGQVRRNPSPYPHGDRGALLDYLRDAGHVHFTDTTARDITQSNSGNRFRLAEDALMGPYLDNCNFFSLENGGGAHFHVAMMANMTYPFSEAAEWNKFAPKTLKQILIRSTNVLGYKPQPRNLMRITGEMICEHYQVIRCFDFLNHVENMRPFAEVALNRNDVVFEPALSLSWARGFDVAHYVGVTEAILRMVGDVAGFGPEQASRSIILGLKDMAGVCPPRFMTELVSTLRKRWPSLVLHCHRHYTDGLFVPAVGAAAKAGAHIVDTAIGASVRWYGQGDVLSMAAYLEDELGLRTNLNKTMIRDCNFVLKQVMPFYDRYCAPYFQGIDYDVVEHGMPGGATSSSQAGAMKQGYIHLLPYMLKFLAGTRKIVRYHDVTPGSQITWNTAFLAVTGAHKRGGEDEVRYLLEVLDNVTRHPESDLSEDMKKARLAIYQDCNDAFRDLLLGKFGRLPLGFPDEWVYRSAFGNEWRKAMASRTEASPLDSLAPVDLALEERGFIDIVRRKPTEEEFVMYLNHPGDAIKTIQFKARFGNANNLPLDVWFEGLQPGEELNFTDSSGKPHHLVILSISRPNDAGYSVIRYVLDSEIMSCEAQVKQSSVADIKGVEMADRANPMHVAAPSNGDLWVMYVHPGDVVKKGEELFNVSIMKQEKAVLAPMDAMVKRVLKTADYRESKQMVAVREGELVVELCPIPKMCPNHACGHPITLDGIDFCPYCGERLDA

SEQ ID NO: 5128 - DNA, 1416 bp, Desulfovibrio vulgaris
  CDS (1)..(1416)
atgcagacgaacgatcataaggtgctggtggcgaacagaggggaaatcgctacccgtatcgtccgggcctgccaccggctgggtctggagttcacctgcgtgtacacggcggaggacgccgcctcaggccatgtgagactcgcccgtgaactgggcggggccaacagcctctatcgggtgtcctcctatcatgatgccaacgaactactcgccgtcgccgacgacgcgggctgcacagcggtgcaccccggctacggcttcttcgcagaggactaccgcttcgcgcggcgcgtggcgcagcgtgagcgcaagctcatcttcataggcccctcgtggcgcgtcatccgcgaactgggcgacaagatcaacaccaagcgcctcgcgcgcagtctcggcgtgcccacggtgccggggtctgacaagcccatctacgatgaacttgaagccgaaaaggtcgcacagagcctttacgagtttcaggagcagcagggcatccgcaggcctctcgtgctggtcaaggcctctgccggcggcgggggcatgggcatcgaagaggtctacgacctcgacctgttcaagtcggtgtatcgccgcatccgcaactacgccctgcgtcagttcaaggacgaaggggtgctcatcgagcagcgcatccgcgacttcaaccacctcgaagtgcagatcgtctccgacaggacagggcgcaatcccgtccatttcggcacgcgcaactgctccatccagtccatcggcctgcagaagcgtatcgaggttgcgccggggttcgaccccacctccatcgagtacgggttcgacgcggcgcaggtgctgcgcgacatcacctaccattcgctcgccatggcgcggaaggtcggctacgacaacgtgggtacgtgggaatggatcgtcacacgtgacggtcatcccttcctcatggaggtcaacacgcgcatccaggtcgagaacggcgtctccgcccgtatcgcgagggtgaacgggcaagaggtcgacctcatcgccgaacagattcgcatcggactcgggcagcctctcggctacggtcaggaggacatcaccttcgaaggtgtcggcatcgagtaccgcctcatcgctgaagaccccgacaaccggttcacgccgtgggtcgggcgtatcgacgccttcggctggcccgaagaggactgggcgcgcatgtatacgcatgtccccaccgaagagccctacgacatccccaccgaattcgaccccaacctcgccctcgccatcatctggggcaaggacctcgaagaggtgaaacggcgcggcgtcagcttccttgaaggactgacgttgcaggggcagaacaaggcgggcgatgagctgcgttccaacgtgaacttcctgcgcgacaacaccggccgcatcctgcggttctag

SEQ ID NO: 5129 - protein, 471 aa, Desulfovibrio vulgaris
MQTNDHKVLVANRGEIATRIVRACHRLGLEFTCVYTAEDAASGHVRLARELGGANSLYRVSSYHDANELLAVADDAGCTAVHPGYGFFAEDYRFARRVAQRERKLIFIGPSWRVIRELGDKINTKRLARSLGVPTVPGSDKPIYDELEAEKVAQSLYEFQEQQGIRRPLVLVKASAGGGGMGIEEVYDLDLFKSVYRRIRNYALRQFKDEGVLIEQRIRDFNHLEVQIVSDRTGRNPVHFGTRNCSIQSIGLQKRIEVAPGFDPTSIEYGFDAAQVLRDITYHSLAMARKVGYDNVGTWEWIVTRDGHPFLMEVNTRIQVENGVSARIARVNGQEVDLIAEQIRIGLGQPLGYGQEDITFEGVGIEYRLIAEDPDNRFTPWVGRIDAFGWPEEDWARMYTHVPTEEPYDIPTEFDPNLALAIIWGKDLEEVKRRGVSFLEGLTLQGQNKAGDELRSNVNFLRDNTGRILRF

SEQ ID NO: 5130 - DNA, 3441 bp, Listeria monocytogenes str
  CDS (1)..(3441)
atgaatcgaattaaaaaagtattagtagcaaaccgcggagaaattgctatccgtgttatgcgtgcgtgtactgaactcaaaatcaaaacagtggctatttattcacaagaagataccggaagttttcaccggtataaatcagatgaagcttatctggttggagcagggaaaaagcctattgatgcgtatctagatatcgaaaacataatagagattgctaaagaatctggtgcagacgcgattcatccgggatatggtttcttgtccgaaaacattgaatttgctcgtcgttgtgagcaagaaggcattattttcgttggtcctaaatcaaaacacctagatatgtttggtgataaaatcaaagcaaaagaacaagctctattagctgatattccagtaattccgggaagtaatggacccgtggctggtattaaagaagtagaagaatttggtgagaaaaacggttacccattaatgattaaagcttctcttggaggcggcggtcgtggtatgcgtgtcgtagaatcaaaagaacatgtcaaagaaagctttgaacgtgcatcctcagaagcaaaagcggcatttgggaacgatgaagtatacgtagaaaaatgcgtgatgaatccgaaacatatcgaagtacaaattcttggtgacacccatggcaacatcgttcatttatttgaacgtgattgttctatccaacgtcgtcatcaaaaagtagtagaggtagcgccatgtaatgcgattacttctgaactacgtaaccgtatctgtgatgctgcagtaaaattaatgaaaaatgttgattacattaatgctggaacagttgaatttttagtggaaggcgatgatttctactttatcgaagtaaatcctcgtgtccaagtggagcatacaattactgaaatgattacagggattgatattgttcaatcacaactattcattgcagatggttacgcgcttcacgaccaactagtagctattcctaagcaagaggatatccatattcacggttctgctattcaaagccgtattacaacggaagatccacttaataactttatgccagatactggtcgagtagatacgtatcgctctacaggtgggtttggagttcggttggatgctggtaacggcttccaaggaacagtagtaacaccattttatgattccttacttgtaaaattatgtacttggggaatgacattcgaacaagcaacgcgcaaaatgcgtcgtaacttaattgaattccgtatccgtggtgtcaaaacgaacattcctttcttattaaatgttgttcgtcatccggattttgcaagtggtaattataatacaagctttattgatacaacaccggaactatttaaattcccacatattcgcgaccgtggtacaaaaacgttgcgttatattggtaatgtaacggttaatggtttcccaggaattaagcaccgtgataaacctgtatatgcagaaccacgcttgccaaaaattccgtatggttcgcaaatctctccaggtacaaaacaaattttggatgcaaaaggtccagaaggcgttgtagactgggtgaaaaaacaagaagaagtgctcttaacagacactacacttcgggatgcgcaccaatctttacttgcaacacgtgttcgctcgaaagacattttccaaatagcagatgcgatggctcatttattaccaaacatgttttcctttgaaatgtggggtggcgcgacttttgacgtggcatatcgtttcctaaatgaagatccttgggtgcgcctagagacacttagaaaacaaattccaaacgtgatgttccaaatgttacttcgcggagctaatgcagttgggtataaaaactatcctgacaatgttatccgtgaattcgttaagcaatcagcacaatccggtgtggatgtattccgcgtgtttgacagcttaaactggatcaaaggcatggaagtgtccattgatgctgttcgtgaagcagggaagatcgtagaggctgctatctgctatacaggagatatcgatgatgacacaagaacgaaatataccatagattactataaagatatggcgaaagagctcgttgctcaaggcacgcatatcctaggaatcaaagatatggctgggcttttaaaaccacaagcggcataccgtttgattggcgaattaaaagatacagtagatgttccaatccaccttcacacgcatgacacaagcggcaacggtatttatacttacgcagcagctgtcagtgctggcgttgacattgtggacgtggcatcaagcgcaatgagtggggctacaagccaaccaagtatgactggtctttattacggattagtgaatggtaatcgtcaaacgaatttagacgctcaaaattcccaaatcattaatcattactgggaagatgttcgtcactattacaaagactttgacaatgcacttaattcacctcaaacagaagtatacattcatgaaatgccaggtggtcaatatactaaccttcaacaacaagccattgcagttggacttggcgatcgttgggacgaagtgaaagaaatgtatacagtggttaatcaaatgtttggtgatatcgttaaagtaacaccttcttccaaagttgttggagacttagcactatttatggttcaaaatgaattatccgaagaagatgtatacgaaaaaggcgataccattgatttcccagattccgttatcgaattctttatgggggaaattggtcaaccatacggcggcttcccagaaaaacttcaaaaactagtactcaaaggacgtacaccacttacagatcgtccaggcgctttaatggaaccagttaactttgttgaagtcaaagcagaattaaaagaaaaaatgggttatgaaccaactgaaaaagatgtcatttcctatattttgtatccaaaagtgttcttagattatcaagaaatgattaataaatatggtgatgtaacagtccttgatacaccaacattctataaaggaatgcgtttaggggaaacaatcgaagtagaacttgaaaaaggaaaaatccttttaatcaagctaaattctattggtgaaccaattgcggatggcacacgtgttatctattttgaattaaatggacaaccacgtgagattaacatccaagatatgaacgttcaatccactgttattgcacgccgtaagattgatacaactaaccctgaacatgttggagctacaatgacaggttcagtcattcaagtagttgttaaaaaaggcgactctgtgaaaaaaggtgatccactactaatcacagaagcaatgaaaatggaaacaacgattcaagcgcctttcgatggagaagttagcagcatttatgtttctgacggcgatactatcgaatctggtgatcttttaattgaagtaaacagaatttaa

SEQ ID NO: 5131 - protein, 1146 aa, Listeria monocytogenes str
MNRIKKVLVANRGEIAIRVMRACTELKIKTVAIYSQEDTGSFHRYKSDEAYLVGAGKKPIDAYLDIENIIEIAKESGADAIHPGYGFLSENIEFARRCEQEGIIFVGPKSKHLDMFGDKIKAKEQALLADIPVIPGSNGPVAGIKEVEEFGEKNGYPLMIKASLGGGGRGMRVVESKEHVKESFERASSEAKAAFGNDEVYVEKCVMNPKHIEVQILGDTHGNIVHLFERDCSIQRRHQKVVEVAPCNAITSELRNRICDAAVKLMKNVDYINAGTVEFLVEGDDFYFIEVNPRVQVEHTITEMITGIDIVQSQLFIADGYALHDQLVAIPKQEDIHIHGSAIQSRITTEDPLNNFMPDTGRVDTYRSTGGFGVRLDAGNGFQGTVVTPFYDSLLVKLCTWGMTFEQATRKMRRNLIEFRIRGVKTNIPFLLNVVRHPDFASGNYNTSFIDTTPELFKFPHIRDRGTKTLRYIGNVTVNGFPGIKHRDKPVYAEPRLPKIPYGSQISPGTKQILDAKGPEGVVDWVKKQEEVLLTDTTLRDAHQSLLATRVRSKDIFQIADAMAHLLPNMFSFEMWGGATFDVAYRFLNEDPWVRLETLRKQIPNVMFQMLLRGANAVGYKNYPDNVIREFVKQSAQSGVDVFRVFDSLNWIKGMEVSIDAVREAGKIVEAAICYTGDIDDDTRTKYTIDYYKDMAKELVAQGTHILGIKDMAGLLKPQAAYRLIGELKDTVDVPIHLHTHDTSGNGIYTYAAAVSAGVDIVDVASSAMSGATSQPSMTGLYYGLVNGNRQTNLDAQNSQIINHYWEDVRHYYKDFDNALNSPQTEVYIHEMPGGQYTNLQQQAIAVGLGDRWDEVKEMYTVVNQMFGDIVKVTPSSKVVGDLALFMVQNELSEEDVYEKGDTIDFPDSVIEFFMGEIGQPYGGFPEKLQKLVLKGRTPLTDRPGALMEPVNFVEVKAELKEKMGYEPTEKDVISYILYPKVFLDYQEMINKYGDVTVLDTPTFYKGMRLGETIEVELEKGKILLIKLNSIGEPIADGTRVIYFELNGQPREINIQDMNVQSTVIARRKIDTTNPEHVGATMTGSVIQVVVKKGDSVKKGDPLLITEAMKMETTIQAPFDGEVSSIYVSDGDTIESGDLLIEVNRI

SEQ ID NO: 5132 - DNA, 3516 bp, Oleomonas sagaranensis
  CDS (1)..(3516)
atgttcaagaaaatcctgatcgccaatcggggcgagatcgccgcgcgcgtcatcaagacggccaggaagatgggcatcgccaccgtggcggtgcattccgaggccgaccgtttcaccctgccggtgctggcggcggacgaggcgatctgcctcggcccggcgccggccaaggaaagctatctccgggccgaggccatcgtgcaggcctgtatcgacacgggcgccgaggcggttcatcccggctatggcttcctgtcggaaaacgccggcttcgccgaggcgctggcggcgaaaggcatccgcttcatcggcccccggcccgaacatctgcgcgatttcggcctgaagcataccgcgcgggcgctggcggaggcggcgggcgtgccgctgctgccgggcaccggtatccttctgtcggccgaggaagcgctggccgccgcccatgagatcggctacccggtcatgctgaagagcacggcgggcggcggcggcatcggcatgtcgctgtgccacgacgcgtccgaattgcaggcccgcttcgaggcggtgcagcgcatggcctcctcctccttcggcgatgcccgggtctatatcgagcgtttcgtttcgaccgcccgccatgtcgaggtgcagatcttcggtgacggcaagggtaacgtggtcgcccttggcgagcgggactgctcgcttcagcgccggaaccagaaggtggtggaagagacgccggcccccggcctctcgcccgagctgcgcgcgcggttgcatgcggcggccgtcgccctgggcaaggcggtcgcttatgaatccgccggcacggtcgaattcatctatgacgttgcgcgcggcgatttctccttcctcgaggtgaacacgcggctgcaggtcgaacacccggtgacggaatcggtcttcggcgtcgacctcgtcgaatggatgatccgccaggcggcgggcgaattgctgctgccggcgcaaggctcgctggtacctaggggcgcggccatcgaggtccggctctatgccgagaatccgcaggccaatttccgcccgcagaccggccgcctgaccgaagtcgccttccccgacgatatccgggtcgatacctgggtcgcgacgggaacggaggtcacgcccttctacgatcccatgctggccaaggtgatcgtcaccggcgcggaccggccggcggccatcgccgccctgtccgatgccctggcgaagaccaaggtctggggcatcgagaccaatctcgcctatcttcgcgccatcgccgccagcgatgtcttcaccagcggcgcggtttcgaccgccgcccttggccaattcgtcttcaccgcgccgacgatcgaggtcatcgtggccggcgcgcagaccagcgtgcaggactggcccgggcgcctcggcctctgggatgtcggcgtgccgccgtccggtccgttcgacgaccggtcgttccggctggccaaccgcatcctcggcaatgccgaaggcgcggcggggctggaatgcaccctgagcggtcccacgctgaaatttcatggcgatgccctgatcgccctcgccggggcggagatgcccgcggcgctcgacggcgtggcggtccccatgctgaccgcgatcccggtgaaggcgggccagaccctcagccttggccagatcaagggcgcgggtcagcgcacctatctcgccgtccggggcggtattgacgggccgaagttcctcggcgcccgggcctgtttctcgctcggccagttcggcggccatgccaccggcgtcctcaaggcgggcgatacgctgcatatcgcggccgagacggcgggcgagccgatgccggcggacgagaagccattgattacccgcgactgggtgatcggcgtccactacggcccccatggcgcgcccgatttcttccaggacgcggatatcgacgatctcttcgccgcgacctatgaggttcacttcaattcggcgcgcacgggcgtccgcctgatcgggccgaagccgcgctgggcaagggcggacggtggggaggcggggcttcacccctccaacatccacgacaatgcctatgccatcggcgccatcgactttaccggcgacatgccgatcatcctcgggccggacggccccagcctcggcggtttcgtctgcccggcggtgatcgcgcgcgacgaattgtggaaggccggccagttgaagccgggcgacaaggtgcgtttcgtgccccacggcatggccgcgccccaggtgatcacctcgaaggatatcggcaccccgatcctcggcacgatagacggcgggccggtgcccgtcgtctatcgccgggcgggcgatgattaccttctggtcgaatatggcccgatggtgctcgacatcgcgctgcgcctgcgcatccacctgctggcccaggcagtgcgcgaggcgagactgccggcgatcatcgacctgacccccggcatccgctcgctgcagatccattatgacagccgcgtgctgaagaccgcgaccctggtggcggccctgcgcgagatcgaggcgggcctgcccccggcggaagcggtgaaagtgccgagccgcatcgtccatctgcccctgtcgtggaacgatccgtcgatccagctcgccgcgcggaaatatcaggaactggtgcggccgaacgcgccctggtgcccgtcgaacatcgagttcatccgccgcatcaatggcctcggcagcgtcgacgacgtgcagaacatcatcttcgacgccagctacctggtgctcggtctcggcgacgtttacctgggcgcgccggtcgcgaccccggtcgatccgcgccaccgcctggtgacgaccaagtacaacccggcccgcacctggacgccggaaaacgccgtcggcatcggcggcgcctatatgtgcatctacggcatggaagggccgggcggttaccagctcttcggccgcacggtgcagatgtggaatgcctggcggacgacgccggtgttcacgccgggccatccctggctgctgcgcttcttcgaccagatccgcttcttccccgtgtcggagcaggaactgatcgaggcgcgcgaagctttcccccatggccgctatccggtgcggatcgaggaaaccaccttcgactacgcgcagcacgccgccttcctcgcggccgaaaggccggccatcgaggcggccaaggcccgccagcagaccgccttcgaggtggagcggcaggactggaaggcgcggggcctcgacagtttcgtggtcgaggacggccccgccgcgagcgatgccgacgtgcccgagggccagaccccggtcgaggcgcaggtgaccggcaatgtctggaagatcattgccgaggaaggcactaatgtcgccgccggcgacatcgtggtgatcgtcgaatcaatgaagatggaaatggaaatcaggagcccggtcgcaggcaaggtcacggcattgcgctgccagccgggccggaccgtgcaggcgggccagatcgtcgccctgatcgaagcggcctga

SEQ ID NO: 5133 - protein, 1171 aa, Oleomonas sagaranensis
MFKKILIANRGEIAARVIKTARKMGIATVAVHSEADRFTLPVLAADEAICLGPAPAKESYLRAEAIVQACIDTGAEAVHPGYGFLSENAGFAEALAAKGIRFIGPRPEHLRDFGLKHTARALAEAAGVPLLPGTGILLSAEEALAAAHEIGYPVMLKSTAGGGGIGMSLCHDASELQARFEAVQRMASSSFGDARVYIERFVSTARHVEVQIFGDGKGNVVALGERDCSLQRRNQKVVEETPAPGLSPELRARLHAAAVALGKAVAYESAGTVEFIYDVARGDFSFLEVNTRLQVEHPVTESVFGVDLVEWMIRQAAGELLLPAQGSLVPRGAAIEVRLYAENPQANFRPQTGRLTEVAFPDDIRVDTWVATGTEVTPFYDPMLAKVIVTGADRPAAIAALSDALAKTKVWGIETNLAYLRAIAASDVFTSGAVSTAALGQFVFTAPTIEVIVAGAQTSVQDWPGRLGLWDVGVPPSGPFDDRSFRLANRILGNAEGAAGLECTLSGPTLKFHGDALIALAGAEMPAALDGVAVPMLTAIPVKAGQTLSLGQIKGAGQRTYLAVRGGIDGPKFLGARACFSLGQFGGHATGVLKAGDTLHIAAETAGEPMPADEKPLITRDWVIGVHYGPHGAPDFFQDADIDDLFAATYEVHFNSARTGVRLIGPKPRWARADGGEAGLHPSNIHDNAYAIGAIDFTGDMPIILGPDGPSLGGFVCPAVIARDELWKAGQLKPGDKVRFVPHGMAAPQVITSKDIGTPILGTIDGGPVPVVYRRAGDDYLLVEYGPMVLDIALRLRIHLLAQAVREARLPAIIDLTPGIRSLQIHYDSRVLKTATLVAALREIEAGLPPAEAVKVPSRIVHLPLSWNDPSIQLAARKYQELVRPNAPWCPSNIEFIRRINGLGSVDDVQNIIFDASYLVLGLGDVYLGAPVATPVDPRHRLVTTKYNPARTWTPENAVGIGGAYMCIYGMEGPGGYQLFGRTVQMWNAWRTTPVFTPGHPWLLRFFDQIRFFPVSEQELIEAREAFPHGRYPVRIEETTFDYAQHAAFLAAERPAIEAAKARQQTAFEVERQDWKARGLDSFVVEDGPAASDADVPEGQTPVEAQVTGNVWKIIAEEGTNVAAGDIVVIVESMKMEMEIRSPVAGKVTALRCQPGRTVQAGQIVALIEAA

SEQ ID NO: 5134 - DNA, 2016 bp, Caenorhabditis elegans
  CDS (1)..(2016)
atgcttggtgtattccaaaaacgatgtgcctcaactgcccctctaattcgtcccattcaacgggttttagttgcaaatcgtggagaaatcgccattcgcgtccaaaataccgctcgtaaaatgggaattgagacagttgctgttttttctgacgcagaccgtaattccctctttgttaaaaaagctgacaaggcataccacatcggccctcctcttgcagcggaaagttatctgaatatggacaaaattatcaacagtgcattgcgatctggagcacaagctattcacccaggatacggtttcctatctgaaaatgctggattcgctgaaaaatgtgctcaggccggccttgtttttattggaccaccagcccaagctatcagggatatgggagccaagaatgtatcgaagcaaatcatggaagatgctaaagttcctgtagtaaaaggattccacggagaagatcaatcagatgctaatttgaaaaagaaatcagcagaaatcggctacccggttatgctgaaggctgtctatggtggaggtggaaaaggaatgagaattgcgtggaacgaggctgaattcgaagaaaaactggcttcagctcgtaacgaagctaagaagtcgtttggaaacgatgaaatgctcgtggaaaagtttgtcgagaagccgagacacgttgaagtacaagttttcggagatcaccatggaaactatgttcatttatgggaaagagattgctccgttcaaagacgtcatcagaaaattattgaagaagcaccagcgccaaatatggaacatgatactcgtgtaaaactcggagaatcagctgttcgtgctgcggcggctgtgggatatgttggagcaggtaccgtcgagttcatcatggacccgcgtggcgaattctactttatggaaatgaacactcggcttcaagtcgaacatcccgtcagtgaagctatcacaggcacggatcttgttgaatggcaattacgggtagctcaaggagagaagcttccactgaaacaatcagaaattccattaaacggtcatgcatttgaatgtcgtgtgtatgccgaggatactcgtaaaggagcattcatgccaactgcgggacgtcttaattatgttgacttcccggaagatgctagaatcgatacaggagttgtttctggagacgaagtatcaatccattacgatcctatgattgctaaggtggtagtgtggggccaggatcgtgctgttgctgctgcaaaattggaaagtgctttggctcgtacaagaatctcagggctacccacaaacattgactttgtccgcagagttcttgctcatcctgaatttgccgcaggaaatgtttataccgattttatccctgatcaccagaaggaactatttgctgaatctgaaactcctgctgaaatttacgttgagtcggctgtagcacatgctttggctgcccttcaaaaatcagatgcaggtgtcttccagaatttatctttctttagaatgaatttgtcaccaaaatacattttcaaaatagacggaaaagatgtcagcattagatttgattctgatagtcgcctgacagtgtcttatgatggcaacagttatgaaacacttctcaacgacattgaatcaaccacagacggatctttcaagtttacattggaagctaatggcaggcgctggagtactgtcgttaaaaatctaggaaatagtttgatggtgaatggagttggtcaaaacgaatatgaaactccacaaatccatgaaacatttgattcgttatccggaggagcagccagtcattctgccgtcgcaccaatgccaggaattattgaaaaaattcttgtgaagcctggagagcaggtaactacaggccaagcactcgtagtgatgacagcaatgaaaatggaatacatcattcgtgccccggaagactcaactgttgaacacattaagtgccaggcaggcaaaaatgttccaaaaaatgcagttttggttcaattcgcatag

SEQ ID NO: 5135 - protein, 671 aa, Caenorhabditis elegans
MLGVFQKRCASTAPLIRPIQRVLVANRGEIAIRVQNTARKMGIETVAVFSDADRNSLFVKKADKAYHIGPPLAAESYLNMDKIINSALRSGAQAIHPGYGFLSENAGFAEKCAQAGLVFIGPPAQAIRDMGAKNVSKQIMEDAKVPVVKGFHGEDQSDANLKKKSAEIGYPVMLKAVYGGGGKGMRIAWNEAEFEEKLASARNEAKKSFGNDEMLVEKFVEKPRHVEVQVFGDHHGNYVHLWERDCSVQRRHQKIIEEAPAPNMEHDTRVKLGESAVRAAAAVGYVGAGTVEFIMDPRGEFYFMEMNTRLQVEHPVSEAITGTDLVEWQLRVAQGEKLPLKQSEIPLNGHAFECRVYAEDTRKGAFMPTAGRLNYVDFPEDARIDTGVVSGDEVSIHYDPMIAKVVVWGQDRAVAAAKLESALARTRISGLPTNIDFVRRVLAHPEFAAGNVYTDFIPDHQKELFAESETPAEIYVESAVAHALAALQKSDAGVFQNLSFFRMNLSPKYIFKIDGKDVSIRFDSDSRLTVSYDGNSYETLLNDIESTTDGSFKFTLEANGRRWSTVVKNLGNSLMVNGVGQNEYETPQIHETFDSLSGGAASHSAVAPMPGIIEKILVKPGEQVTTGQALVVMTAMKMEYIIRAPEDSTVEHIKCQAGKNVPKNAVLVQFA

SEQ ID NO: 5136 - DNA, 1350 bp, Bacillus amyloliquefaciens
  CDS (1)..(1350)
atgtttaaaaaagtcctgattgccaacagaggagaaatcgccttacgaattatccgcacctgcaaacgtctcggcatcccctcggcagctgtgtattcagaagccgaccgggacgcgctgcatgtaaaagcggctgatgaggcctatccgatcggtaaatcgagagtaaatgaaagctatttacatatcgacagaatcatagaagccgccaaatccgccggagcggacgccattcatccgggctacgggcttctgtcagaaaacagcctgttcgccgaacgctgccgaaaagaacaaatcacatttatcggtccgcccggtgatatcatcgccaagatgggcagcaagatagaagcccgaaaaacgatgcaaaaagcaaaggtcccgatcgttcccggtgtttcagagccattgcccgatgttcactccgccttagccgaagcccgtgccatcggttttccggtcatgctgaaagcgtccgcaggaggaggcggaatcggcatgcagatcgtacattcagaagaagagctggccaaagcgtttgaaggcaatcaaaagcgggccgcctccttttttggagacggcgcaatgtatatggaaaaggtcattgaaaatgcccgtcatattgaaattcagatactcgcagattctttcggcaacaccgttcatctgtttgaacgtgactgttcagtacaaaggcgccaccaaaaagtgatagaagaagcgccgtcgccgtttgttgacgatgaattaagacaaagactcggtgaaaccgccattaaagccgcaaaatcgatcggctaccaaaatgcaggcacaatagaatttctcgtcgacgaaaagaaacaaatctattttttagagatgaacaccagactgcaggtggagcatccggtgacagaagaaattacaggactggatcttgtggaagaacagctgaaaattgccgctgggcaggcgctgcctttctcgcagaaagatatcaaccaccgcggtcatgcgatagaagtgcggatctatgcggaagatccggtcaccttttacccgtctcccggtaccatctcgtctttttccgttttaagacacccgtcagtgcgacacgaatgcgccgtcgaaaagggaagcgtcatttctccgttttacgatccgatgattgccaaaatggtcgtcacggcgaatacgagaaaacaagccattgaacaactgaaaaccgcccttggcgaatatcatgtagaagggattaaaaccaacattccgctgctgacaaaaattgcccattcagaagtgtttgaaaagggcgaggcaacaaccggttttttacaaacaatgaacgagggggcgtcaaaatga

SEQ ID NO: 5137 - protein, 449 aa, Bacillus amyloliquefaciens
MFKKVLIANRGEIALRIIRTCKRLGIPSAAVYSEADRDALHVKAADEAYPIGKSRVNESYLHIDRIIEAAKSAGADAIHPGYGLLSENSLFAERCRKEQITFIGPPGDIIAKMGSKIEARKTMQKAKVPIVPGVSEPLPDVHSALAEARAIGFPVMLKASAGGGGIGMQIVHSEEELAKAFEGNQKRAASFFGDGAMYMEKVIENARHIEIQILADSFGNTVHLFERDCSVQRRHQKVIEEAPSPFVDDELRQRLGETAIKAAKSIGYQNAGTIEFLVDEKKQIYFLEMNTRLQVEHPVTEEITGLDLVEEQLKIAAGQALPFSQKDINHRGHAIEVRIYAEDPVTFYPSPGTISSFSVLRHPSVRHECAVEKGSVISPFYDPMIAKMVVTANTRKQAIEQLKTALGEYHVEGIKTNIPLLTKIAHSEVFEKGEATTGFLQTMNEGASK

SEQ ID NO: 5138 - DNA, 3549 bp, Rhodopseudomonas palustris
  CDS (1)..(3549)
atgttcagcaaagttctgattgccaaccgcggcgagatcgccgggcggatcggccgcaccttgcgtcggatggggatcgcatcggtcgcgatctattcggacgccgaccggttcacccgcccaatgcgcgaggccgacgaagcggtgcgggtcggcggcgacgcagcaagcgacagctatctcaatgtcgatgccgtgatcgacgcctgcctcttaaccggcgcgcaggctgtgcatcccggctatggcttcctgtcggaaaaccgcggctttgccgaacggctgaagcagcacggcatcgccttcatcgggccgcgccccgaacatctcgaggcgttcggcctgaagcaccgcgcccgcgaattggcgcagggtagcaacgtgccgctgctgcccggcaccggactgatcgacagcatcgacgaggctctggaagccgccgcgcggatcggctttccgctaatgctgaaaagcaccgcgggcggcggcggcatcggcatgcagctctgccatgacgaagcgacgctgcgcgagcgcttcgccacggtgcagcgcaccgcccgcgccagctttggcgacgctcgggtgtacctcgaacgcttcgttgccgacgcgcggcacatcgaagtgcagatcttcggcgacggccagggcaacgtgatcgcgctcggcgagcgcgactgctcgctgcagcggcgcaatcagaaagtggtcgaggaaaccccggcgcccggcatctcggacgagatgcgggcgcggctgcatcaggccgcggtcgcgctcggccagagcgtcgcctacgaatccgccggcaccgtcgaattcatctacgacgtcgcccgcgacgaattctatttcctcgaggtcaacacccgccttcaggtcgagcatccggtcaccgaagcggtgttcggggtcgatctggtcgaatggatggtgcgccaggctgccggcgacagcccgcttgcgacctacacgccgcgtccgccgaagggcgcggcgatcgaagtgcggctctatgcggaaaatcccggcgccggcttccggccctccgccgggcggctgacgcgggtcgactttccggacgatgtgcgcgtcgacggctggatcgagaccggcgacgaggtgacaccgttctacgacccgatgctggcgaagctgatcgtccatgcggccgaccgcgacgctgcgatcgaccagatcatcggcgcgctagccgccactaccgtcgccgggatcgagaccaatctcgattacttgcgcgcgatcgcttcgtccgctctgttccacagcggcaaggtcgccaccaaggtgctggcggacttcagcttcgcagcgcgcaccatcgacgtggtggcgcccggcgcgcagtccggattgcaggagctgccgggccggctgcatctgtggcacgtcggcgtgccgccgagcggaccgatggacgagcgctcgttccgcctcgccaaccggatcgtcggcaatccggaaaccaccgcagcgttcgaactcaccgtcagcggcccgacgctgcgcttcaacgccgacgccgtggtggcgctgtgcggcgccggcatggcggcgaagctcgacggcacagcggttagtaacgacgcaccgatcgcggtgcgtgccggccaaatactggcgatcggcaagatcgagggcgcgggccaacgttgttacctcgccatccgcggcggtttcgacgcgcccgaagtgttcggttcgcgcgccgtgttcacgctcggcgcgttcggcggccacgccactggcgctctgaaggccggcgacgtgctgcatttcggttcgatcgcgccagccgcggagccgcgtgcgctgagtgacgcggagcggccggctctgacacgtgcgtggcagatcggcgtaatctacggcccccacggtgcacccgatttctttcgtgacgaagacatcgcgacgttgttcgcctccgactacgaggtgcatttcaacagcgcgcgcaccggtgtgcggctgatcggaccaaagccgcaatgggcccgcgccgacggcggcgaagccgggctgcacccgtcgaatatccacgacaacgcctatgcggtcggtgcgatcgacttcaccggcgacatgccgatcatcctcggtcccgatggccctagtctcggaggcttcgtctgcccggccgtggtggcgcgcgacgaattgtggaaggtcggccagctcaagccgggcgacaaagttcgcttcgtgccggtgatgcgcgctgatgatccggtcgcgggaccgactgccattgcggcgcccgccaagcttggctccgctatcgtcggccgccatgacgatggcgagatcccggtggtgtatcgccgcgccggcgacgacaacctgctggtcgaatacggcccgatggagctcgacatcgcgctgcggctgcgagtgcatgtgctcgccgaggcggtcgagaaggcgaaactagccggcctgatcgatctcaccccgggaatccgctcgctgcagatccactatgacagcgcggtgatgtcgcgccgcaagctgctcgacgctctggtcagaatcgagcgcgaactgccctcggtcgaggcgatggcggtgccgagccgcatcattcatctgccgctgtcttggaacgatccgcaggcggtgctagcgatgcgcaagtatcaagagctggtgcggccggatgcgccgtggtgcccgtccaacatcgagttcatccgccgcatcaacggcctcgacaacgatgacgatgtcaagcgcatcgtgttcgacgccaactacctcgtgctcggcctcggcgatgtctatctcggtgcgccggtcgccaccccggtcgatccgcggcatcgcctggtcaccaccaagtacaatccggcccgcacctggacgcccgaaaacgccgtcggcatcggcggcgcctatatgtgcatctacggcatggaaggccccggcggttatcagctgttcggccgcaccatccaggtctggaacacctggcgcaccaccgaagtgttcaagcccggccatccgtggctgctgcggttcttcgaccagatccggttcttcccggtgacgccggaagaactgctcgacgcccgcgccgcgtttccgcacggcggctatccgctcaagatcgaagagacgacgttctcctacgccgactacaaggccttcctggcgcgcgaagcccaaggcatcacggcgttcaagacccgtcagcagaccgcgttcgaggccgagcgccagcgttggcgcgacgccaagctcgacgaggtgggggaggacgacaccgcggccgcgctcggctccggcggcgacgtgccggacggctgcgtcggccaattcaccgaggcgcccggcaacgtctggaagctcaccgttgaacccggcgagcacgtcgaaatcggccagacgctggcggtgatcgagtcgatgaagatggagatcgcgattccggcgaccgcacgcggcatcgtcagagccctcaacgccaagccgggccagacgctgcgcgccggcgacctgatctgcgcgctggaggaagtgtga

SEQ ID NO: 5139 - protein, 1182 aa, Rhodopseudomonas palustris
MFSKVLIANRGEIAGRIGRTLRRMGIASVAIYSDADRFTRPMREADEAVRVGGDAASDSYLNVDAVIDACLLTGAQAVHPGYGFLSENRGFAERLKQHGIAFIGPRPEHLEAFGLKHRARELAQGSNVPLLPGTGLIDSIDEALEAAARIGFPLMLKSTAGGGGIGMQLCHDEATLRERFATVQRTARASFGDARVYLERFVADARHIEVQIFGDGQGNVIALGERDCSLQRRNQKVVEETPAPGISDEMRARLHQAAVALGQSVAYESAGTVEFIYDVARDEFYFLEVNTRLQVEHPVTEAVFGVDLVEWMVRQAAGDSPLATYTPRPPKGAAIEVRLYAENPGAGFRPSAGRLTRVDFPDDVRVDGWIETGDEVTPFYDPMLAKLIVHAADRDAAIDQIIGALAATTVAGIETNLDYLRAIASSALFHSGKVATKVLADFSFAARTIDVVAPGAQSGLQELPGRLHLWHVGVPPSGPMDERSFRLANRIVGNPETTAAFELTVSGPTLRFNADAVVALCGAGMAAKLDGTAVSNDAPIAVRAGQILAIGKIEGAGQRCYLAIRGGFDAPEVFGSRAVFTLGAFGGHATGALKAGDVLHFGSIAPAAEPRALSDAERPALTRAWQIGVIYGPHGAPDFFRDEDIATLFASDYEVHFNSARTGVRLIGPKPQWARADGGEAGLHPSNIHDNAYAVGAIDFTGDMPIILGPDGPSLGGFVCPAVVARDELWKVGQLKPGDKVRFVPVMRADDPVAGPTAIAAPAKLGSAIVGRHDDGEIPVVYRRAGDDNLLVEYGPMELDIALRLRVHVLAEAVEKAKLAGLIDLTPGIRSLQIHYDSAVMSRRKLLDALVRIERELPSVEAMAVPSRIIHLPLSWNDPQAVLAMRKYQELVRPDAPWCPSNIEFIRRINGLDNDDDVKRIVFDANYLVLGLGDVYLGAPVATPVDPRHRLVTTKYNPARTWTPENAVGIGGAYMCIYGMEGPGGYQLFGRTIQVWNTWRTTEVFKPGHPWLLRFFDQIRFFPVTPEELLDARAAFPHGGYPLKIEETTFSYADYKAFLAREAQGITAFKTRQQTAFEAERQRWRDAKLDEVGEDDTAAALGSGGDVPDGCVGQFTEAPGNVWKLTVEPGEHVEIGQTLAVIESMKMEIAIPATARGIVRALNAKPGQTLRAGDLICALEEV

SEQ ID NO: 5140 - DNA, 3312 bp, Rhodopseudomonas palustris
  CDS (1)..(3312)
atgccgttccgaaaactgctgatcgccaaccgcggcgagatcgcgatccgtatcgcgcgcgccgccgccgagtccggcctcactaccgtggcgatccatcccgccgatgatgcggcgtcgctgcacgtccgcatcgccgatcacgccgagcagattcccggccgcggcgcgcgggcctatctcgacatcgaggcggtgatcgtggcggcaaaggcggctggctgcgatgcgctgcatcccggctacggtttcctcagcgagaacgccgatctggcgcggcgctgcgccgaggagggcatcacgttcatcgggccgtcgccggaggcattgcggctgttcggtgacaaggttgccgccaaggagctggcgaagcgctgcggcgtgccgatcattgccggcaccatcgggccgtcgaccctggaagaggtgcaggcgttcttcgcctcgcttggcgacaagccggcggtgatgatcaaggcgatggccggcggcggcggccgcggcatgcgcgtggtcgagcgtgccgaagagctcgccgacgcctatgcgcgctgccagtccgaagccaaggcggcgttcggctatgagggcgtctatgccgagcggctgatccgcaacgcccggcatatcgaggtgcagatcatcggcgaccggcacggcaatgtcagtcagctctgggagcgcgaatgcacgatccagcgccgcaatcagaagctgatcgaaatcgcgccgagcccgtcactgtcggagggactgcgcagccgcattgttgacgcggccaagaccctcgcggcggcggcgaactacgacagcctcggtaccttcgaattcctggtcgacagcgaagccggcgagggcgacggtgccttcgccttcatcgaagccaatccgcgactgcaggtcgaacacaccgtcactgaagaggtgttatccgtcgatctggtgcgctcgcagcttgcggtcgccggcggggcgatgctgacggcgcttgggctcgatcaggcctcggtgccgcgtccccggggctttgcgatccaacttcgcgtcaacatggagacgatggacgccaaaggagcgaccaagccgaccggcggcacgctggcgatcttcgagccgccgtctggtcccggcgttcgcgtcgatacgttcggctatgctggctacaccaccagcgccgcgtacgactcgctgctcgccaaggtgatcgtgcatggccgcggcgattgggccgaggcggtcgccaaggcgtcccgtgcgctgcgtgagttcagagccggcggcgtcgttaccaacatcccgctgctgcaggcgatcctcgcgcataacgacttcaaggccaatcgcgttagcaccagcttcatcgatcgccatgtcgcggatctggtcgaggccgcgcagcagttcgatcagccgctgatcgcgacggacggtgctgacaaccggagcagcgctgccgccgcggcaagcaaggagccggtccccgagggcgcggtcgcgatcgctgcgccgctgcagggcaccgtggtggcgatcactgtcgcggaaggcgacgtggtgcggccggggcagcagctcgcggtgatcgaatccatgaagatggagcacctggtcgccgccgagcaaggcggccgcatccgccgcatcgtcgccaccgacggcgtgacgctgatgcagggcgagccgattctgtacttcgaaccgcaggaggtcgaaggcgatcacgtcgtcgccgaacaggatgtcgatctcgacgcgatccggcccgacctcgccgagatgctcgcgcggcaggccaacaccctcgatgagaaccgccccgactcggtcgggcggcggcgcaagaccaatcagcgcaccgcgcgcgagaacgtcgcgcagctcgtcgacgaaggctcgttcatggaatacggcagcctcgcgatcgctgcgcagcgccgccgccgtccgctcgacgacctgatcaagaacaccccggccgacggcctcgtcaccggtgttgccacggtcaacgccaagcagtttggcgaacacgccgcacgctgcatggtgatcgcctacgactacaccgtgctggccggcacccagggccacatgaaccacaagaagatcgaccggatgctaacactggtcgagcagtggcggatgccgctggtgttctacgccgaaggcggcggcggccggccaggcgacaccgatcggctcggcatgaccgggctcgacggcccgtccttcgtgcagttcgccaagctgtccggcctggtgccggtggtcggcatcgtctccggctattgcttcgccggcaacgccgcgatgctcggctgctgtgacgtcatcatcgccacccagaacgcctcgatcggcatgggcggtccggcgatgatcgagggcggcggcctcggcgtgtatcacccggccgaagtcggaccggtgtcgttccagtcgccgaacggcgtagtcgatattctggtgcaggacgaagaagaggcgacccgggtcgcgcagaaatatctgtcctacttccagggcgcggtcgccgagtggaaggcgccggaccagcggctgctgcggcaggcgattcctgagaaccggctgcgggtgtacgacatccgcagcgtgatcgatctgattgcggacgaagaatcggtgctcgaactgcgccgcgatttcggcgtcggcatgatcaccgccttcatccggatcgagggcaagccgttcggtctgatcgccaacaatccgaagcatctcggcggcgcgatcgacgccgacgccggcgacaaggcggcgcgcttcctgcagctctgcgacgcgttcgacattccgatcgtctcgctgtgcgacacgcccggattcatggtcggcccggaggcggagaagaccgcgatagtccgccatgtcgcgcgaatgttcgtcaccggcgccagcctcaccgtgccgctgttcggcattgtgctgcgcaagggctacggcctcggcgcgcaatcgatgatcggtggcggctttcacgcctcgttcttcactgccgcctggccgaccggagagttcggcggcatggggctggagggctatgtgcgcctcggcttccgcaaggagatggaggcaatcgccgatccggccgagcgcgaggcttactacaagaacaaggtcgcggagctgtatgccaacggcaaggcggtctcgatcgcgtcagtgttcgagatcgacaacgtgatcgatccggccgagacacggcgctgggtcatggccgggctgcgctcggtgccgactccgccagcacggaccgaacgcaagcggccttgcatcgacacatggtaa

SEQ ID NO: 5141 - protein, 1103 aa, Rhodopseudomonas palustris
MPFRKLLIANRGEIAIRIARAAAESGLTTVAIHPADDAASLHVRIADHAEQIPGRGARAYLDIEAVIVAAKAAGCDALHPGYGFLSENADLARRCAEEGITFIGPSPEALRLFGDKVAAKELAKRCGVPIIAGTIGPSTLEEVQAFFASLGDKPAVMIKAMAGGGGRGMRVVERAEELADAYARCQSEAKAAFGYEGVYAERLIRNARHIEVQIIGDRHGNVSQLWERECTIQRRNQKLIEIAPSPSLSEGLRSRIVDAAKTLAAAANYDSLGTFEFLVDSEAGEGDGAFAFIEANPRLQVEHTVTEEVLSVDLVRSQLAVAGGAMLTALGLDQASVPRPRGFAIQLRVNMETMDAKGATKPTGGTLAIFEPPSGPGVRVDTFGYAGYTTSAAYDSLLAKVIVHGRGDWAEAVAKASRALREFRAGGVVTNIPLLQAILAHNDFKANRVSTSFIDRHVADLVEAAQQFDQPLIATDGADNRSSAAAAASKEPVPEGAVAIAAPLQGTVVAITVAEGDVVRPGQQLAVIESMKMEHLVAAEQGGRIRRIVATDGVTLMQGEPILYFEPQEVEGDHVVAEQDVDLDAIRPDLAEMLARQANTLDENRPDSVGRRRKTNQRTARENVAQLVDEGSFMEYGSLAIAAQRRRRPLDDLIKNTPADGLVTGVATVNAKQFGEHAARCMVIAYDYTVLAGTQGHMNHKKIDRMLTLVEQWRMPLVFYAEGGGGRPGDTDRLGMTGLDGPSFVQFAKLSGLVPVVGIVSGYCFAGNAAMLGCCDVIIATQNASIGMGGPAMIEGGGLGVYHPAEVGPVSFQSPNGVVDILVQDEEEATRVAQKYLSYFQGAVAEWKAPDQRLLRQAIPENRLRVYDIRSVIDLIADEESVLELRRDFGVGMITAFIRIEGKPFGLIANNPKHLGGAIDADAGDKAARFLQLCDAFDIPIVSLCDTPGFMVGPEAEKTAIVRHVARMFVTGASLTVPLFGIVLRKGYGLGAQSMIGGGFHASFFTAAWPTGEFGGMGLEGYVRLGFRKEMEAIADPAEREAYYKNKVAELYANGKAVSIASVFEIDNVIDPAETRRWVMAGLRSVPTPPARTERKRPCIDTW

SEQ ID NO: 5142 - DNA, 1983 bp, Rhodopseudomonas palustris
  CDS (1)..(1983)
atgagtgtgacccgtatgttgaagctgacgcctttctccaagatcctgatcgccaaccgcggcgagatcgcgctgcgggtgatgcgcagtgcccgccggctcggctacggcgtggttgcggtgtattcggacgccgacgccgatgccgcccatgtccgcgctgctgacgaagcggtggcgatcggtggcgcgcagccgtcgcaatcgtacctgaacattcccgcaatcatcgcggcggcgaagaccgccggcgccgatgcggtgcatcccggctacggcttcctcgccgagaacgaggactttgccgcggcgtgccgcgatgcggggcttgtctttatcggaccgtccgcggaatcgatcgccgcaatgggcaacaaggccggcgccaaagagatcatgctgaaggccggcgtgccgtgcgtgccgggctatcagggcgaggaccagagcgacgctgcgatggtccgcgaagccgagcggatcggctttccgatcatgatcaaggcggtggcgggcggcgggggccgcggcatgcggctggtgaaggatgccgccgcgctgcccgacgcgctgcgcagcgcgcgttcggaggcgcaaagtgcgttcggcgatccgaccgtgatcctggagcgcgcgatcctgcagccgcgccacatcgagatccaggtgttcggcgatcgctacggggccggcattcatctcggcgagcgtgactgctcggtgcaacgccggcaccagaagctgatcgaggaggcaccgtcgccagcggtctcggaagccttgcgcgagcagatgggcgccgtggcggtgaatgccgtcaaggcgatcggttacgagggcgccggcacactggagttcctgctcgacgccgaaggcaacttctacttcatggagatgaacacccggctccaggtcgagcatccggtgaccgaggcgatcaccgggctcgatctagtcgagctgcaactgcgcatcgccgccggcgagccgctgccgttgcgccaggacgacgtgactttcaaaggccacgccatcgaggtgcggttgtgttcggaggatgccgatcacgacttcatgccgcagtcgggccgcatggcgctgtggcggatgccgccggagctgcgcgtcgagcacgcgctgcaatcgggcgccgagatcccaccgtactacgactcgatgatcgccaaggtaatcgcggtcggcgccagccgcgacgaggcgcggcgcaagttgatccatggcctcgacggcaccatcgcattcggcgtcaccaccaatcgcggcttcctggccgcctgtctgcgccacaaggcgttcgcggccggggaggcgaccacagcgttcatctcgcagcatcgcgacgaactggtccggtcgctgccggacgatgcggtgtcggcagtggcggttgctgcattgctgctctacgtcaccgattcctacgcgccgccgcatcggcccggccgctcgctggccgcggtgtttccgacccggctcaagttcgaactcgacggggtggagcaggcctgcgaagtggtgcgtgagcgcgacggcagctacgtcgtcagccacgaggggcaatcgatcagcttcgtcatcgaggagctgtccgctggcagcatccgctttcaggcccaggggctcggcgagtcagcagtcttccaccgtgatggccaccggttgttcgtgcagcggctcggcgtgcaaaatagcatcgtcgatctgacccgctcggcgccgcaaagcgcggcgcgtggcggcggtgacggcaagctgcgcgcggcgctcaacggccgcgtcgtcgcggtgctggtcaaagccggtgaccgcgtcgaggccggccagccggtgctgactctggaagcgatgaagatggagcacgtgcacacggcacctggctccggcatcatcacgatcgatgtcgccgaaggcgagcaggtcaccgccggccgcatcgtcgccgagatcgaggcggcgacttga

SEQ ID NO: 5143 - protein, 660 aa, Rhodopseudomonas palustris
MSVTRMLKLTPFSKILIANRGEIALRVMRSARRLGYGVVAVYSDADADAAHVRAADEAVAIGGAQPSQSYLNIPAIIAAAKTAGADAVHPGYGFLAENEDFAAACRDAGLVFIGPSAESIAAMGNKAGAKEIMLKAGVPCVPGYQGEDQSDAAMVREAERIGFPIMIKAVAGGGGRGMRLVKDAAALPDALRSARSEAQSAFGDPTVILERAILQPRHIEIQVFGDRYGAGIHLGERDCSVQRRHQKLIEEAPSPAVSEALREQMGAVAVNAVKAIGYEGAGTLEFLLDAEGNFYFMEMNTRLQVEHPVTEAITGLDLVELQLRIAAGEPLPLRQDDVTFKGHAIEVRLCSEDADHDFMPQSGRMALWRMPPELRVEHALQSGAEIPPYYDSMIAKVIAVGASRDEARRKLIHGLDGTIAFGVTTNRGFLAACLRHKAFAAGEATTAFISQHRDELVRSLPDDAVSAVAVAALLLYVTDSYAPPHRPGRSLAAVFPTRLKFELDGVEQACEVVRERDGSYVVSHEGQSISFVIEELSAGSIRFQAQGLGESAVFHRDGHRLFVQRLGVQNSIVDLTRSAPQSAARGGGDGKLRAALNGRVVAVLVKAGDRVEAGQPVLTLEAMKMEHVHTAPGSGIITIDVAEGEQVTAGRIVAEIEAAT

SEQ ID NO: 5144 - DNA, 1353 bp, Rhodopseudomonas palustris
  CDS (1)..(1353)
atgttcgataaaatcctgatagctaatcgcggcgagatcgccctgcgcgtgctacgcgcgtgcaaggagctcggcatcgctacggtcgcggtccactccaccgccgacgccgacgcgatgcacgtccgcctcgccgacgagagcgtgtgcatcggcccgccgccgtccaaggacagctacctcaacgtgccggcgctgctcgccgcctgcgagatcaccggcgccgatgcggtgcatccgggctacggcttcctgtccgagaacgcccgcttcgccgaaatcctctccgaccacaatcttcacttcatcggaccgaaggccgaacacatccggctgatgggcgacaagatcgaggccaagaagaccgccaagaggctcggcattccggtggtcccgggctccgacggcggggtcggcccagatgacgatgcgatggcgatcgccaaggaaatcggcttcccggtgctggtcaaagccgcagcgggcggcggcggccgcggcatgaaggtcgcccacaccgccgaagacctggcgctggcgatctccaccgccggcaacgaggccaaggccgcgttcggcgacgcctcggtgtatcttgaaaagtacctgcagaagccgcgccacatcgaaatccaggtgctcggtgacggccgcggcggtgcgatccatctcggcgagcgcgactgctcgctgcagcgccggcatcagaaggtgtgggaggaaagcccctcgccggtgatcagcccggaggcgcgcgcccggatcggcgggatctgcgccaaggcgatgcaggacatgcagtatctcggcgtcgggacgatcgagttcctgtacgaggacggcgagttctatttcatcgaaatgaacacccgcatccaggtcgagcatccggtcaccgagatgatcaccggtatcgatctggtgctggagcagatccggattgccgccggcggcgacctgccggtgacgcaggacgaaatcaccctcaacggtcatgccatcgagtgccgggtcaacgccgagaacccggtgaccttccggccgtcgcccggcaagatctcgcgctatcatccgcccggcggcctcggcatccggatcgattccgcagtgtatcagggctacacgatcccgccctattacgactcgctggtcggcaagctgatcgtccacggcaaaacccgcggcgagtgcctgatgcggctgcgccgcgcgctcgacgagatggtggtggacggcatcgagaccacgctgccgctgttccgcgccctggtgcgtgagccgtcgatcatcgacggcgactaccacatccattggctggagcagtatctggcttcaggcgatcctgcaggttag

SEQ ID NO: 5145 - protein, 450 aa, Rhodopseudomonas palustris
MFDKILIANRGEIALRVLRACKELGIATVAVHSTADADAMHVRLADESVCIGPPPSKDSYLNVPALLAACEITGADAVHPGYGFLSENARFAEILSDHNLHFIGPKAEHIRLMGDKIEAKKTAKRLGIPVVPGSDGGVGPDDDAMAIAKEIGFPVLVKAAAGGGGRGMKVAHTAEDLALAISTAGNEAKAAFGDASVYLEKYLQKPRHIEIQVLGDGRGGAIHLGERDCSLQRRHQKVWEESPSPVISPEARARIGGICAKAMQDMQYLGVGTIEFLYEDGEFYFIEMNTRIQVEHPVTEMITGIDLVLEQIRIAAGGDLPVTQDEITLNGHAIECRVNAENPVTFRPSPGKISRYHPPGGLGIRIDSAVYQGYTIPPYYDSLVGKLIVHGKTRGECLMRLRRALDEMVVDGIETTLPLFRALVREPSIIDGDYHIHWLEQYLASGDPAG

SEQ ID NO: 5146 - DNA, 2016 bp, Rhodopseudomonas palustris
  CDS (1)..(2016)
atgatgaagagccccgccctgtatcgtcgcttccgcacgctcctgatcgccaaccgcggcgagatcgcctgtcgtgtcatccgcaccgcgcgtgcgatgggcctgcgcaccgtcgcggtgtattccgaggccgatgtcggcgcgcagcacgttgccgaggccgacgaggccgtgctgctcggcccggcgcgggcccgcgacagctatctcaatatcgaacgcatcatccaggccgccaagcagaccggcgccgaggcggtgcatcccggctacggcttcctgtcggagagcgccgaattcgcgcaggcctgcgccgacgcggggctggtgttcgtcggaccgacgccgcagatgatcaccgcgatgggctcgaaatcgggctccaaggcgctgatggaaaaggccggcgtgccgctggtgccgggctatcacggcgcggcgcaggacgaggcgacgctggcggcggccgcggacaagatcggctttccggtgctggtgaaggcctcggccggtggtggtggccgcggcatgcgggtggtgcgcgaggccggcgaactcgccgccgcgatcgtcagcgccaagcgcgaggccaaggcggcgttcggggacgacacgctgttgatcgagcgttatgtcgacaatccgcgccatatcgaggtgcagatcgtcggcgacagccacggcaatctcgtctcgctattcgaacgcgaatgcacgctgcagcgccgccaccagaaggtgatcgaggaggcgccgtcgccgaccctcgacgccgcgcaacgcgagaccgtctgcgccgcggcgcggcgcgccgcgggtgcggtgaactatgtcggcgccggaaccatcgagttcgtctccgacggcaaggacgtgttcttcatcgagatgaacacccgtctgcaggtggagcatccggtcaccgaacggatctccggcgtcgacctggtcgaatggcagctccgcgtcgcgttcggcgaagcgctgccgctgaagcaggatcagctcaagctgagcggccacgccatcgaggcgcgggtgtatgccgagaacccggcgaagaacttcatgccgtcggtcggcaagatcaccacctggcgaacgccggccgaggtcgatggcctgcgcatcgatgccggctatcgcggcggcgacagcgtgtcgccgtattacgacgcgatgctcgccaaggtgatcgcctgggcgccgacccggcaggcggcgatcgaccggctcgaccgcggactgaacgagaccgacgttcgcggcgtcgtcaccaatatcccgtttctctcggcgctggtgacgcatcctgaggtgcgcgccaacgccatcgacaccggtttcatcgaacgcaatctcgcagcgctcaccgccgcaccaagcacgctcggcgatctcgaattcgccgctgcggtcgcggcgatcctgcgcggcgaggacgaagccgccaaggcagaaggtccgtcgccatggcggacggcaggctggatgccggtcggccggcgcaagcgcagcttcctgttccgtcgcgggcaggggcatgaccacactgatcacacgatcgagctgacctatggcggcggatcgtcggcgctgaccatcgacggccgcgagcttgccttcgcgtggaccgccgctggcgacggcatcgatgtggcactcggcgatgcgcgctcgcgaatccacgccgtggtcgatggtgccgagttgtatgtgcgcacgcggagcgggaggttcgagctgcatctcgtcgatccgttcggcggcgaaagcgaggaggccgtcggcgaagacaagatcgtggcgccgctccccggcaccgtagtggcgctgcttgcggaagtcggcgccaagctcgacaagggcgcgccgatcctcacgctcgaagtgatgaagatggagcagaccctgcgcgcgccgttcgccggaacgttgacggcggtgaaatgcaaggtcggcgacatcgtccaggaaggcgccgagcttgccgagctcgaggccgacgcagactaa

SEQ ID NO: 5147 - protein, 671 aa, Rhodopseudomonas palustris
MMKSPALYRRFRTLLIANRGEIACRVIRTARAMGLRTVAVYSEADVGAQHVAEADEAVLLGPARARDSYLNIERIIQAAKQTGAEAVHPGYGFLSESAEFAQACADAGLVFVGPTPQMITAMGSKSGSKALMEKAGVPLVPGYHGAAQDEATLAAAADKIGFPVLVKASAGGGGRGMRVVREAGELAAAIVSAKREAKAAFGDDTLLIERYVDNPRHIEVQIVGDSHGNLVSLFERECTLQRRHQKVIEEAPSPTLDAAQRETVCAAARRAAGAVNYVGAGTIEFVSDGKDVFFIEMNTRLQVEHPVTERISGVDLVEWQLRVAFGEALPLKQDQLKLSGHAIEARVYAENPAKNFMPSVGKITTWRTPAEVDGLRIDAGYRGGDSVSPYYDAMLAKVIAWAPTRQAAIDRLDRGLNETDVRGVVTNIPFLSALVTHPEVRANAIDTGFIERNLAALTAAPSTLGDLEFAAAVAAILRGEDEAAKAEGPSPWRTAGWMPVGRRKRSFLFRRGQGHDHTDHTIELTYGGGSSALTIDGRELAFAWTAAGDGIDVALGDARSRIHAVVDGAELYVRTRSGRFELHLVDPFGGESEEAVGEDKIVAPLPGTVVALLAEVGAKLDKGAPILTLEVMKMEQTLRAPFAGTLTAVKCKVGDIVQEGAELAELEADAD

SEQ ID NO: 5148 - DNA, 2016 bp, Rhodopseudomonas palustris
  CDS (1)..(2016)
atgttcaaacgaattctgatcgccaaccgcggcgagatcgcctgccgggtcatcaagaccgcgcgtcgtatgggtatcgagacggtcgccgtctattccgaggcggatcgcgacgcgctgcacgtcgaaatggccgacgaagcggtgctgatcggccccccggcggcggccgagagctatctggtgatcgagaagatcgtcgaggcctgcaagaagaccggcgcagaggcggtacatccgggctacggcttcctgtccgagcgtgaagcgttcccgcgcgcgctggccgaggccggcatcgtgttcatcggtccgaaccccggcgcgatcgccgcgatgggcgacaagatcgagtcgaagaaggccgccgcgcaggccaaggtttcgaccgtgcccggcttcctcggcgtgatcgaggatgccaagcatgcggtgaagatcgccgacgagatcggctatccggtgatgatcaaggcctccgccggcggtggcggcaagggcatgcgcattgcgcactccacggccgaagtggcggagggtttcaatctcgccaaagccgaggcgaaggcgtcgttcggcgacgaccgcgtcttcatcgagaagttcatcgtcgatccgcgccacatcgaaatccaggtgctcggcgacaagcacggcaacgtcatctatctcggcgagcgtgagtgctcgatccagcgccgcaatcagaaggtgatcgaagaagcgccgtcgccgctgctcgacgaagtcacccgtcgcaagatgggcgagcaggcggtcgcgctggccaaggccgtgaactacgactcggccggcaccgtcgagttcgtcgccggccaggacaagagcttctacttcctcgagatgaatacccgcctgcaggtcgaacatccggtcaccgaaatggtcaccggcatcgatctggtcgagcagatgatccgtgtggcggccggcgagaagctggcgctggcgcagaaggacgtcacgctgaagggctgggcgatcgagtcccgcgtctatgcggaagatccgttccgcaacttcctgccgtcgatcggccgtctggtgaagtaccgcccgccggccgagagcgcggcctctggcatcaccgtgcgcaacgacaccggcgtgcaggagggcggcgagatctcgatgttctacgacccgatgatcgccaagctggtgacgcacgggccgtcgcgcgccgcggcgatcgaggcgcagacccatgcgctcgatgcgttctacgtcgacggcatccgccacaacattccgttcctgtcggcgctgatgacgcatccgcgctggcgcgagggcaatctgtcgaccggcttcatcgccgaggaatttccgcagggcttccatccgcgggtgccggagggcgaagttgcccgccgcatcgccgcggtcggcgcggcgatcgaccgcgtcatcggcgaacgcaagcgcaagatctcgggccagatgatcggccgcgcggtgatccgcgagcgccgacgctgcgtctggctggagcgcagcgaagtgccgctcgacgtgatccgtgagggtgaggcgttcgtcgtccgcttcgccaatcccgatggctcgctcggtcagccgcaccagttgctgtcgtcctggatgccgggcgacccggtgtgggaaggcaccatcgacggccatccggtcgcggtgcaggttcgcgcgatcccgaacggcttcaagctggcgcatcacggctacgaagtctcggtcaacgtcttcaccgagcgcgaagctgcctcggcgcgctggatgaaggaagccgacaaggccgacaccggcaagaaggtgctgtgcccgatgccgggcctgatcgtgtcgatcgcggtgaccgaaggccaggaggtcaaggccggcgagacgctggcggtggtcgaggcgatgaagatgcagaacgtgctgcgcgccgaacgcgacggcaccgtcaagaagatccacgcctctgccggagcgacgctcgcggtcgacgcgatgatcctcgagttcgcgtaa

SEQ ID NO: 5149 - protein, 671 aa, Rhodopseudomonas palustris
MFKRILIANRGEIACRVIKTARRMGIETVAVYSEADRDALHVEMADEAVLIGPPAAAESYLVIEKIVEACKKTGAEAVHPGYGFLSEREAFPRALAEAGIVFIGPNPGAIAAMGDKIESKKAAAQAKVSTVPGFLGVIEDAKHAVKIADEIGYPVMIKASAGGGGKGMRIAHSTAEVAEGFNLAKAEAKASFGDDRVFIEKFIVDPRHIEIQVLGDKHGNVIYLGERECSIQRRNQKVIEEAPSPLLDEVTRRKMGEQAVALAKAVNYDSAGTVEFVAGQDKSFYFLEMNTRLQVEHPVTEMVTGIDLVEQMIRVAAGEKLALAQKDVTLKGWAIESRVYAEDPFRNFLPSIGRLVKYRPPAESAASGITVRNDTGVQEGGEISMFYDPMIAKLVTHGPSRAAAIEAQTHALDAFYVDGIRHNIPFLSALMTHPRWREGNLSTGFIAEEFPQGFHPRVPEGEVARRIAAVGAAIDRVIGERKRKISGQMIGRAVIRERRRCVWLERSEVPLDVIREGEAFVVRFANPDGSLGQPHQLLSSWMPGDPVWEGTIDGHPVAVQVRAIPNGFKLAHHGYEVSVNVFTEREAASARWMKEADKADTGKKVLCPMPGLIVSIAVTEGQEVKAGETLAVVEAMKMQNVLRAERDGTVKKIHASAGATLAVDAMILEFA

SEQ ID NO: 5150 - DNA, 3426 bp, Corynebacterium diphtheriae
  CDS (1)..(3426)
atgtctcaacaatcatctgaacgtggaacctctacggtaaatccattgtcaaagatcctcgttgctaaccgtggcgagatcgccgtgcgagcttttcgtgcagcctttgaaaccggtgctgccacggtagctgtctacccgaacgaagaccgtaattcattccaccgatcgtttgcctctgaagctgtcctcattggtgagggcggatctgcggtcaaagcgtacctcgatatcgacgaaatcatccgtgctgctaaacaaacgggtgccgacgcaatttacccaggctacggcttcctttccgaaaacgcccagcttgctcgtgagtgcgctgaaaacggcataacctttatcggtccacctccatcagtgctggagcttaccggtgataaagcagctgctgttaccgcagcacgcgaggcaggtttgcccacgctgactgagacagaagcaacagacgatccaaagaagctcgcagagctgaccaaggggcagacctacccgctattcgtcaaagccgttgccggtggtggtggccgcggcatgcgttttgtcgacgcccccgaaaacctagaaaagctagcagcagaagcctcccgtgaggcggctgcagcattcggcgatggccgagtctacgccgagcgtgcagtaatcaatcctcagcatattgaggtccagatccttggtgactccgctggcaacatcatccacctgtacgagcgtgattgctcgctgcagcgtcgccaccaaaaggtcgtagagatcgccccagcacagcacttggcgcccggactacgcgaaaagatttgtgcagacgcagtcgcgtttgcacgccacatcggttaccaaggtgcaggcacggtcgagttcctagtcgatgaggaaggcaaccacgtcttcatcgagatgaaccctcgtatccaggtcgaacacaccgtgaccgaagaggtcacccaagtcgacttggtgaagtcccagatcatgatcgcctccggtgcgacactcgaagatctcggtctgcgccaagaagacatccacaccgaaggcgctgccctgcagtgccgtattactactgaagaccccaacaacggtttccgtcctgacaccggaacgattaccgcttatcgttccccaggtggcgcaggtgttcgtctcgacggtgctgccatgctcggtggtgagatcaccccgaatttcgactccatgctggtcaagatgacctgccgtggtgccgatttcgccaccgcagtcgctcgcgctcagcgtgcactcgcagaattcgttgtctcaggtgttgctaccaacatcggattcctgcgtgctttgctacgcgaagaagacttccagcacaagcgcatcgccactggcttcatcgcagatcacccatggctgctgcaggcaccacctgccgacgatgagcctggccgcattttgaactacctagctgatgtgactgtgaacaagcctcatggtctacgcccagccgtgatcaacccggtagaaaagctcccagcagagatcaaaggtgagctaccacgtggttcccgtgatcgcctgctccagctcggcccagagggatttgcgcgcgcactgcgtaaacaggatgcgctcgcggttacggataccaccttccgtgatgcacatcagtcgcttctcgcaacccgcgtgcgctccaacacgctgatcgacgcagcacggcacgtcgcaaagctcaccccagagctgctctctgtagaagcatggggtggtgctacctatgacgttgctatgcgcttcctacatgaggacccctgggagcgtctcgaccacctgcgtgaggccatgcccaacgtcaacattcagatgctgctgcgaggccgcaacacagtcggctacacaccgtacccagattctgtatgcaaggcttttgtcgacgaagccgcacgctctggtgttgatatcttccgcatcttcgacgcgcttaacgacgtctcccagatgcgtccagcaatcgacgcagtgctcgaaaccaacaccacgattgccgaagtcgcaatggcctactccggtgatctgaccaacccaagtgagaagctctacacactggattactaccttaagcttgccgaggaaatcgttaagtccggtgcacatgttctagccattaaagacatggctggactgatgaagccagccgcagcaaccaagctggtcaccgaactacgacgcaacttcgacctgccggttcatgttcacacccacgacactgctggtggccagctggctacgtattgggctgcagcagccgctggtgcagatgccgtcgatggtgcctccgcgccactgtcgggcacaacgtcgcagccatcgttgtctgcaattgtggcagcattcgctaacacctaccgcgatacgggtctctctctggacgcagtcggatcgatggaaccgtactgggaagcagtgcgcaaactctacgcacccttcgaatccggaaccccaggaccaactggccgcgtctaccagcacgaaatcccaggcggccagctgtccaatctgcgcgcacaggcaactgcactcggcttggcagatcgcttcgagctcatcgaggactactacgcagccgttaatgagatgctgggacgccccaccaaggtcaccccgtcctcaaaggtcgttggcgatcttgcactctacctagtcggcgcaggagttaacccagcggactttgcagcagatccccaaaagtacgatattcctgactccgtcattgccttcctccgtggtgagctcggcacccctccaggcggctggccagaagaactgcgtgctaaggcattggcaggacgtaaggaatcaaaggacacattggccccgctgccagcagaagatgaagctctgctcgcagatcgtgcgaccgttcgcccaacgctggatcgcctgctcttcccgaagcctgcggcagaattcgcagagcaccgccgtcagtttggcgataccaccaaactcggtgacgcagaattcctctatggcctcaaagaaggcaaagaaacggtcattcgtaccgcagacagtagcgtcccaatgctggtgcgtctcgatgccgtcggcgagcccgacgaaaagggcatgcgcaacgttgtgtgcaatgtcaacggccagattcgccccatcctcgtgcgtgatcgcagcgtagagtcagtgaccgcctcggtggaaaaggctgatccttccaacgccggacacgtagcagcaccattcgcaggcgttgtcacagtgacaatcgaggaaggcgctaccgtcaaagccggcgatccagttgctgtcattgaggcaatgaagatggaggcaacgatctctgccaccacagacggaaccgtcgaccgtatcgtcttgacgcaggccaccaaggtcgaaggtggagacttgctcctcgtgatcaagtag

SEQ ID NO: 5151 - protein, 1141 aa, Corynebacterium diphtheriae
MSQQSSERGTSTVNPLSKILVANRGEIAVRAFRAAFETGAATVAVYPNEDRNSFHRSFASEAVLIGEGGSAVKAYLDIDEIIRAAKQTGADAIYPGYGFLSENAQLARECAENGITFIGPPPSVLELTGDKAAAVTAAREAGLPTLTETEATDDPKKLAELTKGQTYPLFVKAVAGGGGRGMRFVDAPENLEKLAAEASREAAAAFGDGRVYAERAVINPQHIEVQILGDSAGNIIHLYERDCSLQRRHQKVVEIAPAQHLAPGLREKICADAVAFARHIGYQGAGTVEFLVDEEGNHVFIEMNPRIQVEHTVTEEVTQVDLVKSQIMIASGATLEDLGLRQEDIHTEGAALQCRITTEDPNNGFRPDTGTITAYRSPGGAGVRLDGAAMLGGEITPNFDSMLVKMTCRGADFATAVARAQRALAEFVVSGVATNIGFLRALLREEDFQHKRIATGFIADHPWLLQAPPADDEPGRILNYLADVTVNKPHGLRPAVINPVEKLPAEIKGELPRGSRDRLLQLGPEGFARALRKQDALAVTDTTFRDAHQSLLATRVRSNTLIDAARHVAKLTPELLSVEAWGGATYDVAMRFLHEDPWERLDHLREAMPNVNIQMLLRGRNTVGYTPYPDSVCKAFVDEAARSGVDIFRIFDALNDVSQMRPAIDAVLETNTTIAEVAMAYSGDLTNPSEKLYTLDYYLKLAEEIVKSGAHVLAIKDMAGLMKPAAATKLVTELRRNFDLPVHVHTHDTAGGQLATYWAAAAAGADAVDGASAPLSGTTSQPSLSAIVAAFANTYRDTGLSLDAVGSMEPYWEAVRKLYAPFESGTPGPTGRVYQHEIPGGQLSNLRAQATALGLADRFELIEDYYAAVNEMLGRPTKVTPSSKVVGDLALYLVGAGVNPADFAADPQKYDIPDSVIAFLRGELGTPPGGWPEELRAKALAGRKESKDTLAPLPAEDEALLADRATVRPTLDRLLFPKPAAEFAEHRRQFGDTTKLGDAEFLYGLKEGKETVIRTADSSVPMLVRLDAVGEPDEKGMRNVVCNVNGQIRPILVRDRSVESVTASVEKADPSNAGHVAAPFAGVVTVTIEEGATVKAGDPVAVIEAMKMEATISATTDGTVDRIVLTQATKVEGGDLLLVIK

SEQ ID NO: 5152 - DNA, 1785 bp, Corynebacterium diphtheriae
  CDS (1)..(1785)
atgtctgtggaacagaagaagatcactaaggtgctcatcgcaaaccgcggtgagatcgccgtccgcgttatccgtgcagcccgcgatgccggcatcgccagcgtcgccgtgtacgcagagcccgatgcagacgctcctttcgtctccatggctgacgaggcatttgcactaggtggccaaacctccgccgagtcctaccttgtctttgacaagatcctcgacgcggccaagaaatccggcgccgacgccatccacccaggctatggcttcctctctgaaaacggcgacttcgccgaagcagttatcaatgcaggcctgatctggatcggcccatcgccgcagtccatccgcgacctcggcgacaaagtcactgcacgccacatcgcgcttaaagccgaagcacctatggcaccaggcaccaaagagccagtcaaagacgcctccgaggtcgtcgccttcgcagaagagcacggacttcccatcgctattaaggcagcattcggcggcggcggacgcggcatgaaagttgcctacaccatggatgaagtagccgacctctacgaatccgcaacccgcgaggcagtggcagccttcggtcgcggcgaatgcttcgtcgagcgttacctcgacaaagcacgccacgtcgagtgccaagtcatcgcagatatgcacggcaacgttgttgtcgcaggcacccgcgactgctccctccagcgccgattccaaaagctcgtcgaagaagcaccagccccattccttaccgacgaccagcgcacccgccttcacgaatccgccaaagccatctgtaaagaagctggttactacggtgccggcaccgtagagtacctcgtcggctccgacggactgatctccttccttgaggtcaacacccgcctccaggtggaacaccccgtcaccgaggtcaccaccggcctcgacttggtacgcgagcaattccgcatcgcagaaggcaaagaactccacatcaaacaagacccaacccctcgtggacacgccttcgaattccgaatcaacggcgaagacgcaggctcaaacttcatgcccgcaccaggcaaggtcaccaagtacatcgagccttccggcccaggtgtacgcatggactccggtatcgtcgaaggctccgtcatcggcggccaattcgactccatgctcgccaagctcatcgtcttcggagaaacccgtgacgaagcactccaacgcgcatcccgcgctcttaatgagtacgtcgtcgaaggcatgcccaccgtcttgccattccaccgccacatcgtggaaaacccagccttcatcggcgacggcgaaaaattcgaggtctacaccaagtggatcgaagaagagtggaacaacccgatcgagccatacgtcgacccaacagatgtggatgatgaagaagcagcactgccatcccagaaagttgtcgtggaaatcgacggccgccgcgtagaaatcgcactaccaggcgacctcgcactcggcggcggcgcaggtgcaccaaagaagaaagccaagaagcgccgcgcaggtggctccaaggctgccatctctggcgacgctgttgcagcaccaatgcagggcaccgtcatcaagatcaacgccgaagaaggcgccgaagtagctgaaggcgacaccgtcgtcgtcctcgaagcaatgaagatggaaaaccccgtcaaggcacacaagtccggtgtggtcaccggtctagccatcgccgctggcgaaggcgtaaccaagggccaagtactcctcgagatcaaagacgcctaa

SEQ ID NO: 5153 - protein, 594 aa, Corynebacterium diphtheriae
MSVEQKKITKVLIANRGEIAVRVIRAARDAGIASVAVYAEPDADAPFVSMADEAFALGGQTSAESYLVFDKILDAAKKSGADAIHPGYGFLSENGDFAEAVINAGLIWIGPSPQSIRDLGDKVTARHIALKAEAPMAPGTKEPVKDASEVVAFAEEHGLPIAIKAAFGGGGRGMKVAYTMDEVADLYESATREAVAAFGRGECFVERYLDKARHVECQVIADMHGNVVVAGTRDCSLQRRFQKLVEEAPAPFLTDDQRTRLHESAKAICKEAGYYGAGTVEYLVGSDGLISFLEVNTRLQVEHPVTEVTTGLDLVREQFRIAEGKELHIKQDPTPRGHAFEFRINGEDAGSNFMPAPGKVTKYIEPSGPGVRMDSGIVEGSVIGGQFDSMLAKLIVFGETRDEALQRASRALNEYVVEGMPTVLPFHRHIVENPAFIGDGEKFEVYTKWIEEEWNNPIEPYVDPTDVDDEEAALPSQKVVVEIDGRRVEIALPGDLALGGGAGAPKKKAKKRRAGGSKAAISGDAVAAPMQGTVIKINAEEGAEVAEGDTVVVLEAMKMENPVKAHKSGVVTGLAIAAGEGVTKGQVLLEIKDA

SEQ ID NO: 5154 - DNA, 1479 bp, Bdellovibrio bacteriovorus
  CDS (1)..(1479)
atgaaaaagttcacacgtattgccatcgccaatcgcggtgaagtggctgttcgtattatcaaagcctgcgaggaaatgggtattgaaaccgttcttctgcactcagaagccgacatcaacacccgcgcttatcgtatggcgactaaaaccatctgcgtgggtcctgcggcaacggcggaaagttatctgaacattccagccaacatcaacggcgctttggccggtggtgcgcaagcggtgcatccgggttttggtttcctgtctgaaaacgccgatttcgcggaggctgtgaataaagccggtttgaccttcattggtccttctccggaagcgatccgtgctttgggtgacaaggttcactgtaaagagctggcaaagcaggcgggtttgccgctggtgccgggttatcagggtgaaaaccaggatgtggctcacttgatcacgcaggctgagaagatcggctatccggtgatcgtgaaagccgctgccggtggtggtggccgcgggatgaaacttttgaagtcttccgcagaagctcacgagctgattgaatccgcccagcgtgaagcacagtcggcttttggttctccgaaagtcttcctggaaaagtatctggatcgtgcaaaacacattgaattccaggtcttcggtgacagcaccggaaatgtgcagcacttctttgaccgcgaatgctctgttcagcgccgtcaccagaaaatcatcgaagaggcgacttcgccttctttgaccgatgatctgcgccgccgtatgggagaggcggcttgtgccattgcgactttgggcaaatacaaaggggcgggcacggtggaattccttctgcaagatggggagttctatcttttggaagtgaacactcgtttgcaggtcgaacacccggtgacggaagaagttctgggtgtggatctggtgaaaatgcagatcctgactgcgcagggtgatttcgttcatgacaacaaacagatccgcgcaccgaagggccattccatcgaatgccgtatctatgctgaaaatccattcctgggtggcgttccttccacaggtcttttgggtcatgtggaatggccggaaggtccgggccgtcgttatgaatacggctttgattccggcgacaccattacgccgtactatgacccgatgattgccaaagtgatcgtgtgggatgaaaaccgtccgcgtgcgattcagaaaatgatccgcgtattgaaggattccgtggtgtttggtgttcacacgaacatcccgtacctgatcgaaattctttcgcacaaagagttcgtcatgggcacgatgacgacaagatttattgaaacttacttcagtgaatcactgaaagaaccagctttgacggaaattgaaaaaaccgtggcggcgggtgcattgttgcagcttcgcggaggcgctggtgaaacggcgaaaacttccgcatccccttgggcttcttactggagaggtatctaa

SEQ ID NO: 5155 - protein, 492 aa, Bdellovibrio bacteriovorus
MKKFTRIAIANRGEVAVRIIKACEEMGIETVLLHSEADINTRAYRMATKTICVGPAATAESYLNIPANINGALAGGAQAVHPGFGFLSENADFAEAVNKAGLTFIGPSPEAIRALGDKVHCKELAKQAGLPLVPGYQGENQDVAHLITQAEKIGYPVIVKAAAGGGGRGMKLLKSSAEAHELIESAQREAQSAFGSPKVFLEKYLDRAKHIEFQVFGDSTGNVQHFFDRECSVQRRHQKIIEEATSPSLTDDLRRRMGEAACAIATLGKYKGAGTVEFLLQDGEFYLLEVNTRLQVEHPVTEEVLGVDLVKMQILTAQGDFVHDNKQIRAPKGHSIECRIYAENPFLGGVPSTGLLGHVEWPEGPGRRYEYGFDSGDTITPYYDPMIAKVIVWDENRPRAIQKMIRVLKDSVVFGVHTNIPYLIEILSHKEFVMGTMTTRFIETYFSESLKEPALTEIEKTVAAGALLQLRGGAGETAKTSASPWASYWRGI

SEQ ID NO: 5156 - DNA, 1503 bp, Bdellovibrio bacteriovorus
  CDS (1)..(1503)
atggcattgtttaaaaaaatcctgatcgccaaccgcggggaaatcgccatccgtatcactcgcgcctgccgcgagctgggtatcggctctgtggcggtgttttccgatgcggaccgcgacagcttgcacgtattcctggcggatgaggcttaccacattggcccgtccccatcgcgagaaagttacctgaactataacaagatcatcgaagtctgcaaaaaagccggcgtggacgctgttcacccgggttacggcttcctgtctgaaaacaccacttttgcgcaagctttgaaagatgcaggcatcaccttcatcggtccaacggttgcgaatattgaagccatgggggataaactttccgccaaggctttgatgaaaaaagccggtgttccgacggttccaggctctgacggcggggttgaatccgttgaagaagcccagaagatcgcagaacaaatcggtctgcctatcatcatcaaggcttctgccggcggtggtggtaaagggatgcgtgtagttcgtcagatggacgaactggaaagcgctttccgtgcgtgccgttctgaaggccagaactatttcgcggatccgactgtttacatcgaaaaattcatcaacgatccgaaacacatcgagatccaggtgtttggcgacactcataacaaccacgttcacctgtttgaacgtgagtgctctgtgcagcgccgtcaccagaagatcatcgaggaatgtccgtccccttctgtgcctcacgaagtgcgcctgcgcatgggtgaagccgctgttcgcgcagcaaaacagatcaactatgtgggcgcgggaacgattgagttcatctttgataacgccaccaaggaattctacttcatggagatgaacactcgtcttcaggtggaacatccgatcacggaaatcgtgactggttatgacctggtgaaagagcagatctatgtggctgcgggcaaacctttgagcttcaaacaagaagacatcaaacaaaaaggccacgccatcgaagcccgtatctgtgcggaagacccgatcacgtataaaccgcaccctggtgtgatccgcgcctgccgtcacccgcaaggtccgtttatgcgtgtggattcctacgcttacccgggctacgaagtgcctatcttctacgatccaatgatcgccaaagtgatcacttggggtgagacgcgcgaagaggccatcgacagaatgcaacgtgccctgagtgagttcgtgctgaccggtattaaaaccaatatcgttctgcataaaaccatcctggatcacccgaaattccgtgatggctcttacacgactcagtttattgaaaagaacttcgaagttatcgaaccaaatcttttcaaagaagttgaagacccagtattcctgatcgcggcggcaatcactgcttacaacgatcgtaaatccaaagacgttcgccagctgaacctgacttccaactggaagcgtatcagccgcaaacttcaattgaggacgtaa

SEQ ID NO: 5157 - protein, 500 aa, Bdellovibrio bacteriovorus
MALFKKILIANRGEIAIRITRACRELGIGSVAVFSDADRDSLHVFLADEAYHIGPSPSRESYLNYNKIIEVCKKAGVDAVHPGYGFLSENTTFAQALKDAGITFIGPTVANIEAMGDKLSAKALMKKAGVPTVPGSDGGVESVEEAQKIAEQIGLPIIIKASAGGGGKGMRVVRQMDELESAFRACRSEGQNYFADPTVYIEKFINDPKHIEIQVFGDTHNNHVHLFERECSVQRRHQKIIEECPSPSVPHEVRLRMGEAAVRAAKQINYVGAGTIEFIFDNATKEFYFMEMNTRLQVEHPITEIVTGYDLVKEQIYVAAGKPLSFKQEDIKQKGHAIEARICAEDPITYKPHPGVIRACRHPQGPFMRVDSYAYPGYEVPIFYDPMIAKVITWGETREEAIDRMQRALSEFVLTGIKTNIVLHKTILDHPKFRDGSYTTQFIEKNFEVIEPNLFKEVEDPVFLIAAAITAYNDRKSKDVRQLNLTSNWKRISRKLQLRT

SEQ ID NO: 5158 - DNA, 1362 bp, Parachlamydia sp
  CDS (1)..(1362)
atgcaaaaagttcttatcgctaacagaggcgagattgccgttcgaattattcgtgcttgtcacgatttaggtcttcaaactgtggctgtttattcgcaagcagatgctgaagccttacacgttcttcatgctgacgaagccatttgtattggagaagccccttcccataaatcttatcttaaagtgccaaatatcctttctgcttgtgaaattaccggagctgatgcgatccatccgggttacggttttttaagcgaaaatgcaaattttgcctctatttgtgaaagctgtggcttaaactttattggaccggctccccaatctattgcattgcttggtgataaagctaaagctaaagcaacagcaaaaaaagctggttgtcctgttatcccaggctcagatggagtcgtagtggatattaaagaagctttgaaagacgcaaaaaaattaggtttccctattttcattaaagctgttgcgggaggtggcgggaaaggaattcggatagcttacaacgaagaagagtttactaagctatttgcagctgcacgagctgaagcagaggtaagttttgggaatccagacgtctatttagaaaaaatgattatgaatcctcgacatattgaagtgcaagtgttaggggataaatttggtcattatattcatttaggagaaagagattgcactactcaacgacgcagacaaaaactcattgaagagtctccaagtccggttctcagtcaaaaaatgcgccaaaagattggtcaagcagctgtcaatgttgttaaagaagcaaattatttttctgcgggaacagtagaattccttttagacaaagatcaaaacttttattttatggaagtaaatacacgtattcaagttgagcatacggtcacagaagaattaacaggtattgatcttgtaatggaacagctcaaaattgctcgtggagaaaaattgattttagaacaaaaggatgtaaaattcactggtcatgtaattcaatttagaattaatgcagaaaatcctagccacaattttgctccctctcctggaaaattagaatattatcttcctcctggtggcccccatgttagagttgacagcgcttgttattcaggatattccattcctcctaactatgattcaatgattgctaaattaattgtgaagggtaaagatcgtacagaaactattgcaataggaaaaagagctctaagtgaatttcatatcggaggagttaattccacaataccttttcacctttatatgctagaagatccaaaatttttaaatgcagattttgatctgacttatatcgataacctaattgcagaaggtaatcgctttgaattagaatag

SEQ ID NO: 5159 - protein, 453 aa, Parachlamydia sp
MQKVLIANRGEIAVRIIRACHDLGLQTVAVYSQADAEALHVLHADEAICIGEAPSHKSYLKVPNILSACEITGADAIHPGYGFLSENANFASICESCGLNFIGPAPQSIALLGDKAKAKATAKKAGCPVIPGSDGVVVDIKEALKDAKKLGFPIFIKAVAGGGGKGIRIAYNEEEFTKLFAAARAEAEVSFGNPDVYLEKMIMNPRHIEVQVLGDKFGHYIHLGERDCTTQRRRQKLIEESPSPVLSQKMRQKIGQAAVNVVKEANYFSAGTVEFLLDKDQNFYFMEVNTRIQVEHTVTEELTGIDLVMEQLKIARGEKLILEQKDVKFTGHVIQFRINAENPSHNFAPSPGKLEYYLPPGGPHVRVDSACYSGYSIPPNYDSMIAKLIVKGKDRTETIAIGKRALSEFHIGGVNSTIPFHLYMLEDPKFLNADFDLTYIDNLIAEGNRFELE

SEQ ID NO: 5160 - DNA, 1506 bp, Methanococcus maripaludis
  CDS (1)..(1506)
atgtttaaaaaagtattgatagccaataggggagaaattgcagtcagggtaattcgagcatgtaaagaacttggaattaagactgttgcagttttttctgaagctgacgaacactcactctatagaaatattgcagatgaatgttatccaatcggggaacctcctgcatcaaaaagctaccttaacatggaaaggatcttaaaagtggctgaaaaagcaggtgtggatgcagttcacccaggatatggttttttatctgaaaatgtaaaatttgcagatgaatgtcacaaaagaggcattgaatttatcggccctccaacaaacgcaattgatgttatgggcagtaaaatcaatgctaagaaagcaatgaaaacagcaggagttcctgtactgcctggaagggaagaatcaatcgaaagcgaagaagaagcaatcgaagttgcagatgaaattggataccctgtaatcataaaagcatctgcaggtggtggcggtatcggaatgaacgtggtttacaataaagaagaactcgttgatacgatacagtctacaaaatccattgcacagagtgcttttggtgattcaacagtatttattgaaaaatacctcgaaaaaccaagacacattgaaatacaggtggttgcagataaatttggaaatgtgattcaccttggtgatagggagtgttcaattcaaagaaggcaccaaaaattaattgaagagtccccctctccaatcatgaccgaggaattaagggaaagaatgggaaatgcagctgtaaaagctgctaaggccataaattaccacagcgtgggtacggttgaatttttatacagcaaaggcgaattttatttccttgaaatgaatacaagagttcaggtagaacacccaataacagaggttgttactggcgttgatatcgtaaaagaacagataaaaattgcagccggaaaaaaattatcctacacccaagatgaaattacattcagaggacatgcaatagaatgtagggtaaatgcagaagatgcaataaatgattttgttccagctcctggaaaaataaaatattaccggtctcctggaggtccaggtgtaaggctcgatagtggtgtatttgggggagctgaaattccaccttattatgattccatggttgcaaagataattacgtacggtcttacaagagaagaagcaattgaaaggatgaaaagggcactttccgaatatatggttctaggaataattacaaacatacctttccacagggcggtaattgaggaagacaactttttaaaaggaaacctttcaacgcactacgttgaagataatctatgctcatttagaaaagcaatggtaaattatgctttagaagcaaaagatagggaaaaaatattcagtgaaaaagtattccatggtaataaaaaggtcattgcaattgcaggcggtttaaatgcttacataacaagcctttcaaataaaaataaggataaatacgataaaaattaa

SEQ ID NO: 5161 - protein, 501 aa, Methanococcus maripaludis
MFKKVLIANRGEIAVRVIRACKELGIKTVAVFSEADEHSLYRNIADECYPIGEPPASKSYLNMERILKVAEKAGVDAVHPGYGFLSENVKFADECHKRGIEFIGPPTNAIDVMGSKINAKKAMKTAGVPVLPGREESIESEEEAIEVADEIGYPVIIKASAGGGGIGMNVVYNKEELVDTIQSTKSIAQSAFGDSTVFIEKYLEKPRHIEIQVVADKFGNVIHLGDRECSIQRRHQKLIEESPSPIMTEELRERMGNAAVKAAKAINYHSVGTVEFLYSKGEFYFLEMNTRVQVEHPITEVVTGVDIVKEQIKIAAGKKLSYTQDEITFRGHAIECRVNAEDAINDFVPAPGKIKYYRSPGGPGVRLDSGVFGGAEIPPYYDSMVAKIITYGLTREEAIERMKRALSEYMVLGIITNIPFHRAVIEEDNFLKGNLSTHYVEDNLCSFRKAMVNYALEAKDREKIFSEKVFHGNKKVIAIAGGLNAYITSLSNKNKDKYDKN

SEQ ID NO: 5162 - DNA, 1719 bp, Streptomyces antibioticus
  CDS (1)..(1719)
atgagtctgcgcaaggtgctcatcgccaaccgtggcgaaatcgctgtccgcgtggcccgggcctgccgggacgccgggatcgcgagcgtggccgtctacgccgacccggaccgcgacgctgtgcacgtacgggccgccgacgaggcgttcgcgctggggggtgacaccccggccaccagctacctggacatcgagaaggtgctgctggccgccaagcagtccggtgcggacgcgatccaccccggctacggcttcctgtccgagaacgccgagttcgcccaggccgttctcgacgcgggcctgatctggatcggcccgccgccgcaggcgatccgggacctgggtgacaaggtcgccgcccgtcacatcgcccagcgcgccggcgccccgctggtggcgggtacgccggacccggtgagtggtgcggaggaggtcgtggctttcgccgaggagcacggtctgccgatcgcgatcaaggccgcgttcggcggcggcgggcgcggtctgaaggtcgcccgcaccctcgaagaggtccccgagctgtacgagtccgccgtgcgtgaggccgtcgccgcgttcggccgtggcgagtgcttcgtcgagcgctacctcgaccggccgcggcatgtggagacgcagtgcctggccgacaagcacggcaacgtcgtcgtggtctccacccgcgactgctccctgcagcgccgtcaccagaaactggtcgaggaggctcccgcaccgttcctgtccgaggagcagatggcggagctgtaccgggcgtcgaaggccatcctgaaggaggccgggtacgagggcgcgggcacgtgtgagttcctggtcgggcaggacggcacgatctccttcctggaggtcaacacccgcctgcaggtcgagcacccggtcaccgaggaagtcgccggcatcgacctggtccgggagatgttccgcatcgccgacggcgaacccctcggctacgacgacccggtgctgcgcggtcactccttcgagttccgtatcaacggtgaggacccgggcgtgcgtctggacgcgggcgtggaggccggcagtgtgatcggcccggcgtgggactccctgctggccaagctgatcgtcaccggccgcacccgcaaggaagccctccagcgggccgcccgcgcgctggaggagttccgtgtcgagggcatggccaccgccatccccttccaccgcaaggtcgtcaccgaccccgccttcgcccccgaactcaccggctccagcgagccgttcacggtccacacccggtggatcgagaccgagttcgtcaacgacatcaagcccttcaccgcccccgccgacgccgaggccgacgaggatgcggcgcgtgagacggtcgtggtcgaggtcggcggcaagcgcctggaggtctccctgccctccagcctgggcatgagcctggcccgcaccgggctcgcggccggggccaagcccaagcggcgcgcggcgaagaagtccgggcccgtcgcctccggcgacaccctgacctcccccatgcagggcaccatcgtcaagatcgccgtcgaggaaggccagcaggtcaaggagggcgacctggtcgtcgtcctggaggccatgaagatggaacagcccctcaacgcccacaaggcgggcaccatcaagggcctgaccgccgaggtcggcgcctccctcacctccggcgccgccatctgcgagatcacggactga

SEQ ID NO: 5163 - protein, 572 aa, Streptomyces antibioticus
MSLRKVLIANRGEIAVRVARACRDAGIASVAVYADPDRDAVHVRAADEAFALGGDTPATSYLDIEKVLLAAKQSGADAIHPGYGFLSENAEFAQAVLDAGLIWIGPPPQAIRDLGDKVAARHIAQRAGAPLVAGTPDPVSGAEEVVAFAEEHGLPIAIKAAFGGGGRGLKVARTLEEVPELYESAVREAVAAFGRGECFVERYLDRPRHVETQCLADKHGNVVVVSTRDCSLQRRHQKLVEEAPAPFLSEEQMAELYRASKAILKEAGYEGAGTCEFLVGQDGTISFLEVNTRLQVEHPVTEEVAGIDLVREMFRIADGEPLGYDDPVLRGHSFEFRINGEDPGVRLDAGVEAGSVIGPAWDSLLAKLIVTGRTRKEALQRAARALEEFRVEGMATAIPFHRKVVTDPAFAPELTGSSEPFTVHTRWIETEFVNDIKPFTAPADAEADEDAARETVVVEVGGKRLEVSLPSSLGMSLARTGLAAGAKPKRRAAKKSGPVASGDTLTSPMQGTIVKIAVEEGQQVKEGDLVVVLEAMKMEQPLNAHKAGTIKGLTAEVGASLTSGAAICEITD

SEQ ID NO: 5164 - DNA, 1344 bp, Photobacterium profundum
  CDS (1)..(1344)
atgttagataaattagttattgcgaaccgaggcgaaattgcccttcgtattctacgtgcttgtaaagaattaggcattaagactgttgcgattcactcaacagctgaccgcgatcttaagcatgtattgcttgcagacgaaactgtatgtattggttctgcaaaaagttctgaaagctatttgaacattcctcgcatcattagtgcagcggaaatcacaggggcagttgcgattcaccctggttacggtttcttgtctgaaaatgctgattttgcagaacaagtagagcgatctggctttatttttgtgggccctaaagcggaaactattcgcatgatgggcgacaaagtatcagcgattaccgcgatgaaaaaagcgggcgttccttgtgtgcctggttctgatggcccacttaatgacgacgaagcaaaaaacaaatctttcgctaagcgtattggtttccctgtcatcattaaagcatctggtggcggcggtggccgtggtatgcgtgttgttcgttcagaagctgaactagcagaagctattgcgatgacacgtgcagaagctaaatcgttcttcaataacgatgtggtttacatggagaaataccttgaaaaccctcgtcatatcgaagttcagatcatggctgatggtcaaggtaatgcgattcacttaggtgagcgtgactgttcaatgcagcgtcgccaccagaaagtcgttgaagaagcaccagcaccaggtatcaccgaagagatgcgtaagttcatcggtgagcgttgtacgcgtgcttgtatcgaaatcggttaccgtggcgcaggtacatttgaattcttgtacgaaaacggtgagttctacttcattgaaatgaacacccgtattcaggttgagcacccagtaaccgaaatggtaacgggcgttgatctgatcaaagaacagcttcgtgttgctgctggtcagccactatcattcagccaatctgatattcaaattcgtggccatgctatcgaatgtcgtatcaatgctgaagatcctgagcgtttcctaccttgcccaggtaaaatcacgcgcttccacgcgcctggtggcatgggtatccgttgggaatctcacatctactcaggctacacagtgccaccgcattatgattccatgatcggtaagctgatttcatacggtgaaaaccgcgatgtggcaatttcacgtatgcgtaacgcattaggtgaatcaatcatcgatggtattaaaaccaatatcccgctacagcaagaaattatggcagatgaaaacttccagcatggtggtgcaaacatccactatctagagaagaaacttggtctacaataa

SEQ ID NO: 5165 - protein, 447 aa, Photobacterium profundum
MLDKLVIANRGEIALRILRACKELGIKTVAIHSTADRDLKHVLLADETVCIGSAKSSESYLNIPRIISAAEITGAVAIHPGYGFLSENADFAEQVERSGFIFVGPKAETIRMMGDKVSAITAMKKAGVPCVPGSDGPLNDDEAKNKSFAKRIGFPVIIKASGGGGGRGMRVVRSEAELAEAIAMTRAEAKSFFNNDVVYMEKYLENPRHIEVQIMADGQGNAIHLGERDCSMQRRHQKVVEEAPAPGITEEMRKFIGERCTRACIEIGYRGAGTFEFLYENGEFYFIEMNTRIQVEHPVTEMVTGVDLIKEQLRVAAGQPLSFSQSDIQIRGHAIECRINAEDPERFLPCPGKITRFHAPGGMGIRWESHIYSGYTVPPHYDSMIGKLISYGENRDVAISRMRNALGESIIDGIKTNIPLQQEIMADENFQHGGANIHYLEKKLGLQ

SEQ ID NO: 5166 - DNA, 26 bp, artificial sequence
  primer
ttatttttcctgaagaccgagttttt

SEQ ID NO: 5167 - DNA, 24 bp, artificial sequence
  primer
atgctggataaaattgttattgcc

SEQ ID NO: 5168 - DNA, 300 bp, Saccharomyces cerevisiae
  CDS (1)..(300)
atggccgcaactaaagaagcaaagcaaccaaaggaaccaaagaagaggaccaccaggagaaagaaggatcctaacgcccctaagaggggcttgtcagcttatatgttctttgctaatgaaaacagagacattgtccgttccgagaatcctgacgtaacttttggccaagtaggcagaatattgggtgagaggtggaaggccttaactgctgaagaaaagcaaccctatgaatctaaggctcaagcagacaagaagagatacgaatctgaaaaggaattgtacaatgctacacgtgcttga

SEQ ID NO: 5169 - protein, 99 aa, Saccharomyces cerevisiae
MAATKEAKQPKEPKKRTTRRKKDPNAPKRGLSAYMFFANENRDIVRSENPDVTFGQVGRILGERWKALTAEEKQPYESKAQADKKRYESEKELYNATRA

SEQ ID NO: 5170 - DNA, 282 bp, Saccharomyces cerevisiae
  CDS (1)..(282)
atggtcaccccaagagaacctaagaagagaaccactagaaagaagaaggacccaaatgcccctaagagggctttgtccgcctacatgtttttcgctaacgaaaacagagatattgttcgttctgaaaatccagatatcacatttggacaagtcggcaagaagttgggtgagaagtggaaggctctaacgccagaggaaaagcagccttacgaggccaaggcccaggccgataagaagagatatgaatccgaaaaggagttatataacgccactttggcttag

SEQ ID NO: 5171 - protein, 93 aa, Saccharomyces cerevisiae
MVTPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 5172 - DNA, 995 bp, Gallus gallus (chicken)
  CDS (100)..(723)
cggccgccgggaaaccagtccgcaggagccgcgcagggagcaagggcccgcgtcgccaacgctaagccccctcagccaggacccgccgccgagctcgccatgggcaagggcgaccccaacaagccgcggggcaagatgtcctcgtacgcgtacttcgtgcagacgtgcccgcgagagcacaagaagaagcacccggactcgtcagtcaacttcgccgagttctcgcggaagtgctcggagcggtggaagacgatgtccagcaaggagaaagggaagttcgaggagatggccaagggagacaaagctcgctacgacagggagatgaagaactatgttcctcccaaaggagagaagaagggaaagaagaaggaccccaacgctcctaaaagaccaccatctgcattcttccttttctgttccgaacaccgtccaaaaatcaaaaatgatcatcccggcttgtctatcggagacacggcaaagaagttgggtgaaatgtggtctgaacagtcggccaaagacaagcaaccctatgaacagaaggctgcaaagctaaaggagaaatatgaaaaggatattgcagcatatcgtgccaagagcaagagtgatgcaggaaaaaagggcccaggtaggcctgcaggatctaagaagaaagcagaaccagaagaggaggaggaggaggaggaagatgaggaagaggaggaagaagaagaggatgaggagtaaatgaatgcccgtgctgtaaagatttatgctcgaaatccaatgttttgctaagaatgtgaactcaagtgcagctcattgttagcttcagtataaaaatctgtacagattgtgtataggtaatgtggttctttgtagggagacctctatttctaaagtaagtagtagctgagtgctgcacagttcagttttaaaagaaggttgtgggaatgtttctgcatatttaatggttttgttgaaattcagtgaatgatagccagtttttttttttagcc

SEQ ID NO: 5173 - protein, 207 aa, Gallus gallus (chicken)
MGKGDPNKPRGKMSSYAYFVQTCPREHKKKHPDSSVNFAEFSRKCSERWKTMSSKEKGKFEEMAKGDKARYDREMKNYVPPKGEKKGKKKDPNAPKRPPSAFFLFCSEHRPKIKNDHPGLSIGDTAKKLGEMWSEQSAKDKQPYEQKAAKLKEKYEKDIAAYRAKSKSDAGKKGPGRPAGSKKKAEPEEEEEEEEDEEEEEEEEDEE

SEQ ID NO: 5174 - DNA, 603 bp, Strongylocentrotus purpuratus (purple urchin)
  CDS (1)..(603)
atgggcaagaaggaccgagacagttcgaagccgcgtggacgtatgtctgcatacgcttactttgtacaggattccagagcagagcatggcaagaaccaccctaacagtcctgtcaggtttgcagagttctccaaagattgctcagcaagatggaaggctctggaggagaagggaaagggtgttttccatgagaagtctatgcgtgacaaggttcgatacgatcgtgagatgcagtcctacaagcctcctaagggtgagaagaacaagaggagacgtcgcaggaaggacccagatgcacccaagaggaatctgtcagcattcttcatcttcagtggagagaacagagcagccataaagagtgttcatcccaactggtctgtgggtgatatcgccaaagaactggccgtcaggtggagagctatgactgctggggaaaagattccgtttgacaaaggtgctgctaaggacaaggagagatacatcaaggccatggccgagtacaaggcaaaggcaaaacccatgaagcgtcaagtcaaggaatcctccagctcaagttcctctgattccagctctgatgattcaagttcagatgatagcgattag

SEQ ID NO: 5175 - protein, 200 aa, Strongylocentrotus purpuratus (purple urchin)
MGKKDRDSSKPRGRMSAYAYFVQDSRAEHGKNHPNSPVRFAEFSKDCSARWKALEEKGKGVFHEKSMRDKVRYDREMQSYKPPKGEKNKRRRRRKDPDAPKRNLSAFFIFSGENRAAIKSVHPNWSVGDIAKELAVRWRAMTAGEKIPFDKGAAKDKERYIKAMAEYKAKAKPMKRQVKESSSSSSSDSSSDDSSSDDSD

SEQ ID NO: 5176 - DNA, 401 bp, Babesia bovis
  CDS (69)..(362)
gccgcctattgggcatattttggacgggcttgttttcttttttggttcattctggtctctttgctacgatggctggtgcttcggaccgtactggcgtgcgcagacctaggaaggctaagaaggatcccaacgctcctaagcgtgctttatcttcttacatgttttttgctaaggagaagcgtgtagagataattgctgagaaccctgagatcgctaaggacgttgctgctatcggtaagatgatcggtgctgcttggaatgctctttctgatgaggagaagaagccctatgagcgcatgtctgatgaagatcgtgttaggtacgagcgtgagaaggctgagtacgcccagaggaaggtatgatgcgaattgtattattaatttctttggttatctaaaaaa

SEQ ID NO: 5177 - protein, 97 aa, Babesia bovis
MAGASDRTGVRRPRKAKKDPNAPKRALSSYMFFAKEKRVEIIAENPEIAKDVAAIGKMIGAAWNALSDEEKKPYERMSDEDRVRYEREKAEYAQRKV

SEQ ID NO: 5178 - DNA, 327 bp, Schizosaccharomyces pombe
  CDS (1)..(327)
atgcctagagccgcaaaatccagccgtaaaaaagatccaaatactcctaaacgcaatatgtcggcgtttatgtttttttccattgagaaccgcgaaaagatgaaaacagacaaccctgatgccacctttggccagctaggatctttgttgggcaaaagatggaaagagcttacaagcacagaacgtgagccatacgaggaaaaagctcgtcaggacaaagaacgttatgaacgtgagagaaaagagtacgacactaaactagctaatggtgaaaaaactggtaaagcttcagctcctgctgctgctgctgccgccaaagaggaataa

SEQ ID NO: 5179 - protein, 108 aa, Schizosaccharomyces pombe
MPRAAKSSRKKDPNTPKRNMSAFMFFSIENREKMKTDNPDATFGQLGSLLGKRWKELTSTEREPYEEKARQDKERYERERKEYDTKLANGEKTGKASAPAAAAAAKEE

SEQ ID NO: 5180 - DNA, 1381 bp, Caenorhabditis elegans
  CDS (176)..(883)
cttctctctcctgtttcaccctattctattcgaattgtattcctctactctccactattcgcgtgatcttgtgcaactgattccttggagcgagacgaggaaaattcaaatataacgaaccgtcgttgtctcccgaaggaacatctgaaaatccgtgaaaaaataacgagtaacaatgaattctggttacagcgcaaacatttttcccagtagctcatcgcccactctgtatcagagtcaccaacttcagccgaatccatcagcaacgatgtatcaggcgaccccccgggatatgggtaaacctccagtacgaggcaagacatctccatacggattctttgtgaaaatgtgctacgaagaacacaagaaaaagtatccgaacgagaatgtccaagtgacagagatttcgaaaaagtgctcagaaaagtggaagacgatggttgacgatgagaagagacgtttctatgaactggcacaaaaggacgccgagcgatatcaggcagaggtgagtgttgccgcttacggaggagaagatgcgatgaggaagaggaagcgtgccaagaaggatccacatgcaccaaaaagagccctctcagccttcttcttttactcacaagacaaacgtcctgaaatacaggcaggtcatccagattggaaagtcggacaagttgcacaggagcttggaaaaatgtggaaactagtgccccaggagacgaaggatatgtatgagcaaaaagcacaagcggataaggatagatatgcggatgaaatgcgcaattacaaagctgaaatgcaaaaaatgtctggcatggaccattatgacgatgataacatccatcatgttgtacatgttgaagatattaatagtcaaaatatctcgtaatcattccaatttgttcgatttttgtaccccttatcgattcgctcttcataatttttctttaacacacaagcgcaaatcattcactttaccagtcaacaggaattcaaatgatttcttttttgtttctgtactccataaaacaccaaacacctcgctgaaccttcccactccacatcgccctcccccaccgttttagatctacaattttatttcacaagtaggccgagaatgagatacctgtaaataatcgctattgtcgattgaactttattttcaaaatccgtatgcaacccttgtattcccgtttgtcgttttatgattggtttactttattttatgttctgataattttttccacatcagcacaatgataaatgtcgcgattagtttcctctttcttttttgtctcttttccccttatatgttccatgtttccccgaaacaccatctcatttttaataaatttcatttcggttcaataaaaaaaaaaaaaaaaaa

SEQ ID NO: 5181 - protein, 235 aa, Caenorhabditis elegans
MNSGYSANIFPSSSSPTLYQSHQLQPNPSATMYQATPRDMGKPPVRGKTSPYGFFVKMCYEEHKKKYPNENVQVTEISKKCSEKWKTMVDDEKRRFYELAQKDAERYQAEVSVAAYGGEDAMRKRKRAKKDPHAPKRALSAFFFYSQDKRPEIQAGHPDWKVGQVAQELGKMWKLVPQETKDMYEQKAQADKDRYADEMRNYKAEMQKMSGMDHYDDDNIHHVVHVEDINSQNIS

SEQ ID NO: 5182 - DNA, 1194 bp, Homo sapiens
  CDS (77)..(724)
ttaattcggcggccgcggatccgagccggacgggcactgggcgactctgtgcttcgctgaggaaaaataactaaacatgggcaaaggagatcctaagaagccgagacggaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgaaaagctgaaggaaaaatacgaaaaggatattgctgcatatcgagctaaaggaaagcctgatgcagcaaaaaagggagttgtcaaggctgaaaaaagcaagaaaaagaaggaagaggaggaaggtgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtatcttcaatagccactaaccctgcctggtacagtatgggggttgtaaattggcatggaaatttaaagcaggttcttgtttgggcacagcacaaattagttatatatggggatggtagttttttcatcttcagttgtctctgatgcagctatacgaaataattgttgttctgttaactgaataccactctgtaattgcaaaaaaaaaaaaaaagttgcagctgttttgttgacattctgaatgcttctaagtaaatacaattttttttattaaaaaaaaaa

SEQ ID NO: 5183 - protein, 215 aa, Homo sapiens [sequence omitted]

SEQ ID NO: 5184 - DNA, 392 bp, Plasmodium falciparum
  CDS (79)..(372)
catttacgtattgattatttcgataattttgattatttataaaattttttcggatatactttttataacaacgctagaatgaagaatacaggaaaagaagttcgtaaaagaagaaaaaagaaaaaagacccacatgcccccaagagatccttatcagcttacatgttttttgcaaaggagaaaagagcagagattataagtaaacaacctgagttaagtaaagatgtagcaacagtaggaaagatgatcggagaagcatggaataaattaggagaaaaagaaaaggccccttttgaaaaaaaagcacaagaagataaattaagatacgaaaaagaaaaagcagaatatgcaaatatgaaaatgaaagcttaaattggcttgagagaaaaaat

SEQ ID NO: 5185 - protein, 97 aa, Plasmodium falciparum
MKNTGKEVRKRRKKKKDPHAPKRSLSAYMFFAKEKRAEIISKQPELSKDVATVGKMIGEAWNKLGEKEKAPFEKKAQEDKLRYEKEKAEYANMKMKA

SEQ ID NO: 5186 - DNA, 543 bp, Plasmodium yoelii yoelii
  CDS (72)..(389): n means a or g or c or t/u
ttaaaaatatatacaaatataaagtattaatttcctgtcctttatattttaaaaaaaaaggtttttcaataatggatggcatgaaaaaatttaaagatatgaaaatgggtggaaaggaagtaaagaaacgaagaaaaaataaaaaggatccacatgcacctaaaaggtctttatcagcttatatgttttttgcaaaagaaaagagagcagagataataactcgagatccgagtttaagtaaagatgttgcaactgttggaaaaatgattggagaagcatggaataaattagacgaaagggaaaaagccccatatgaaaaaaaagcacaagaagacaaaataagatatgaaaaagaaaaaatggaatatgccaaaagtaaaatgaaataaaaaaataaatttattttattcataaaaggaaagtatatataataaaatattatatgaatgtgtatctatttntatgtatatatcaaaatgtatgcattatgtatacantgacaaagatatgaaaatataccagtgcccatagttaaataatatg

SEQ ID NO: 5187 - protein, 105 aa, Plasmodium yoelii yoelii
MDGMKKFKDMKMGGKEVKKRRKNKKDPHAPKRSLSAYMFFAKEKRAEIITRDPSLSKDVATVGKMIGEAWNKLDEREKAPYEKKAQEDKIRYEKEKMEYAKSKMK

SEQ ID NO: 5188 - DNA, 312 bp, Neurospora crassa
  CDS (1)..(312)
atgcccaaggccgccgccaaaagcaagaccaccggcaaggtcgagaaacgccgcgcgaagaaggaccccaacgccccgaagcgtggcctctctgcctacatgttctttgccaatgagcagcgtgagaatgtccgtgaagagaacccaggcgtttctttcggtcaggttggcaagatccttggagaaaggtggaaggctctcagcgacaagcagcgtgccccctacgaggccaaggctgctgccgacaagaagcgctatgaggacgagaagcaggcgtacaacgccgaggccgacgaggaggagtcttcctga

SEQ ID NO: 5189 - protein, 103 aa, Neurospora crassa
MPKAAAKSKTTGKVEKRRAKKDPNAPKRGLSAYMFFANEQRENVREENPGVSFGQVGKILGERWKALSDKQRAPYEAKAAADKKRYEDEKQAYNAEADEEESS

SEQ ID NO: 5190 - DNA, 618 bp, Brachydanio rerio
  CDS (1)..(618)
atggggaaggatccgacaaaaccaaggggcaaaatgtcctcttacgcatactttgtccagacttgcagagaggagcacaagaagaaacaccccgaggcgacggtcaacttttctgagttttccaaaaagtgctcagagcgatggaagactatgtcagccaaagaaaaagggaagtttgaagacatggccaaactggacaaggcacgttacgagagggagatgaagaactacattccacccaaaggcgagaagaagaagaggtttaaggaccccaatgctcccaagagacccccgtctgccttcttcattttctgctccgagttccgacccaaggtgaaagaagagaccccgggtctgtctatcggagacgtggccaagagactgggtgagatgtggaacaaaatatcatctgaagagaagcagccgtacgagaagaaggccgccaagctgaaggagaagtacgagaaggacatcgctgcctatcgctctaaaggcaaagtgggaggaggcgcagccaaagccccatccaagccagacaaggctaacgatgaggacgaagacgacgacgaagaggaggacgaagatgacgatgatgaagaggaggatgacgacgagtag

SEQ ID NO: 5191 - protein, 205 aa, Brachydanio rerio
MGKDPTKPRGKMSSYAYFVQTCREEHKKKHPEATVNFSEFSKKCSERWKTMSAKEKGKFEDMAKLDKARYEREMKNYIPPKGEKKKRFKDPNAPKRPPSAFFIFCSEFRPKVKEETPGLSIGDVAKRLGEMWNKISSEEKQPYEKKAAKLKEKYEKDIAAYRSKGKVGGGAAKAPSKPDKANDEDEDDDEEEDEDDDDEEEDDDE

SEQ ID NO: 5192 - DNA, 627 bp, Dermacentor variabilis
  CDS (1)..(627)
atgggcaaaggagacaagcctcgcggccggatgtctgcgtacgccttctttgtgcagacctgccgggaggagcacaagaagaagcacccgaacgagaacgtggtgttcgccgagttctcgaagaaatgtgccgagcgctggaagaccatgagcgagagcgagaagaagcgcttccatcagatggccgacaaggacaagaagcgcttcgacaccgagatggccgactacaagccgcccaagggcgacaagtccaagaagcgcaagcgcgcaaaggatcccaatgcacctaagcgccccttgtctgctttcttctggttctgcaatgacgagagacccaacgtgcgccaggagagcccagatgcctctgtcggtgaggtggcgaaagagctgggccggcgatggaatgaggttggcgacgacgtcaagtcaaagtacgagggcctggctgccaaggacaaggcgcgttacgagaaggaactgaaggcctacaagggaaagaagcccaaggctgcatctccaccaaaggagaaggccaaaaagaaggaagaggatgatgacgaagatgatgacgatgaagaagatgaggttgaggatgctgaagatgatgatgacgacgacgaggattga

SEQ ID NO: 5193 - protein, 208 aa, Dermacentor variabilis
MGKGDKPRGRMSAYAFFVQTCREEHKKKHPNENVVFAEFSKKCAERWKTMSESEKKRFHQMADKDKKRFDTEMADYKPPKGDKSKKRKRAKDPNAPKRPLSAFFWFCNDERPNVRQESPDASVGEVAKELGRRWNEVGDDVKSKYEGLAAKDKARYEKELKAYKGKKPKAASPPKEKAKKKEEDDDEDDDDEEDEVEDAEDDDDDDED

SEQ ID NO: 5194 - DNA, 648 bp, Mus musculus
  CDS (1)..(648)
atgggcaaaggagatcctaaaaagccgagaggcaaaatgtcctcatatgcattctttgtgcaaacttgccgggaggagcacaagaagaagcacccggatgcttctgtcaacttctcagagttttccaagaagtgctcagagaggtggaagaccatgtctgctaaagaaaaggggaaatttgaagatatggcaaaggctgacaaggctcgttatgaaagagaaatgaaaacctacatcccccccaaaggggagaccaaaaagaagttcaaggaccccaatgcacccaagaggcctccttcggccttcttcttgttctgttctgagtaccgccccaaaatcaaaggcgagcatcctggcttatccattggtgatgttgcaaagaaactaggagagatgtggaacaacactgcagcagatgacaagcagccctatgagaagaaagctgccaagctgaaggagaagtatgagaaggatattgctgcctacagagctaaaggaaaacctgatgcagcgaaaaagggggtggtcaaggctgaaaagagcaagaaaaagaaggaagaggaagatgatgaggaggatgaagaggatgaggaagaggaggaagaagaggaagacgaagatgaagaagaagatgatgatgatgaataa

SEQ ID NO: 5195 - protein, 215 aa, Mus musculus
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEDDEEDEEDEEEEEEEEDEDEEEDDDDE

SEQ ID NO: 5196 - DNA, 300 bp, Plasmodium falciparum
  CDS (1)..(300)
atggcttcaaaatctcaaaagaaagttttaaaaaaacaaaacaaaaaaaagaaaaaagacccattagctccaaagagagctttgtctgcctatatgttttatgttaaggataagagactagaaataataaaagaaaaaccagaattagcaaaagatgttgcacaagttggtaaattgataggtgaagcttggggacaattaagcccagctcaaaaagccccatatgaaaagaaagcccaattagacaaagtccgatattcaaaagaaatagaagaatatagaaagaaaaatcaagaataa

SEQ ID NO: 5197 - protein, 99 aa, Plasmodium falciparum
MASKSQKKVLKKQNKKKKKDPLAPKRALSAYMFYVKDKRLEIIKEKPELAKDVAQVGKLIGEAWGQLSPAQKAPYEKKAQLDKVRYSKEIEEYRKKNQE

SEQ ID NO: 5198 - DNA, 699 bp, Homo sapiens
  CDS (83)..(667)
ccccgcgtccgctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatga

SEQ ID NO: 5199 - protein, 195 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEE

SEQ ID NO: 5200 - DNA, 915 bp, Gallus gallus
  CDS (183)..(830)
gaattcggcacgaggtgtgaggaggctgcgtatcgatcccgctctcacagccattgcggtgcattgggctacacagggacccaggcagcgctggggccggggcgagcggccgggcgggcgtctctggggctgggggccgagcgagggctgcgtgccgactctgacgcggaaaatcctcaaaaatgggcaaaggtgatcccaagaagccgagaggtaaaatgtcttcatacgccttctttgtgcaaacctgccgggaggagcacaagaagaaacatccagatgcttcagtgaacttctcagagttctcaaaaaaatgctcagaacgatggaagactatgtcttctaaggagaaagggaagtttgaagatatggcaaaggctgacaagcttcgttatgaaaaagaaatgaaaaactatgtaccacctaagggggaaacaaaaaagaagttcaaggatccaaatgcaccgaagaggcctccttcggcttttttcttgttttgctctgagtttcgtccaaaaatcaaaggagaacatcccggtctgtccattggggacgtggcaaagaaactgggagagatgtggaacaacaccgcagcagatgataaacagccttacgaaaagaaggctgctaagctgaaggagaagtatgagaaggatattgctgcataccgggccaaagggaaggttgatgcaggcaaaaaagtagttgccaaggccgagaagagcaagaagaagaaggaagaagaggaagatgaggacgaagacgaagaggatgaagaggacgaagaagaggaagaagaggaggaggaagatgatgatgatgatgaataagtctcttttagagcaatttctttcttgtctataaagcatttaacccccctgtacacaactcactccttttactcgtgccgaattc

SEQ ID NO: 5201 - protein, 215 aa, Gallus gallus
MGKGDPKKPRGKMSSYAFFVQTCREEHKKKHPDASVNFSEFSKKCSERWKTMSSKEKGKFEDMAKADKLRYEKEMKNYVPPKGETKKKFKDPNAPKRPPSAFFLFCSEFRPKIKGEHPGLSIGDVAKKLGEMWNNTAADDKQPYEKKAAKLKEKYEKDIAAYRAKGKVDAGKKVVAKAEKSKKKKEEEEDEDEDEEDEEDEEEEEEEEEDDDDDE

SEQ ID NO: 5202 - DNA, 294 bp, Plasmodium falciparum
  CDS (1)..(294)
atgaagaatacaggaaaagaagttcgtaaaagaagaaaaaacaaaaaagacccacatgcccccaagagatccttatccgcttacatgttttttgcaaaggagaaaagagcagagattataagtaaacaacctgagttaagtaaagatgtagcaacagtaggaaagatgatcggagaagcatggaataaattaggagaaaaagaaaaggccccttttgaaaaaaaagcacaagaagataaattaagatacgaaaaagaaaaagcagaatatgcaaatatgaaaatgaaagcttaa

SEQ ID NO: 5203 - protein, 97 aa, Plasmodium falciparum
MKNTGKEVRKRRKNKKDPHAPKRSLSAYMFFAKEKRAEIISKQPELSKDVATVGKMIGEAWNKLGEKEKAPFEKKAQEDKLRYEKEKAEYANMKMKA

SEQ ID NO: 5204 - DNA, 279 bp, Candida albicans
  CDS (1)..(279)
atggctccaggtgaaagaaagaagtcctctagaaagaagaaggatccagatgctccaaaaagatccttatctgcttatatgtttttcgctaatgaaaacagagatattgttagagctgaaaacccaggtatctcttttggtcaagttggtaaattattaggtgaaaaatggaaggctttaaacagtgaagataaattaccttacgaaaacaaggctgaagctgataaaaagagatatgaaaaagaaaaggctgaatacgctaaaaagaattccgcctaa

SEQ ID NO: 5205 - protein, 92 aa, Candida albicans
MAPGERKKSSRKKKDPDAPKRSLSAYMFFANENRDIVRAENPGISFGQVGKLLGEKWKALNSEDKLPYENKAEADKKRYEKEKAEYAKKNSA

SEQ ID NO: 5206 - DNA, 1266 bp, Mus musculus
  CDS (90)..(737)
attgagctccatagagacagcgccggggcaagcgcgagccggacgggcactgggcgactctgtgcctcgcggaggaaaatcaactaaacatgggcaaaggagatcctaagaagccgagaggcaaaatgtcctcatatgcattctttgtgcaaacttgccgggaggagcacaagaagaagcacccggatgcttctgtcaacttctcagagttctccaagaagtgctcagagaggtggaagaccatgtctgctaaagaaaaggggaaatttgaagatatggcaaaggctgacaaggctcgttatgaaagagaaatgaaaacctacatcccccccaaaggggagaccaaaaagaagttcaaggaccccaatgcacccaagaggcctccttcggccttcttcttgttctgttctgagtaccgccccaaaatcaaaggcgagcatcctggcttatccattggtgatgttgcaaagaaactaggagagatgtggaacaacactgcagcagatgacaagcagccctatgagaagaaagctgccaagctgaaggagaagtatgagaaggatattgctgcctacagagctaaaggaaaacctgatgcagcgaaaaagggggtggtcaaggctgaaaagagcaagaaaaagaaggaagaggaagatgatgaggaggatgaagaggatgaggaagaggaggaagaagaggaagacgaagatgaagaagaagatgatgatgatgaataagttggttctagcgcagttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtctgggggttgtaaattggcatggaaatttaaagcaggttcttgttggtgcacagcacaaattagttatatatggggacagtagtttggttttttgttttgtttttttcttttggttttctttctgggttttatttttttcatcttcagttgtctctgatgcagcttatacgaagataattgttgttctgttaactaaatacccctctgtaattgcaaaaaaaaaaattgcggctgttttgttgacattctgaatgcttctaagtaaatacaattttttttattaaaaaaaaaaaaaaaaaaaaaaaa

SEQ ID NO: 5207 - protein, 215 aa, Mus musculus; identical to SEQ ID NO: 5195

SEQ ID NO: 5208 - DNA, 782 bp, Mus musculus
  CDS (60)..(692)
ctctctgcggaggtctgagggaagcagcgctcgcagcagacagacgccgcgccgtcgtcatgggcaagggtgaccccaacaagccgcggggcaaaatgtcctcgtacgccttcttcgtgcagacctgccgcgaggagcacaagaagaagcatcccgactcgtcggtgaacttcgccgagttctccaagaaatgctccgagagatggaagaccatgtctgcaaaggaaaagtccaagtttgaagatttggccaagagcgacaaagctcgttatgacagggagatgaagaactatgttcctcccaaaggggataagaaaggaaagaaaaaagaccccaatgctccgaagagaccaccgtctgccttcttcctgttttgctctgaaaatcgcccaaagatcaaaattgaacacccaggcctgtctattggagatactgcgaagaaactgggtgagatgtggtctgagcaatctgccaaagataaacaaccgtatgagcagaaagcagctaaactaaaggagaagtatgaaaaggatattgctgcataccgtgccaagggcaaaagtgaagcaggaaagaagggtcctggtaggccaacaggctcaaagaagaagaacgaaccagaagatgaggaggaggaagaagaggaggaagaggaggaagatgacgaggaagaagaggaggatgaagaataagtggctgtcctaaagtgtggagtatatttgctcaggcaattattttgctaagaatgtgaaattcaagtgcagctcaacattagcttcagt

SEQ ID NO: 5209 - protein, 210 aa, Mus musculus
MGKGDPNKPRGKMSSYAFFVQTCREEHKKKHPDSSVNFAEFSKKCSERWKTMSAKEKSKFEDLAKSDKARYDREMKNYVPPKGDKKGKKKDPNAPKRPPSAFFLFCSENRPKIKIEHPGLSIGDTAKKLGEMWSEQSAKDKQPYEQKAAKLKEKYEKDIAAYRAKGKSEAGKKGPGRPTGSKKKNEPEDEEEEEEEEEEEDDEEEEEDEE

SEQ ID NO: 5210 - DNA, 1153 bp, Sus scrofa
  CDS (144)..(776)
acaaaccagttcacgccggagccgcaggtaggcagcgtcgcggtcggacccggccgctgcgcgggagcctgaggagaagctaccaccaggcaagagacccctccgggccccggtggacgcgtcgtcgccggcgccgcagcaccatggggaagggcgaccccaacaagccgcggggcaagatgtcctcgtacgccttcttcgtgcagacctgccgggaggagcacaagaagaaacaccccgattcctcggtcaacttcgccgagttctccaagaagtgctccgagcgatggaagactatgtctgccaaggaaaagtccaagtttgaagatatggcaaaaagtgacaaagctcgctatgaccgggagatgaaaaattacgtccctcccaagggtgacaagaagggcaagaaaaaagatcccaatgctcccaaaaggcctccatctgccttcttcctgttttgctctgaacatcgcccaaagatcaaaagtgaacaccctggcttatccattggggatactgcaaagaaattgggtgaaatgtggtctgagcagtcagccaaagataaacaaccgtatgaacagaaagcagctaagctaaaggaaaaatatgaaaaggatattgctgcataccgtgccaagggtaagggtgaagcaggaaagaagggccctggcaggccaacaggctctaagaagaagaatgaaccagaagatgaggaggaagaggaagaggaggaagaagatgaagacgaggaggaagaagatgaagatgaggaataaatggctatcctgtaatgttgtgtgtggagtgtgtgtgtgtgctcaggcaattattttgctaagaatgtgaattcaagtgcagctcaatattagcttcagtataaaaactgtacagatttttgtatagctaataagattctttgtagagaaaatactttttttaaaagtgcaggttgcagctttttgaggggctactacatacagttagattttaaagcttctgatgttgaatgtttctaaatatttaatggtttctttaatttcttgtgtatggtaacagcaaactcgtagaaataagtatcaatagcaaattttgggttttctagaatgttgcattttgttttttaaaaaaattttgtaataaaattatgtatatt

SEQ ID NO: 5211 - protein, 210 aa, Sus scrofa
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKGEAGKKGPGRPTGSKKKNEPEDEEEEEEEEEDEDEEEEDEDEE

SEQ ID NO: 5212 - DNA, 285 bp, Ashbya gossypii
  CDS (1)..(285)
atggccgcggcagccacaaccaagaagagaacgcaacgcaagaagaaggaccccaacgcgcccaagcgcgcgatgtccgcgtacatgttcttcgccaacgagaaccgcgacatcgtgcgcgcggagaacccgggcatctcgttcgggcaggtgggacgcgtgctcggcgagaagtggaaggcgctctcggacgacgagaagcagccgtacgaggccaaggcggaggcggacaagaagcgctacgagtctgagaaggagctgtacaacgccacaaaggcggcgtga

SEQ ID NO: 5213 - protein, 94 aa, Ashbya gossypii
MAAAATTKKRTQRKKKDPNAPKRAMSAYMFFANENRDIVRAENPGISFGQVGRVLGEKWKALSDDEKQPYEAKAEADKKRYESEKELYNATKAA

SEQ ID NO: 5214 - DNA, 833 bp, Branchiostoma belcheri tsingtaunese
  CDS (61)..(729)
accataggcttcgctgcagaactttgaggtgttaacccatagagtatcaagtcagccatcatgccaaaggacaagaacaagcctaaggggaagatgtcggcgtacgcctgcttcgtgcaggagtgccgccgcgagcacgagaagaagtaccccaacaagcaggttgtcttcacggagttctcccagaagtgtgcttcgagatggaagaccatgaatgatgacgagaagaagcgcttccaggcccttgccgaagcagacaagaggcggtacgaacaggacatggccaagtacgtcccacccaagggtgccgagggtggccgcaggaagaggaagaagaaggaccccaaygcaccaaagagggccatgtctgccttcttcatgtattgtgctgatgcgcgtcccaaggtccgtgcagcacatccrgatttccaagtgggggatatcgcgaagatcctggggaagcagtggaaggaaatctcagattcagacaaggccaagtatgaaaagaaggcccaaactgaaaaggctcgctaccagaaggagcttgcggagtacaagagaagtgggggtggtgccagccctgccaagaagggccgtccagccaagaaggcgccaccaccaaagagggtagaggaggaagatgatgatgatgaggacgaggatgaggaggaagaagaggaggaggaggatgaagatgaggacgatgaggaagatgaggaggacgagtagatctgttatcctcaaaggttctttctcagctgtacacatctgaaagctcattccagtccatcttctctatcaacctaggcaggacaaaaaaaaaaaaaaaaaaa

SEQ ID NO: 5215 - protein, 222 aa, Branchiostoma belcheri tsingtaunese
MPKDKNKPKGKMSAYACFVQECRREHEKKYPNKQVVFTEFSQKCASRWKTMNDDEKKRFQALAEADKRRYEQDMAKYVPPKGAEGGRRKRKKKDPNAPKRAMSAFFMYCADARPKVRAAHPDFQVGDIAKILGKQWKEISDSDKAKYEKKAQTEKARYQKELAEYKRSGGGASPAKKGRPAKKAPPPKRVEEEDDDDEDEDEEEEEEEEDEDEDDEEDEEDE

SEQ ID NO: 5216 - DNA, 24 bp, artificial sequence
  primer
atggccgcaactaaagaagcaaag

SEQ ID NO: 5217 - DNA, 25 bp, artificial sequence
  primer
tcaagcacgtgtagcattgtacaat

SEQ ID NO: 5218 - DNA, 411 bp, Saccharomyces cerevisiae
  CDS (1)..(411)
atgggtagagttagaaccaagaccgtcaaacgtgcctccaaggctttgattgaacgttactatccaaagttgaccttggatttccaaactaacaagagactttgtgatgaaattgcaactatccaatccaagagattgagaaacaagattgctggttacactactcatttgatgaaaagaatccaaaagggtccagttagaggtatttctttcaaattgcaagaagaagaaagagaaagaaaggatcaatacgtcccagaagtctctgctttggacttgtctcgttctaacggtgttttgaacgttgacaaccaaacctctgacttggttaaatctttgggtttgaagttgccattatctgtcatcaacgtttccgctcaaagagacagacgttacagaaagagaaactaa

SEQ ID NO: 5219 - protein, 136 aa, Saccharomyces cerevisiae
MGRVRTKTVKRASKALIERYYPKLTLDFQTNKRLCDEIATIQSKRLRNKIAGYTTHLMKRIQKGPVRGISFKLQEEERERKDQYVPEVSALDLSRSNGVLNVDNQTSDLVKSLGLKLPLSVINVSAQRDRRYRKRN

SEQ ID NO: 5220 - DNA, 420 bp, Aspergillus fumigatus
  CDS (1)..(420)
atgggtcgcgttagaaccaagacagtcaagaggtccgccaaggtcatcatcgagcgctactaccccaagttgacgctcgactttgagaccaacaagcgtctttgcgatgagatcgctatcattgcctccaagcgccttcgcaacaagattgctggttacaccacccaccttatgaagcgtatccagcgtggccctgtccgcggtatctctttcaagctgcaggaggaggagcgtgagcgcaaggatcagtacgttcctgaggtttccgctctggatgtttcccagaccgagtccggccagctcgatgtcgatgccgacaccaaggaccttctcaagtccatgggcttcgacaatctcaaggtcaacgttgtcaacgtctcccaacatcaggttcaggagcgcccccgccgcttccggtag

SEQ ID NO: 5221 - protein, 139 aa, Aspergillus fumigatus
MGRVRTKTVKRSAKVIIERYYPKLTLDFETNKRLCDEIAIIASKRLRNKIAGYTTHLMKRIQRGPVRGISFKLQEEERERKDQYVPEVSALDVSQTESGQLDVDADTKDLLKSMGFDNLKVNVVNVSQHQVQERPRRFR

SEQ ID NO: 5222 - DNA, 561 bp, Arabidopsis thaliana (mouse-ear cress)
  CDS (10)..(435)
aactgaaagatggggcgtgttagaaccaagaccgtgaagaaatcttctcgtcaagtcattgagaagtactactctcgcatgactcttgactttcacactaacaagaagatccttgaagaggttgccatcatcccatcaaagagactccgcaacaagattgctggattctccacccacttgatgaaacgtatccagaagggaccagtccgtggaatctcactcaagcttcaagaagaagagcgtgaacgccgtatggactttgttcccgatgagtctgctatcaagactgatgagatcaaggtcgacaaagagactcttgagatgcttgcttctctaggaatgtctgacactctcggcatctctgcagtcgacccacaacaagctatggcaccaatccctgctttcggcggcggcagggcacccagaagatactaagatggacgattggctctcttttttcacagttagggacaagaaagacttgtgtgttatgtcttaaactcaatgtgagactctttcgtattaatggtttttgagttatgtggaaccaaaattggagtt

SEQ ID NO: 5223 - protein, 141 aa, Arabidopsis thaliana (mouse-ear cress)
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDTLGISAVDPQQAMAPIPAFGGGRAPRRY

SEQ ID NO: 5224 - DNA, 540 bp, Arabidopsis thaliana (mouse-ear cress)
  CDS (1)..(540)
atgtttcaccaaccctattttctctacttctctccgcctctctcgcatctccaaatcgaaatcgctctctgcctctcttcgtctccgtctccgtctccgtctccatctctgtctccgatggggcgtgttagaaccaagacggtgaagaaatcttcacgtcaagtcattgagaagtactactctcgcatgactcttgactttcacactaacaagaagatccttgaagaggttgccatcatcccatcaaagagactccgcaacaagattgctggattctccacccacttgatgaaacgtatccagaagggaccagtccgtggaatctcactcaagcttcaagaagaagagcgtgaacgccgtatggactttgttcccgatgagtctgctatcaagactgatgagatcaaggtcgacaaagagactcttgagatgcttgcttctctaggaatgtctgacacatccggcatctctgcagtcgagccacaacaagctatggcaccaatcgctgctttcggcggcagggcacccagaagatactaa

SEQ ID NO: 5225 - protein, 179 aa, Arabidopsis thaliana (mouse-ear cress)
MFHQPYFLYFSPPLSHLQIEIALCLSSSPSPSPSPSLSPMGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDTSGISAVEPQQAMAPIAAFGGRAPRRY

SEQ ID NO: 5226 - DNA, 357 bp, nucleomorph Guillardia theta
  CDS (1)..(357)
atgggcaaagttcgtactaaaactattaaaagatcagcaaaatatatatttattaaatatttcaaacatttaacaattgattttcaagaaaataaattcttttgtgatgaaattgctttgataacttctaaatctctaagaaacaaaatagcagggtatgtaactcatttaattaaagaatttttcaaaggtaaaaaaaaaaaaatttatacaaatataaagtttgatataaataatattgagataaacaataaagaatctgaagttttttcaaacacagaacttaaattaaacttagttgatgatgaaactaagcagatgattaaaaaattatttccaaataaaaatattatttaa

SEQ ID NO: 5227 - protein, 118 aa, nucleomorph Guillardia theta
MGKVRTKTIKRSAKYIFIKYFKHLTIDFQENKFFCDEIALITSKSLRNKIAGYVTHLIKEFFKGKKKKIYTNIKFDINNIEINNKESEVFSNTELKLNLVDDETKQMIKKLFPNKNII

SEQ ID NO: 5228 - DNA, 543 bp, Drosophila melanogaster
  CDS (54)..(449)
ctttttctttcgtttccggcgagcggtgattaaaatatccatcgagcaacataatgggtcgcgtacgaaccaagacggtgaagaaggccgctaaggtcatcatcgagaagtactacactcgcctgacgttggacttccacaccaacaagcgcatctgcgaggaggtggccatcattcccaccaagcccctgcgcaacaagattgccggctatgtcacccatttgatgggccgcctgcgtcactcccaggtgcgtggtatctccatcaagttgcaggaggaggagcgtgagcgtcgtgacaactacgtcccggccgtctccgctctggagcaggacatcatcgaggtcgacgccgacaccaaggagatgttgaagcttctggacttccacaacatccgtggcctgcagctcacccagcccaacaccaacaactttggtcgtcgcaactaagatttgtatagcgcgtagatgatgatgttctgatttgcatgggatcacaataaatttgtgtgaagtgcatttaaagtgtaaaaaaaaaaaaaaa

SEQ ID NO: 5229 - protein, 131 aa, Drosophila melanogaster
MGRVRTKTVKKAAKVIIEKYYTRLTLDFHTNKRICEEVAIIPTKPLRNKIAGYVTHLMGRLRHSQVRGISIKLQEEERERRDNYVPAVSALEQDIIEVDADTKEMLKLLDFHNIRGLQLTQPNTNNFGRRN

SEQ ID NO: 5230 - DNA, 414 bp, Homo sapiens (man)
  CDS (7)..(414)
gccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttag

SEQ ID NO: 5231 - protein, 135 aa, Homo sapiens (man) [sequence omitted]

SEQ ID NO: 5232 - DNA, 441 bp, Neurospora crassa
  CDS (1)..(441)
atgggtcgcgttcgtaccaagactgtcaagaagtccgccaaggtcatcattgagcggtactaccccaagttgaccctcgacttcgagaccaacaagcgcatctgcgatgagatcgccatcattgcctccaagcgcctccgcaacaagattgccggctacaccacccacttgatgaagcgtatccagcgtggccccgtccgcggtatctccttcaagctgcaggaggaggagcgtgagcgcaaggaccagtacgttcccgaggtctctgctctcgacttcacccagaactccgagagcggtcagctcgacgtcgacaccgagaccaaggacctcctcaagcacctcggcttcgactccatccccgtcaacgtcatccccgtcacccaggcccagcctgtcgagcgcggccgccgcttcggcgaccgtccccgccgcgactaa

SEQ ID NO: 5233 - protein, 146 aa, Neurospora crassa
MGRVRTKTVKKSAKVIIERYYPKLTLDFETNKRICDEIAIIASKRLRNKIAGYTTHLMKRIQRGPVRGISFKLQEEERERKDQYVPEVSALDFTQNSESGQLDVDTETKDLLKHLGFDSIPVNVIPVTQAQPVERGRRFGDRPRRD

SEQ ID NO: 5234 - DNA, 411 bp, Dictyostelium discoideum
  CDS (4)..(411)
aaaatgggtcgtgttagaacaaagacaatcaaaagagcttccaaactcctcattgagaagcattacccaagacttaccaatgacttcgacactaacaagagaacttgcgacaaactcgccaagatcccatcaaaacgtttaagaaacaagattgctggtttctgtacccatttaatgagacgtattgctaatggtccagtccgtggtatttcttacaaattacaagaagaagaaagagaaaagagagataactacgttccacaagaatcagccatcaaaaccaacgaagttaaaatcgatcgtgatgttgaagaaatgcttaaatctactttggaattcccaaccatcccacaaatccacgtcgttgaccaaaagagatacaacaaaaacaccaaaaaatcaaacaaatag

SEQ ID NO: 5235 - protein, 135 aa, Dictyostelium discoideum
MGRVRTKTIKRASKLLIEKHYPRLTNDFDTNKRTCDKLAKIPSKRLRNKIAGFCTHLMRRIANGPVRGISYKLQEEEREKRDNYVPQESAIKTNEVKIDRDVEEMLKSTLEFPTIPQIHVVDQKRYNKNTKKSNK

SEQ ID NO: 5236 - DNA, 600 bp, Caenorhabditis elegans
  CDS (37)..(414)
ggtttaattacccaagtttgagaacttcggttaaacatgagtcgtgttcgtaccaagaccgtcaagaaggcttcccgtgtcctcatcgagaagtactacactcgcatgaccaatgacttccataacaacaagcgcgtctgtgacgaggttgccatcatcggaagcaagccactcagaaacaagatcgctggatacatcactcacttgatgagacgtatcgagagaggaccagtcagaggtatctccatcaagcttcaagaagaggagcgtgagcgcagagacaactacatgccagagatctccactgttgatccatctcaactcacctccatcaaggttgacactgataccagcgacatgctcaaggccgctgtaagttttcaaaaaattaagattcagttatgggagtcctgaaagctgctttgccggttttcaggctttccctatccaaaacgctcgttcgagtgtttcagttcggtatgtcgaggcgttaccggacggaaaatatttaaaataaaatcctcgtcatttcagggattcaaccttccaaacgtcaccgttgaggatcaaggaaagaacaagggaaagtaaatattccct

SEQ ID NO: 5237 - protein, 125 aa, Caenorhabditis elegans
MSRVRTKTVKKASRVLIEKYYTRMTNDFHNNKRVCDEVAIIGSKPLRNKIAGYITHLMRRIERGPVRGISIKLQEEERERRDNYMPEISTVDPSQLTSIKVDTDTSDMLKAAVSFQKIKIQLWES

SEQ ID NO: 5238 - DNA, 396 bp, Schizosaccharomyces pombe
  CDS (1)..(396)
atgggtcgtgtacgtaccaaaactaccaagagagcttcccgtgtggtaattgaaaaatattaccctcgtctcactcttgatttccaaaccaacaagagaattgttgacgaagtcgctatcatcgcctctaagcgtcttcgtaataaaattgccggttacacgactcacttaatgaaacgtattcaacgtggtcccgttcgtggtatctccttcaagcttcaagaagaggagcgtgaacgcaaggatcaatacgttcctgaagtttctgagcttgaggtcgatcgtgttaacgttgaccaagacaccaaggacatgcttaagtctcttggctacgatcaaattcccgtccgtgtgcttgctcctgcccctcaagagcgtttccgtcgcagacagtaa

SEQ ID NO: 5239 - protein, 131 aa, Schizosaccharomyces pombe
MGRVRTKTTKRASRVVIEKYYPRLTLDFQTNKRIVDEVAIIASKRLRNKIAGYTTHLMKRIQRGPVRGISFKLQEEERERKDQYVPEVSELEVDRVNVDQDTKDMLKSLGYDQIPVRVLAPAPQERFRRRQ

SEQ ID NO: 5240 - DNA, 426 bp, Arabidopsis thaliana (mouse-ear cress)
  CDS (1)..(426)
atggggcgtgttagaaccaagactgtgaagaaatcttctcgtcaagtcatcgagaagtactactctcgcatgactcttgacttccacactaacaagaaaatccttgaagaggttgccatcatcccttcaaagagactccgcaacaagattgctggattctccacccacttgatgaaacgtatccagaagggaccagtccgtggaatctcactcaagcttcaggaagaggagcgtgaacgccgcatggactttgttcccgatgagtctgccatcaagactgatgagatcaaggtggacaaagagactcttgagatgcttgcttctctaggaatgtctgacactcccggcatctctgcagtcgagccacaacaagctatggcaccaatcgctgctttcggtggtggcagggcacccagaagatactga

SEQ ID NO: 5241 - protein, 141 aa, Arabidopsis thaliana (mouse-ear cress) [sequence omitted]

SEQ ID NO: 5242 - DNA, 399 bp, Schizosaccharomyces pombe
  CDS (1)..(399)
atgggtcgtgtacgcaccaaaactacgaagagagcttctcgcgtagttatcgagaaatactaccctcgtcttacattggacttccaaaccaataagaggattgtcgatgaggttgctatcattgcttccaagcgtctccgcaacaagattgctggatacacgactcatcttatgaaacgtatccaacgcggtcctgtccgtggtatttccttcaagcttcaagaagaagagcgtgagcgcaaggatcaatacgttcctgaagtctctgagctcgagaaggacaagattaacgttgatcaagacaccaaggatatgcttaaagctcttggctacgactctatccctactgtcgttgtcgctgcctctcgccctgagcgtcccttccgttacagacactaa

SEQ ID NO: 5243 - protein, 132 aa, Schizosaccharomyces pombe
MGRVRTKTTKRASRVVIEKYYPRLTLDFQTNKRIVDEVAIIASKRLRNKIAGYTTHLMKRIQRGPVRGISFKLQEEERERKDQYVPEVSELEKDKINVDQDTKDMLKALGYDSIPTVVVAASRPERPFRYRH

SEQ ID NO: 5244 - DNA, 570 bp, Phaffia rhodozyma
  CDS (49)..(501): n means a or g or c or t/u
cttcctcccgtcaaggcaaaccttcagaatcctctcaagtcattcaacatgggacgagtccgcaccaaaaccgtcaagcgagcttcgcgagtgatgatcgagaagttctaccctcgactcactcttgatttccacaccaacaagcgaatcgccgacgaggttgccatcatcccctccaagcgacttcgaaacaagatcgctgggttcactacccacttgatgaagcgaatccagaagggacccgttcgaggtatctccttcaagcttcaggaggaggagcgagagaggaaggatcagtacgttcctgaggtctccgcccttgccgcccctgagctgggtttggaggttgaccccgacaccaaggatcttctccgatcccttggcatggactccatcaacgtccaggtctccgctcctatctcttcctacgctgcccccgagcgaggtccccgaggtgccggacgangtggacgaatcgtccccggagctggccgatactaagtgttttcttcaaccangggatatttgatnattcgctaggcttgaaatttttttatcattcttcctata

SEQ ID NO: 5245 - protein, 150 aa, Phaffia rhodozyma
  misc_feature (140)..(140): Xaa can be Ser or Gly or Arg or Cys
MGRVRTKTVKRASRVMIEKFYPRLTLDFHTNKRIADEVAIIPSKRLRNKIAGFTTHLMKRIQKGPVRGISFKLQEEERERKDQYVPEVSALAAPELGLEVDPDTKDLLRSLGMDSINVQVSAPISSYAAPERGPRGAGRXGRIVPGAGRY

SEQ ID NO: 5246 - DNA, 564 bp, Homo sapiens
  CDS (25)..(318)
cggacgcgtgggggacccgccaacatgggccgggttcgaaccaaaaccgcgaagaaggcggcccgggtcatgataaaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtaaactttctggatatttgggcttctggctaatcctcaaatgataaagctatgggttcttggcttccaaagggacctcagctgaatctgagacctttaatccatacattccataaccagctgtgggtgcccataggccccctaccagtttcttagcctccattctgctcttctggaaccagttaagtctattccatatttcatgagagcccttaatgttgatttgatgactgctgtcgtggctcgattgtttgcccctaatatagtattctttggtgg

SEQ ID NO: 5247 - protein, 97 aa, Homo sapiens
MGRVRTKTAKKAARVMIKKYYTRLGNDFHTNKRVCEEIAIIPSKKLRNKIAGYVTHLMKRIQRGPVRGISIKLQEEERERRDNYVPEVNFLDIWASG

SEQ ID NO: 5248 - DNA, 414 bp, Giardia lamblia ATCC 50803
  CDS (1)..(414)
atgggcaaagtcaggaccaagacaatcaagcgtgctgcgcgcaagattgttgagaacaattacgaatcactgaaacccaaggatttccagaacaacaaggctatttgctcgaagaggaacgtagctataataccatccaagcgcctgaggaataaggttgctggctatgtcacaacgctcatgaatcgcgtcgttaagggacccgtccacggcatctctctgaggctccaggaggaggagcgcgagcgtagggacaactatgccccaaagaagtctgagtttgatgtagagaacatcaccgtctctggggcaacgcagcagatgatagactcgattggcttcaaatgcatgtccacctctctgaaggtcatcgacccaacgatgagaaagagggccagggacacccgggagtaa

SEQ ID NO: 5249 - protein, 137 aa, Giardia lamblia ATCC 50803
MGKVRTKTIKRAARKIVENNYESLKPKDFQNNKAICSKRNVAIIPSKRLRNKVAGYVTTLMNRVVKGPVHGISLRLQEEERERRDNYAPKKSEFDVENITVSGATQQMIDSIGFKCMSTSLKVIDPTMRKRARDTRE

SEQ ID NO: 5250 - DNA, 1890 bp, Plasmodium yoelii yoelii
  CDS (1)..(1890)
atggaaaaactaaatgcatacgctaaaaagtttaatattaattatagggaaagcttagatggtctaaatatctctcttttgaataatcctgtattcaaatcaatgggaggtaaaaaatttgatattgatatgaatgatatagaagaggaaatacaaaaacatacaataaatttggaacatatgtgtaacgaaaatgggtcaaaaaacaaatcaaagataaatatattaaatatacattatagtgatcatcagaaattactttattctttattagcttttttaatagagaataaaatttattccttcaaaggttatataatatcatcatttgtaataaaaataaatacttcatattatagcgcttggatatatagaaggaaatgtttgaaaaagctaaatttaaattatttgaatgatttagaatttacgcgatttataattagtgaaaatataaaaagctttcaaagttggtatcatagaagatggctaatcgaatatatttacaaatctaatttgaaaaaaaaaggaaaaaataatgatcaaaaagagcaaaacaatgttacacaaattggcattcccgaggacgatgaaatgaaaaggaatgtccaaaaaatggagaaaaatatatatagtaatgtacacaaaaatatgtgtaatgacgatgatttatttgatcatgaacaaaatttcataagtagtgatgaagaaatttgtagcattcattcatcaaatgagagctaccatgaaaatgtatttataagcaattttgaaaatagtgatcttgatattgaaaaagaagatattttacacgaaaattttaaagacataattgaaaatagtaccttttttaaaaactctttacataaaaatgaagaaataaaaattaatatttatgaatttttatacaatgaattattatataccaattgtcacatatttcttgatacaaaaaattataattcttgggcacataaaacttggctaattaataagttttcaatgcttacaaaaaataaatatatttatgataagtataatatattattacatgaatataattatataaattattttttaaaatgcgatatttataataattctgtatgggtatatagacattttatttttaccaaattaaaacatataaaaaatataaataaattggaaaaagaaattatattttgcttaaattatggtcaacaattttatgacaatgaagcattatttagctactttatcaatatacttttaaaatacataaaattatgccaaaaaataagaaaattatcacccattgtatcaaaaacaaatgaagcaatagcatctttagaggaaactagtacatatgacatttttgaaatacccattgttaattttgttaaaaacaatttaacaaaattggcaacaaagtcaaaatttgtcttgttatttttagcccaactctatgcttacaatggatctcactatgaagaggcgcaaggaagagttcgtactaagactatcaaaagagccgctaggcaaatcgtcgagaaatactatgctaaacttactctcgactttcaaataaataaaaaaataacagaggaagttgcaataataccatcaaaaagaatgaaaaacaaagttgctggtttcgttacacatttaatgaaaagaattcagaaaggacccgtcagaggtattagtttaaaacttcaagaagaagaaagagaaagacgtttggatttcgtacctgaaaaatctcaaatcgatgttaatgtaatatatgtagaacctgatactgtaagaatgattaaatctttgggaattaatataagcaacatgaaaatccacaacccaatgattaatactaatcaccaaaaacaaaacagaatgaatgcccaatattaa

SEQ ID NO: 5251 - protein, 629 aa, Plasmodium yoelii yoelii
MEKLNAYAKKFNINYRESLDGLNISLLNNPVFKSMGGKKFDIDMNDIEEEIQKHTINLEHMCNENGSKNKSKINILNIHYSDHQKLLYSLLAFLIENKIYSFKGYIISSFVIKINTSYYSAWIYRRKCLKKLNLNYLNDLEFTRFIISENIKSFQSWYHRRWLIEYIYKSNLKKKGKNNDQKEQNNVTQIGIPEDDEMKRNVQKMEKNIYSNVHKNMCNDDDLFDHEQNFISSDEEICSIHSSNESYHENVFISNFENSDLDIEKEDILHENFKDIIENSTFFKNSLHKNEEIKINIYEFLYNELLYTNCHIFLDTKNYNSWAHKTWLINKFSMLTKNKYIYDKYNILLHEYNYINYFLKCDIYNNSVWVYRHFIFTKLKHIKNINKLEKEIIFCLNYGQQFYDNEALFSYFINILLKYIKLCQKIRKLSPIVSKTNEAIASLEETSTYDIFEIPIVNFVKNNLTKLATKSKFVLLFLAQLYAYNGSHYEEAQGRVRTKTIKRAARQIVEKYYAKLTLDFQINKKITEEVAIIPSKRMKNKVAGFVTHLMKRIQKGPVRGISLKLQEEERERRLDFVPEKSQIDVNVIYVEPDTVRMIKSLGINISNMKIHNPMINTNHQKQNRMNAQY

SEQ ID NO: 5252 - DNA, 426 bp, Oryza sativa
  CDS (1)..(426)
atgggtcgcgtgcggaccaagacggtgaagaagacctcgaggcaggtgatcgagaagtactactcgcggatgacgctcgacttccacaccaacaagaaggtgctcgaggaggtgtccatcctgccgtcgaagcggctgcgcaacaaggtggccgggttcaccacccacctgatgcgccgcatccagcgcgggcccgtgcggggcatctcgctgaagctgcaggaggaggagcgcgagcgccgcatggacttcgtcccggagaagtcggcgctcgaggtggaggagatccgcgtcgacaaggagaccatggagatgctcgccgcgctcggcatggccgacctccccggcgtcgagcgccagcaagaggtctccgcgccgacctactcccgcccgccgtacggtggcccccgccgcgaccgcgtctag

SEQ ID NO: 5253 - protein, 141 aa, Oryza sativa
MGRVRTKTVKKTSRQVIEKYYSRMTLDFHTNKKVLEEVSILPSKRLRNKVAGFTTHLMRRIQRGPVRGISLKLQEEERERRMDFVPEKSALEVEEIRVDKETMEMLAALGMADLPGVERQQEVSAPTYSRPPYGGPRRDRV

SEQ ID NO: 5254 - DNA, 435 bp, Oryza sativa
  CDS (1)..(435)
atggggcgcgtgcgcacgaagacggtgaagaagacgtctcggcaggtgatcgagaagtactactcgcggatgaccctggacttccacacgaacaagaaggtgctggaggaggtgtcgatcctgccgtcgaagcgcctccgcaacaaggtggccggcttcagcacccacctgatgcgccgcatccagcgcggccccgtccgcggcatctccctcaagctccaggaggaggagcgcgagcgccgcatggacttcgtcccggacaggtcggcgctcgaggtcgacgacatccgcgtcgacaaggagaccctcgacatgctcacctccctcggcatggccgacctccccggcgtcgtgcgccagcccgacgcctccacctccgccccgcagcagtacggcgccgcccgcctcccctacgcccgccgcgaccgcgcctag

SEQ ID NO: 5255 - protein, 144 aa, Oryza sativa
MGRVRTKTVKKTSRQVIEKYYSRMTLDFHTNKKVLEEVSILPSKRLRNKVAGFSTHLMRRIQRGPVRGISLKLQEEERERRMDFVPDRSALEVDDIRVDKETLDMLTSLGMADLPGVVRQPDASTSAPQQYGAARLPYARRDRA

SEQ ID NO: 5256 - DNA, 414 bp, Plasmodium falciparum
  CDS (1)..(414)
atgggaagagtcaggactaaaactattaaaagagccgcaaggcaaattgtagaaaagtactatgccaaattaactctagattttcaaattaacaaaaagataacagaggaagtagccataattccctcaaagagaatgaaaaataaagttgctggttttgttactcacttaatgaaaagaatacaaaagggacctgtacgtggtattagtttgaaattacaagaagaagaaagagaaagacgtttagattttgtcccagaaaaatcacaaattgatgttagcgtaatttatgtagaacctgatacattacgtatgatcaaatccttgggtataaatattagcaacatgaaagtacataatcccatgattaacactaaccaacaaaaacaaaacagaatgaataaccaattttaa

SEQ ID NO: 5257 - protein, 137 aa, Plasmodium falciparum
MGRVRTKTIKRAARQIVEKYYAKLTLDFQINKKITEEVAIIPSKRMKNKVAGFVTHLMKRIQKGPVRGISLKLQEEERERRLDFVPEKSQIDVSVIYVEPDTLRMIKSLGINISNMKVHNPMINTNQQKQNRMNNQF

SEQ ID NO: 5258 - DNA, 614 bp, Branchiostoma belcheri
  CDS (9)..(413)
atttcaacatgggtcgcgttcgtacgaagacgatcaaaaaggcggcgcgggtgatcatcgaaaaatactacaccaggcttacgctcgacttccacacaaataagcggatatgtgaggagattgccattattcccagcaagaagctgaggaacaaggttgcagggtttgtaacccatctgatgaagcgtatccagcgaggaccagtccgtggtatctccatcaagctgcaggaggaggagagggagaggagagacaactacgttcctgaggtgtctgcaattgatcaggacatcattgaggtggatcctgacaccaaggagatgttgaaggcactggactttggtaacatctcgggtctgcaggtgacacagcctgttggtgtgcccggattcagagcacccaagaacccctagaagcatacatgaatttggctccatccctatatgcaggttttgcagcctgtcggagttcctagcttattaagtgcagcgaatgtctgaatatgatgtaacacctggagacatgactatgcatctctcagacacattatgtatgtttctctgaagaataacagctgaattaagagaaacattgataccaaaaaaaaaaaaaaa

SEQ ID NO: 5259 - protein, 134 aa, Branchiostoma belcheri
MGRVRTKTIKKAARVIIEKYYTRLTLDFHTNKRICEEIAIIPSKKLRNKVAGFVTHLMKRIQRGPVRGISIKLQEEERERRDNYVPEVSAIDQDIIEVDPDTKEMLKALDFGNISGLQVTQPVGVPGFRAPKNP

SEQ ID NO: 5260 - DNA, 477 bp, Aequipecten irradians
  CDS (5)..(427)
gaaaatggctcgcgtcaggacaaagaccgtcaagaaggccgccagagtcattattgagaaatactacaccaagttgaccctcgacttccacactaacaaaagagtatgtgaagaaatcgctattttgcctagcaagaagcttaggaacaaagtagcagggtttgtcacccatttgatgaagcgtatccaggctgggccagtccgaggtatctccatcaagctacaggaagaagagagggaaaggagggataactacgtcccagaggtttctcttttggaacaacatgacgttattgaagttgatcccgatacaaaggacatgttgaagtctctggactttggcaacatccccggcctgcaggttacccagcccatcacagcccagggaggattccgaccagggggtgctggtggaccaaggatgtaattaagttaataaagtcaacaggggaaaaacaaaaaaaaaaaaaaaaaaaa

SEQ ID NO: 5261 - protein, 140 aa, Aequipecten irradians
MARVRTKTVKKAARVIIEKYYTKLTLDFHTNKRVCEEIAILPSKKLRNKVAGFVTHLMKRIQAGPVRGISIKLQEEERERRDNYVPEVSLLEQHDVIEVDPDTKDMLKSLDFGNIPGLQVTQPITAQGGFRPGGAGGPRM

SEQ ID NO: 5262 - DNA, 363 bp, Encephalitozoon cuniculi
  CDS (1)..(363)
atgggctgtgtcaggaataagatagtcaagagggctgctcggacgattgcagagaagtatttccagaggcttgacagcacctttgatcacaacctgcttgttgtgcaggatgttgcggttgtgcagtcgaagaagctgaagaacgagattgcgggatatctcacgtcgctttacaagaagattctgaaggggacatacaacaaggtctacatcaagagccacgaggaggagagggagagaaaggaaaacgtaattccgaaggagtcgatgcttgatgtcgactgtgttgaggttgatgatgtgacgatggagatgataaagaggtatggatatgaggggaacttcaaggtttatggaatgtga

SEQ ID NO: 5263 - protein, 120 aa, Encephalitozoon cuniculi
MGCVRNKIVKRAARTIAEKYFQRLDSTFDHNLLVVQDVAVVQSKKLKNEIAGYLTSLYKKILKGTYNKVYIKSHEEERERKENVIPKESMLDVDCVEVDDVTMEMIKRYGYEGNFKVYGM

SEQ ID NO: 5264 - DNA, 408 bp, Homo sapiens
  CDS (1)..(408)
atgggccacgtttgcaccaaaaccatgaagaaggctgcctgggtcatcatagaaaagtactacatgcacctgggcaacgacttccacacaaacaagcacatgtgcaaggagattgccattatccccagcaagaagctccacaacaagacagcaggttatgtcacccatctgatgaagcagattcagagaggcccagtaagaggtatctccatcaagctgcaggaggaggtgagagaaaggagagacaattatgttcctgagatctcagccctggatcaggagatcattgaagtagatcctgacactaaagaaatgctgaagcttttggactttggtggtctgtctaacctgcaggtcactcagcctacagttgggatgaatttcaaaatgcctcggggacctgtttga

SEQ ID NO: 5265 - protein, 135 aa, Homo sapiens
MGHVCTKTMKKAAWVIIEKYYMHLGNDFHTNKHMCKEIAIIPSKKLHNKTAGYVTHLMKQIQRGPVRGISIKLQEEVRERRDNYVPEISALDQEIIEVDPDTKEMLKLLDFGGLSNLQVTQPTVGMNFKMPRGPV

SEQ ID NO: 5266 - DNA, 577 bp, Anopheles gambiae
  CDS (31)..(426)
gcgaaagacagccgtgaatcttagcacagaatgggtcgtgtacgtaccaagacgatcaagaaggcctcgaaggtcatcatcgagaagtactacactcgattgaccatggatttcgacactaacaagcgtattgtcgaagaagtggccatcattccgacgaaaccactgcgtaacaagattgctggttttgtaacccatctgatgaagcgcctgcgtcactcgcaagtgcgtggtatttccatcaagctccaggaagaagagcgtgagcgtcgcgataactatgtgccggatgtttcagcactggagcaggatatcattgaggtggatccagagacgaaggagatgttgaagcatcttgacttcaataacatcgttgtccagttgaccaacccgaccgctccaggatacagcaatcgacgcaactaagaccatgcgaatgtgtcttgggctgtatcgtttaagattactgcactggattggtcttctcctgtaatactgtgtgtgtgtgtgtgggtagcaaactaaccagaatataggaaaaaccaatgtaaaccaccaaaaaaaaaaaaaaaaaaaa

SEQ ID NO: 5267 - protein, 131 aa, Anopheles gambiae
MGRVRTKTIKKASKVIIEKYYTRLTMDFDTNKRIVEEVAIIPTKPLRNKIAGFVTHLMKRLRHSQVRGISIKLQEEERERRDNYVPDVSALEQDIIEVDPETKEMLKHLDFNNIVVQLTNPTAPGYSNRRN

SEQ ID NO: 5268 - DNA, 393 bp, Caenorhabditis elegans
  CDS (1)..(393)
atgagtcgtgttcgtaccaagaccgtcaagaaggcttcccgtgtcctcatcgagaagtactacactcgcatgaccaatgacttccataacaacaagcgcgtctgtgacgaggttgccatcatcggaagcaagccactcagaaacaagatcgctggatacatcactcacttgatgagacgtatcgagagaggaccagtcagaggtatctccatcaagcttcaagaagaggagcgtgagcgcagagacaactacatgccagagatctccactgttgatccatctcaactcacctccatcaaggttgacactgataccagcgacatgctcaaggccgctggattcaaccttccaaacgtcaccgttgaggatcaaggaaagaacaagggaaagtaa

SEQ ID NO: 5269 - protein, 130 aa, Caenorhabditis elegans
MSRVRTKTVKKASRVLIEKYYTRMTNDFHNNKRVCDEVAIIGSKPLRNKIAGYITHLMRRIERGPVRGISIKLQEEERERRDNYMPEISTVDPSQLTSIKVDTDTSDMLKAAGFNLPNVTVEDQGKNKGK

SEQ ID NO: 5270 - DNA, 641 bp, Lycopersicon esculentum
  CDS (48)..(482)
aactttctgctgcttatctctgtctcgtctaaggaaattctgcaaggatgggtcgtgtgcgcaccaagaccgtgaagaagtcatctcgacaggtaattgagaggtactactccaaaatgacattggatttccacaccaacaagaagattttggaggaagttgctataattccttccaagcgtctccgcaacaagattgctggattctccactcacctcatgaagcgtatccagaagggaccagtccgtggtatctccctgaaactgcaagaggaggaacgtgagagacgcatggactttgttcctgatgaatctgccatcaagactgatctcattgaagttgacaaggagacccttgacatgctttcagccctcggcatgtctgaccttccaggcgttgtcaagcaggccgctgagccacaagcagtggcagctctcccatcatatggccgcggtggaggtggttttggacggaaatactaataagagaacagttacaatgatctcttatgatctattgaagaaactttttggtagattatatgtttagttttcccctaatttttcttttaaagagtctttgaaactcattccagtgtttttgaaacataaatgatgaacaaccccttttggtgttaaaaa

SEQ ID NO: 5271 - protein, 144 aa, Lycopersicon esculentum
MGRVRTKTVKKSSRQVIERYYSKMTLDFHTNKKILEEVAIIPSKRLRNKIAGFSTHLMKRIQKGPVRGISLKLQEEERERRMDFVPDESAIKTDLIEVDKETLDMLSALGMSDLPGVVKQAAEPQAVAALPSYGRGGGGFGRKY

SEQ ID NO: 5272 - DNA, 453 bp, Mus musculus
  CDS (12)..(419)
gacccgtcaacatgggccgcgttcgcaccaagactgtgaagaaggcggcccgggtcatcatagagaagtactacacgcgtctgggtaatgacttccacaccaacaagcgcgtgtgcgaggagatcgccattatccccagcaagaagcttcggaacaagatagccggctatgtcacgcatctgatgaagcggattcagagagggcctgtgagaggcatctctatcaagttgcaggaagaagagagagagaggagagataactacgttcctgaggtctcagccctagatcaggagatcattgaggtggatcccgacaccaaggagatgctgaagctcctggactttggcagtctctctaaccttcaggtcactcagcctacagttggcatgaatttcaaaacaccacgtggagctgtttaatctgttatgccatattttcaataaacctgaaaac

SEQ ID NO: 5273 - protein, 135 aa, Mus musculus
MGRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGAV

SEQ ID NO: 5274 - DNA, 466 bp, Rattus norvegicus
  CDS (25)..(432)
cctcttttaccgagacccgtcaacatgggccgcgttcgcaccaagactgtgaagaaggcggcccgggtcatcatcgagaagtactacacgcgcctgggtaatgactttcacaccaacaagcgcgtgtgcaaggagatcgccatcatccccagcaaaaaccttcggaacaagatagccggctatgtcacgcatctgatgaagcggattcagagaggtcctgtgagaggcatctccatcaagttgcaggaagaagagagggagaggagagataattatgttcctgaggtctcagccctagatcaggagatcattgaggtagatcctgacaccaaggaaatgctgaagcttctggactttggcagtctctccaacctccaggtcactcagcctacggttgggatgaatttcaaaacaccacgtggagctgtttaatccattatgccatattttcaataaacctgaaaac

SEQ ID NO: 5275 - protein, 135 aa, Rattus norvegicus
MGRVRTKTVKKAARVIIEKYYTRLGNDFHTNKRVCKEIAIIPSKNLRNKIAGYVTHLMKRIQRGPVRGISIKLQEEERERRDNYVPEVSALDQEIIEVDPDTKEMLKLLDFGSLSNLQVTQPTVGMNFKTPRGAV

SEQ ID NO: 5276 - DNA, 456 bp, Spodoptera frugiperda
  CDS (25)..(426)
gaaggttgctgcagtgtttcagccatgggtcgtgtcaggactaagaccgtcaagaaagcggctaagattatcattgaaaaatactacaccagattgactctggacttcgacacaaataagagaatatgtgaggaaatcgccatcattcccaccaagcccctgcgtaacaaaatcgctgggtttgctacccatttgatgaggcgtctcaggcactcccaggtcagaggaatctccatcaaactgcaagaggaagagcgtgagaggcgtgacaactatgtgcccgaggtttccgccctggagcacgacatcattgaagttgaccccgacaccaaggacatgttgaagatgctcgacttcaataacatcaacggtctgcaactgacgcagccagccacacaaggcggctatggtggcagacgtaattaaggataataaataattaatatctgaaaaaaa

SEQ ID NO: 5277 - protein, 133 aa, Spodoptera frugiperda
MGRVRTKTVKKAAKIIIEKYYTRLTLDFDTNKRICEEIAIIPTKPLRNKIAGFATHLMRRLRHSQVRGISIKLQEEERERRDNYVPEVSALEHDIIEVDPDTKDMLKMLDFNNINGLQLTQPATQGGYGGRRN

SEQ ID NO: 5278 - DNA, 611 bp, Theileria annulata
  CDS (175)..(570)
ggcacgagttttaaaatcatatcctatgtagattcttccatcacgttctactgattttcaagataaaacttaccctctttcataccaaacaacattaaacaaatttatttacctacaaaacccgttaaactctttgaacaaatacttacaaacctgtacatctgacgattgaatatgggccgtgtcagaaccaagacagttaagcgtgcagctcgtcaaatagtcgaaaaatactatggaaaacttggattagattttcagtacaataagaaggtggcagaggaagttgccctgatcccctcgaagcgtatgaggaacaaagtcgcaggctttataacgcacttgatgaggaggattcaaaagggtccagttagaggaatctctctaaaacttcaggaggaggaacgtgaaagaaggatggattacattcctgagaagtcggagcttgaagtgccagtaattcaagtggatcaggacacagcggatatgttaaactttttgaagatttcccttccgaatctcaaagtcatgtcatttaacgctcatgaacaccgcgaagacactaagtaaaattttctaattttatctttgtttaaaaaaaaaaaaaaaaa

SEQ ID NO: 5279 - protein, 131 aa, Theileria annulata
MGRVRTKTVKRAARQIVEKYYGKLGLDFQYNKKVAEEVALIPSKRMRNKVAGFITHLMRRIQKGPVRGISLKLQEEERERRMDYIPEKSELEVPVIQVDQDTADMLNFLKISLPNLKVMSFNAHEHREDTK

SEQ ID NO: 5280 - DNA, 454 bp, Arabidopsis thaliana
  CDS (1)..(423)
atgggtcgtgttcgtaccaaaacggttaagaagtcttcacgtcaggtgattgagaagtactactcacggatgacactagacttccacaccaacaagaagatcttggaagaagttgcaatcatcccatcgaaaaggctacgcaacaagattgctggattctccactcacttgatgaaacgtatccaaaagggtccagtccgtggaatctccctcaagctacaagaggaagagcgtgaaaggcgaatggactttgttcccgatgagtcagccattaaaatcgatgatgttaaggtggacaaagagacactagagatgcttgcttctttgggaatgtctgatattgctgggatttctcaagtggagacacaacaagctatggcacctgctgtgtttggacgtcccgcaggaagataccaacgctaagtttattgggtttcaatcaaagatttcggag

SEQ ID NO: 5281 - protein, 140 aa, Arabidopsis thaliana
MGRVRTKTVKKSSRQVIEKYYSRMTLDFHTNKKILEEVAIIPSKRLRNKIAGFSTHLMKRIQKGPVRGISLKLQEEERERRMDFVPDESAIKIDDVKVDKETLEMLASLGMSDIAGISQVETQQAMAPAVFGRPAGRYQR

SEQ ID NO: 5282 - DNA, 411 bp, Ashbya gossypii
  CDS (1)..(411)
atgggtagagtcagaaccaagaccgtcaagcgtgcctccaaggctttgatcgagcgttactatccaaagttgactttggacttccaaaccaacaagagattgtgtgacgagatcgccaccatccagtccaagagattgagaaacaagattgcgggctacaccacccacttgatgaagagaatccaaaagggcccagtcagaggtatctccttcaagttgcaggaggaggagagagagagaaaggaccagtacgtgccagctgtctctgccttggacttgtcccacaacaagggcatgttgaacgttgacaaccagaccgccgagttggtcaagactttgggcttgaagttgccaatgtccgtcaccaacgtttccagccagagagacagaagattcagaagaagaaactaa

SEQ ID NO: 5283 - protein, 136 aa, Ashbya gossypii
MGRVRTKTVKRASKALIERYYPKLTLDFQTNKRLCDEIATIQSKRLRNKIAGYTTHLMKRIQKGPVRGISFKLQEEERERKDQYVPAVSALDLSHNKGMLNVDNQTAELVKTLGLKLPMSVTNVSSQRDRRFRRRN

SEQ ID NO: 5284 - DNA, 25 bp, artificial sequence
  primer
ttagtttctctttctgtaacgtctg

SEQ ID NO: 5285 - DNA, 24 bp, artificial sequence
  primer
atggtacgtaccacgagatgttga

SEQ ID NO: 5286 - DNA, 506 bp, Saccharomyces cerevisiae
  CDS (135)..(458)
gaggagatggacatatacacaaagtgttggatgagaagcgtgagcccgaagagtagtgaaatgccgaagatcagggtgtttatatgaacgaacactagcttacaaatgtggaaacgggatccttcagaggtaaaatgcgccttcagtggccaaagttcatcaccttccttagcacgggttcttgctgtctgctcttcctgcttcttccctgttcgtttttccctcttcctacggctatgcacagtggcaaatgcactgcatgtgtttctgtggcgggtatccctcaattgcgggtaacaataagtaactcaacatcacgaacgacgtttatgtttgctgttaccacaaagggtaaaacgtcaataaaagcaagcaatgttattcgtgccagagaactatatctggcgtacgtcttatatataacacaagcaagggcaaatacgtggttagtggtgtaaaaactgaagggattaatttacatacaactagatccatctttctcaaaa

SEQ ID NO: 5287 - protein, 107 aa, Saccharomyces cerevisiae
MRLQWPKFITFLSTGSCCLLFLLLPCSFFPLPTAMHSGKCTACVSVAGIPQLRVTISNSTSRTTFMFAVTTKGKTSIKASNVIRARELYLAYVLYITQARANTWLVV

SEQ ID NO: 5288 - DNA, 23 bp, artificial sequence
  primer
atgcgccttcagtggccaaagtt

SEQ ID NO: 5289 - DNA, 24 bp, artificial sequence
  primer
ttacaccactaaccacgtatttgc

SEQ ID NO: 5290 - protein, 23 aa, artificial sequence
  MISC_FEATURE (1)..(23): consensus for the disclosure of xaa see table XV
SXXTXXXXXXXLXXXXXXXXXXG

SEQ ID NO: 5291 - protein, 222 aa, artificial sequence
  MISC_FEATURE (1)..(222): consensus Xaa in all positions is any amino acid.
YXXXXXXXXXXXXXXXXXXXXXXPXEXXLXXXXXXSRXTXXXAXXXLXXXGXXXXXXGXGTXXXXXXXXXXXXXXXXXXXXXXXEXXXXXXXXXXXXXXXXXXXXXXXXXXXXLXXXXXXXXXXXXXRXXXXXXXPXXXEXXXXXXXXXXXXXXXXXXXXXXXXXXXXXXXXXXXXXXXXXXXXXXXXXXXXXXXLXXXXXXXXXXXXXXXXXXXXXXXXXE

SEQ ID NO: 5292 - protein, 53 aa, artificial sequence
  MISC_FEATURE (1)..(53): consensus for the disclosure of xaa see table XV
XXXXXXXXXXXXXXXXXXXXXXXXXXXXXXXXXXXXXXXXXXXXXXXXXXXXX

SEQ ID NO: 5293 - protein, 75 aa, artificial sequence
  MISC_FEATURE (1)..(75): consensus for the disclosure of xaa see table XV
XXXXXXXXXXXXXXXXXXXXXGXGXXXEXXXXXXXXXXXXXXXXXXGPXXXXXXXXXXXXXXXXXXXXXXXXXXX

SEQ ID NO: 5294 - protein, 100 aa, artificial sequence
  MISC_FEATURE (1)..(100): consensus for the disclosure of xaa see table XV
XXXXXXXXXKXXXGGXGXXXXXXXXXXXXXXXXXXXXXXXXXXXXXXXXXXXXXXXXXXXXHXEXQXXXDXXXXXGXXXXXXXRXCXXQXXXQKXXEXXX

SEQ ID NO: 5295 - protein, 46 aa, artificial sequence
  MISC_FEATURE (1)..(46): consensus for the disclosure of xaa see table XV
YXXXXTXEXXXXXXXXXXXXXXXXXXXXXXFXEXNXRXQVEHXXXE

SEQ ID NO: 5296 - protein, 688 aa, artificial sequence
  MISC_FEATURE (1)..(688): consensus Xaa in all positions is any amino acid
LXANRGEIAXRXXRXXXXXXXXXVXXXXXXXXXXXAXXXXXDXXXXXXXXADXXXXXGXXXXXXXXXXXXXXYLXXXXXXXXAXXXXXXAXHPGYGFLSENXXFXXXXXXXXXGXXFXGPXXXXXXXXGXKXXXXXXXXXXXXPXXPXXXXXXXXXXXXXXXXXXXXXXXXXXXXXXXXXXXXXXXXXXXXXXGXPXXXXXXKAXXGGGGXGXXXXXXXXXXXXXXXXXXXEAXXXFXXXXXXXEXXXXXXXXRHXEXXXXDXXXXXGXXXXKXXRDCSXQRRXQKXXEXXPXXXXXXXXXXXRXXXXXXXXXXXXXXXXXXXXYXXAGTXFXXXXXXXXXXXXXXXXXXXXXFXEXNXRXQVEHXXTEXXXXXXDXXXXEXXXAXGXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXRXXXEXPXXXXXXXPXXGXXXXXXXXXXXXXXXXXXXXXXXXXXXRXXXXXXXXGXXXXXXXDXXXXKXXXXXXXXXXAXXXXXXALXXXXXXGXXXXTXXXXXXXXXXXXXF

SEQ ID NO: 5297 - protein, 29 aa, artificial sequence
  MISC_FEATURE (1)..(29): consensus for the disclosure of xaa see table XV
XDPXXPKXXXSXXXXXXXXXRXXXXXXXP

SEQ ID NO: 5298 - protein, 12 aa, artificial sequence
  MISC_FEATURE (1)..(12): consensus for the disclosure of xaa see table XV
XXXXXXXXXXXW

SEQ ID NO: 5299 - protein, 22 aa, artificial sequence
  MISC_FEATURE (1)..(22): consensus for the disclosure of xaa see table XV
XXXXXXXXXXXXXXYXXXXXXY

SEQ ID NO: 5300 - protein, 75 aa, artificial sequence
  MISC_FEATURE (1)..(75): consensus Xaa in all positions is any amino acid.
KDPXAPKRXXSAXXXFXXXXRXXXXXXXPXXXXXXXXXXKXXGXXWXXXXXXXKXPYEXKAXXXKXXYEXXXXXY

SEQ ID NO: 5301 - protein, 10 aa, artificial sequence
  MISC_FEATURE (1)..(10): consensus for the disclosure of xaa see table XV
VXXKXXKXXX

SEQ ID NO: 5302 - protein, 20 aa, artificial sequence
  MISC_FEATURE (1)..(20): consensus for the disclosure of xaa see table XV
XXXXXXKXXXNXXAGXXTXL

SEQ ID NO: 5303 - protein, 113 aa, artificial sequence
  MISC_FEATURE (1)..(113): consensus Xaa in all positions is any amino acid.
GRVRTKTXKXXXXXXIEKYYXXXXXDFXXNKXXXXEXXXXAXIXSKXLRNKXAGXXTHLMXRIXXGPVRGISXKLQEEERERXXXXVPXXSXXXXXXXXXXXXXXVDXXTXXM

SEQ ID NO: 5304 - DNA, 1062 bp, Escherichia coli K12; identical to SEQ ID NO: 2732
  CDS (1)..(1062)

SEQ ID NO: 5305 - protein, 353 aa, Escherichia coli K12; identical to SEQ ID NO: 2733

SEQ ID NO: 5306 - DNA, 1444 bp, Pseudomonas fluorescens; identical to SEQ ID NO: 2734
  CDS (156)..(1214)

SEQ ID NO: 5307 - protein, 352 aa, Pseudomonas fluorescens; identical to SEQ ID NO: 2735

SEQ ID NO: 5308 - DNA, 1484 bp, Haemophilus influenzae; identical to SEQ ID NO: 2736
  CDS (278)..(1342)

SEQ ID NO: 5309 - protein, 354 aa, Haemophilus influenzae; identical to SEQ ID NO: 2737

SEQ ID NO: 5310 - DNA, 1131 bp, Thermus aquaticus; identical to SEQ ID NO: 2738
  CDS (62)..(1084)

SEQ ID NO: 5311 - protein, 340 aa, Thermus aquaticus; identical to SEQ ID NO: 2739

SEQ ID NO: 5312 - DNA, 1196 bp, Aquifex pyrophilus; identical to SEQ ID NO: 2740
  CDS (51)..(1097)

SEQ ID NO: 5313 - protein, 348 aa, Aquifex pyrophilus; identical to SEQ ID NO: 2741

SEQ ID NO: 5314 - DNA, 1023 bp, Rickettsia prowazekii; identical to SEQ ID NO: 2742
  CDS (1)..(1023)

SEQ ID NO: 5315 - protein, 340 aa, Rickettsia prowazekii; identical to SEQ ID NO: 2743

SEQ ID NO: 5316 - DNA, 1329 bp, Myxococcus xanthus; identical to SEQ ID NO: 2744
  CDS (201)..(1229)

SEQ ID NO: 5317 - protein, 342 aa, Myxococcus xanthus; identical to SEQ ID NO: 2745

SEQ ID NO: 5318 - DNA, 1394 bp, Legionella pneumophila; identical to SEQ ID NO: 2746
  CDS (166)..(1212)

SEQ ID NO: 5319 - protein, 348 aa, Legionella pneumophila; identical to SEQ ID NO: 2747

SEQ ID NO: 5320 - DNA, 1224 bp, Treponema pallidum subsp. pallidum (syphilis spirochete); identical to SEQ ID NO: 2748
  CDS (1)..(1224): k means g or t/u

SEQ ID NO: 5321 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 5322 - DNA, 1050 bp, Clostridium acetobutylicum; identical to SEQ ID NO: 2750
  CDS (1)..(1050)

SEQ ID NO: 5323 - protein, 349 aa, Clostridium acetobutylicum; identical to SEQ ID NO: 2751

SEQ ID NO: 5324 - DNA, 1047 bp, Listeria innocua; identical to SEQ ID NO: 2752
  CDS (1)..(1047)

SEQ ID NO: 5325 - protein, 348 aa, Listeria innocua; identical to SEQ ID NO: 2753

SEQ ID NO: 5326 - DNA, 1137 bp, Brucella melitensis; identical to SEQ ID NO: 2754
  CDS (1)..(1137)

SEQ ID NO: 5327 - protein, 378 aa, Brucella melitensis; identical to SEQ ID NO: 2755

SEQ ID NO: 5328 - DNA, 1062 bp, Salmonella enterica subsp. enterica serovar Typhi; identical to SEQ ID NO: 2756
  CDS (1)..(1062)

SEQ ID NO: 5329 - protein, 353 aa, Salmonella enterica subsp. enterica serovar Typhi; identical to SEQ ID NO: 2757

SEQ ID NO: 5330 - DNA, 1074 bp, Nostoc sp. PCC 7120; identical to SEQ ID NO: 2758
  CDS (1)..(1074)

SEQ ID NO: 5331 - protein, 357 aa, Nostoc sp. PCC 7120; identical to SEQ ID NO: 2759

SEQ ID NO: 5332 - DNA, 1044 bp, Xylella fastidiosa; identical to SEQ ID NO: 2760
  CDS (1)..(1044)

SEQ ID NO: 5333 - protein, 347 aa, Xylella fastidiosa; identical to SEQ ID NO: 2761

SEQ ID NO: 5334 - DNA, 1164 bp, Lactococcus lactis subsp. lactis; identical to SEQ ID NO: 2762
  CDS (1)..(1164)

SEQ ID NO: 5335 - protein, 387 aa, Lactococcus lactis subsp. lactis; identical to SEQ ID NO: 2763

SEQ ID NO: 5336 - DNA, 2025 bp, Borrelia burgdorferi (Lyme disease spirochete); identical to SEQ ID NO: 2764
  CDS (25)..(1122)

SEQ ID NO: 5337 - protein, 365 aa, Borrelia burgdorferi (Lyme disease spirochete); identical to SEQ ID NO: 2765

SEQ ID NO: 5338 - DNA, 1728 bp, Deinococcus radiodurans; identical to SEQ ID NO: 2766
  CDS (399)..(1490)

SEQ ID NO: 5339 - protein, 363 aa, Deinococcus radiodurans; identical to SEQ ID NO: 2767

SEQ ID NO: 5340 - DNA, 1071 bp, Caulobacter crescentus; identical to SEQ ID NO: 2768
  CDS (1)..(1071)

SEQ ID NO: 5341 - protein, 356 aa, Caulobacter crescentus; identical to SEQ ID NO: 2769

SEQ ID NO: 5342 - DNA, 1199 bp, Thermotoga maritima; identical to SEQ ID NO: 2770
  CDS (67)..(1137)

SEQ ID NO: 5343 - protein, 356 aa, Thermotoga maritima; identical to SEQ ID NO: 2771

SEQ ID NO: 5344 - DNA, 1662 bp, Arabidopsis thaliana (mouse-ear cress); identical to SEQ ID NO: 2772
  CDS (368)..(1498)

SEQ ID NO: 5345 - protein, 376 aa, Arabidopsis thaliana (mouse-ear cress); identical to SEQ ID NO: 2773

SEQ ID NO: 5346 - DNA, 1038 bp, Aquifex aeolicus; identical to SEQ ID NO: 2774
  CDS (1)..(1038)

SEQ ID NO: 5347 - protein, 345 aa, Aquifex aeolicus; identical to SEQ ID NO: 2775

SEQ ID NO: 5348 - DNA, 1062 bp, Chlamydophila pneumoniae, Chlamydia pneumoniae; identical to SEQ ID NO: 2776
  CDS (1)..(1062)

SEQ ID NO: 5349 - protein, 353 aa, Chlamydophila pneumoniae, Chlamydia pneumoniae; identical to SEQ ID NO: 2777

SEQ ID NO: 5350 - DNA, 1047 bp, Neisseria meningitidis; identical to SEQ ID NO: 2778
  CDS (1)..(1047)

SEQ ID NO: 5351 - protein, 348 aa, Neisseria meningitidis; identical to SEQ ID NO: 2779

SEQ ID NO: 5352 - DNA, 1032 bp, Campylobacter jejuni; identical to SEQ ID NO: 2780
  CDS (1)..(1032)

SEQ ID NO: 5353 - protein, 343 aa, Campylobacter jejuni; identical to SEQ ID NO: 2781

SEQ ID NO: 5354 - DNA, 1065 bp, Chlamydia muridarum, Chlamydia trachomatis MoPn; identical to SEQ ID NO: 2782
  CDS (1)..(1065)

SEQ ID NO: 5355 - protein, 354 aa, Chlamydia muridarum, Chlamydia trachomatis MoPn; identical to SEQ ID NO: 2783

SEQ ID NO: 5356 - DNA, 1050 bp, Bacillus halodurans; identical to SEQ ID NO: 2784
  CDS (1)..(1050)

SEQ ID NO: 5357 - protein, 349 aa, Bacillus halodurans; identical to SEQ ID NO: 2785

SEQ ID NO: 5358 - DNA, 1229 bp, Streptococcus pneumoniae; identical to SEQ ID NO: 2786
  CDS (26)..(1192)

SEQ ID NO: 5359 - protein, 388 aa, Streptococcus pneumoniae; identical to SEQ ID NO: 2787

SEQ ID NO: 5360 - DNA, 1251 bp, Agrobacterium tumefaciens; identical to SEQ ID NO: 2788
  CDS (1)..(1251)

SEQ ID NO: 5361 - protein, 416 aa, Agrobacterium tumefaciens; identical to SEQ ID NO: 2789

SEQ ID NO: 5362 - DNA, 1044 bp, Staphylococcus aureus; identical to SEQ ID NO: 2790
  CDS (1)..(1044)

SEQ ID NO: 5363 - protein, 347 aa, Staphylococcus aureus; identical to SEQ ID NO: 2791

SEQ ID NO: 5364 - DNA, 1506 bp, Acinetobacter calcoaceticus; identical to SEQ ID NO: 2792
  CDS (403)..(1452)

SEQ ID NO: 5365 - protein, 349 aa, Acinetobacter calcoaceticus; identical to SEQ ID NO: 2793

SEQ ID NO: 5366 - DNA, 1479 bp, Brucella abortus; identical to SEQ ID NO: 2794
  CDS (316)..(1398)

SEQ ID NO: 5367 - protein, 360 aa, Brucella abortus; identical to SEQ ID NO: 2795

SEQ ID NO: 5368 - DNA, 981 bp, Streptococcus pyogenes; identical to SEQ ID NO: 2796
  CDS (1)..(981)

SEQ ID NO: 5369 - protein, 326 aa, Streptococcus pyogenes; identical to SEQ ID NO: 2797

SEQ ID NO: 5370 - DNA, 1349 bp, Leptospira biflexa; identical to SEQ ID NO: 2798
  CDS (107)..(1270)

SEQ ID NO: 5371 - protein, 387 aa, Leptospira biflexa; identical to SEQ ID NO: 2799

SEQ ID NO: 5372 - DNA, 1762 bp, Xanthomonas campestris pv. campestris; identical to SEQ ID NO: 2800
  CDS (159)..(1190)

SEQ ID NO: 5373 - protein, 343 aa, Xanthomonas campestris pv. campestris; identical to SEQ ID NO: 2801

SEQ ID NO: 5374 - DNA, 1212 bp, Aeromonas salmonicida; identical to SEQ ID NO: 2802
  CDS (151)..(1212)

SEQ ID NO: 5375 - protein, 353 aa, Aeromonas salmonicida; identical to SEQ ID NO: 2803

SEQ ID NO: 5376 - DNA, 1433 bp, Azotobacter vinelandii; identical to SEQ ID NO: 2804
  CDS (311)..(1360)

SEQ ID NO: 5377 - protein, 349 aa, Azotobacter vinelandii; identical to SEQ ID NO: 2805

SEQ ID NO: 5378 - DNA, 1108 bp, Acetobacter polyoxogenes; identical to SEQ ID NO: 2806
  CDS (35)..(1081)

SEQ ID NO: 5379 - protein, 348 aa, Acetobacter polyoxogenes; identical to SEQ ID NO: 2807

SEQ ID NO: 5380 - DNA, 1230 bp, Neisseria gonorrhoeae; identical to SEQ ID NO: 2808
  CDS (133)..(1179)

SEQ ID NO: 5381 - protein, 348 aa, Neisseria gonorrhoeae; identical to SEQ ID NO: 2809

SEQ ID NO: 5382 - DNA, 1649 bp, Bacteroides fragilis; identical to SEQ ID NO: 2810
  CDS (351)..(1307)

SEQ ID NO: 5383 - protein, 318 aa, Bacteroides fragilis; identical to SEQ ID NO: 2811

SEQ ID NO: 5384 - DNA, 1349 bp, Methylobacillus sp; identical to SEQ ID NO: 2812
  CDS (293)..(1327)

SEQ ID NO: 5385 - protein, 344 aa, Methylobacillus sp; identical to SEQ ID NO: 2813

SEQ ID NO: 5386 - DNA, 1320 bp, Vibrio anguillarum; identical to SEQ ID NO: 2814
  CDS (166)..(1212)

SEQ ID NO: 5387 - protein, 348 aa, Vibrio anguillarum; identical to SEQ ID NO: 2815

SEQ ID NO: 5388 - DNA, 1394 bp, Anabaena variabilis; identical to SEQ ID NO: 2816
  CDS (125)..(1201)

SEQ ID NO: 5389 - protein, 358 aa, Anabaena variabilis; identical to SEQ ID NO: 2817

SEQ ID NO: 5390 - DNA, 1334 bp, Bacillus subtilis; identical to SEQ ID NO: 2818
  CDS (215)..(1258)

SEQ ID NO: 5391 - protein, 347 aa, Bacillus subtilis; identical to SEQ ID NO: 2819

SEQ ID NO: 5392 - DNA, 1348 bp, Proteus mirabilis; identical to SEQ ID NO: 2820
  CDS (151)..(1218)

SEQ ID NO: 5393 - protein, 355 aa, Proteus mirabilis; identical to SEQ ID NO: 2821

SEQ ID NO: 5394 - DNA, 1384 bp, Pseudomonas aeruginosa; identical to SEQ ID NO: 2822
  CDS (145)..(1185)

SEQ ID NO: 5395 - protein, 346 aa, Pseudomonas aeruginosa; identical to SEQ ID NO: 2823

SEQ ID NO: 5396 - DNA, 1352 bp, Pseudomonas cepacia; identical to SEQ ID NO: 2824
  CDS (223)..(1266)

SEQ ID NO: 5397 - protein, 347 aa, Pseudomonas cepacia; identical to SEQ ID NO: 2825

SEQ ID NO: 5398 - DNA, 1047 bp, Synechococcus sp; identical to SEQ ID NO: 2826
  CDS (1)..(1047)

SEQ ID NO: 5399 - protein, 348 aa, Synechococcus sp; identical to SEQ ID NO: 2827

SEQ ID NO: 5400 - DNA, 1190 bp, Aquaspirillum magnetotacticum; identical to SEQ ID NO: 2828
  CDS (112)..(1146)

SEQ ID NO: 5401 - protein, 344 aa, Aquaspirillum magnetotacticum; identical to SEQ ID NO: 2829

SEQ ID NO: 5402 - DNA, 1841 bp, Rhizobium leguminosarum bv. viciae; identical to SEQ ID NO: 2830
  CDS (32)..(1087)

SEQ ID NO: 5403 - protein, 351 aa, Rhizobium leguminosarum bv. viciae; identical to SEQ ID NO: 2831

SEQ ID NO: 5404 - DNA, 1047 bp, Rhizobium meliloti; identical to SEQ ID NO: 2832
  CDS (1)..(1047)

SEQ ID NO: 5405 - protein, 348 aa, Rhizobium meliloti; identical to SEQ ID NO: 2833

SEQ ID NO: 5406 - DNA, 2762 bp, Mycobacterium tuberculosis; identical to SEQ ID NO: 2834
  CDS (311)..(2683)

SEQ ID NO: 5407 - protein, 790 aa, Mycobacterium tuberculosis; identical to SEQ ID NO: 2835

SEQ ID NO: 5408 - DNA, 1249 bp, Methylomonas clara; identical to SEQ ID NO: 2836
  CDS (123)..(1151)

SEQ ID NO: 5409 - protein, 342 aa, Methylomonas clara; identical to SEQ ID NO: 2837

SEQ ID NO: 5410 - DNA, 1065 bp, Enterobacter agglomerans; identical to SEQ ID NO: 2838
  CDS (1)..(1065)

SEQ ID NO: 5411 - protein, 354 aa, Enterobacter agglomerans; identical to SEQ ID NO: 2839

SEQ ID NO: 5412 - DNA, 1125 bp, Streptomyces lividans; identical to SEQ ID NO: 2840
  CDS (1)..(1125)

SEQ ID NO: 5413 - protein, 374 aa, Streptomyces lividans; identical to SEQ ID NO: 2841

SEQ ID NO: 5414 - DNA, 1347 bp, Rhodobacter sphaeroides; identical to SEQ ID NO: 2842
  CDS (220)..(1251)

SEQ ID NO: 5415 - protein, 343 aa, Rhodobacter sphaeroides; identical to SEQ ID NO: 2843

SEQ ID NO: 5416 - DNA, 1065 bp, Vibrio cholerae; identical to SEQ ID NO: 2844
  CDS (1)..(1065)

SEQ ID NO: 5417 - protein, 354 aa, Vibrio cholerae; identical to SEQ ID NO: 2845

SEQ ID NO: 5418 - DNA, 1068 bp, Rhodobacter capsulatus; identical to SEQ ID NO: 2846
  CDS (1)..(1068)

SEQ ID NO: 5419 - protein, 355 aa, Rhodobacter capsulatus; identical to SEQ ID NO: 2847

SEQ ID NO: 5420 - DNA, 1533 bp, Helicobacter pylori; identical to SEQ ID NO: 2848
  CDS (275)..(1318)

SEQ ID NO: 5421 - protein, 347 aa, Helicobacter pylori; identical to SEQ ID NO: 2849

SEQ ID NO: 5422 - DNA, 1065 bp, Synechocystis sp; identical to SEQ ID NO: 2850
  CDS (1)..(1065)

SEQ ID NO: 5423 - protein, 354 aa, Synechocystis sp; identical to SEQ ID NO: 2851

SEQ ID NO: 5424 - DNA, 1351 bp, Arabidopsis thaliana (mouse-ear cress); identical to SEQ ID NO: 2852
  CDS (1)..(1320)

SEQ ID NO: 5425 - protein, 439 aa, Arabidopsis thaliana (mouse-ear cress); identical to SEQ ID NO: 2853

SEQ ID NO: 5426 - DNA, 1392 bp, Pseudomonas putida; identical to SEQ ID NO: 2854
  CDS (111)..(1178)

SEQ ID NO: 5427 - protein, 355 aa, Pseudomonas putida; identical to SEQ ID NO: 2855

SEQ ID NO: 5428 - DNA, 1053 bp, Mycobacterium tuberculosis; identical to SEQ ID NO: 2856
  CDS (1)..(1053)

SEQ ID NO: 5429 - protein, 350 aa, Mycobacterium tuberculosis; identical to SEQ ID NO: 2857

SEQ ID NO: 5430 - DNA, 1053 bp, Wolinella succinogenes; identical to SEQ ID NO: 2858
  CDS (1)..(1053)

SEQ ID NO: 5431 - protein, 350 aa, Wolinella succinogenes; identical to SEQ ID NO: 2859

SEQ ID NO: 5432 - DNA, 1110 bp, Vibrio vulnificus; identical to SEQ ID NO: 2860
  CDS (1)..(1110)

SEQ ID NO: 5433 - protein, 369 aa, Vibrio vulnificus; identical to SEQ ID NO: 2861

SEQ ID NO: 5434 - DNA, 1068 bp, Photorhabdus luminescens; identical to SEQ ID NO: 2862
  CDS (1)..(1068)

SEQ ID NO: 5435 - protein, 355 aa, Photorhabdus luminescens; identical to SEQ ID NO: 2863

SEQ ID NO: 5436 - DNA, 1110 bp, Gloeobacter violaceus; identical to SEQ ID NO: 2864
  CDS (1)..(1110)

SEQ ID NO: 5437 - protein, 369 aa, Gloeobacter violaceus; identical to SEQ ID NO: 2865

SEQ ID NO: 5438 - DNA, 1053 bp, Chromobacterium violaceum; identical to SEQ ID NO: 2866
  CDS (1)..(1053)

SEQ ID NO: 5439 - protein, 350 aa, Chromobacterium violaceum; identical to SEQ ID NO: 2867

SEQ ID NO: 5440 - DNA, 1128 bp, Synechococcus sp; identical to SEQ ID NO: 2868
  CDS (1)..(1128)

SEQ ID NO: 5441 - protein, 375 aa, Synechococcus sp; identical to SEQ ID NO: 2869

SEQ ID NO: 5442 - DNA, 1128 bp, Rhodopirellula baltica; identical to SEQ ID NO: 2870
  CDS (1)..(1128)

SEQ ID NO: 5443 - protein, 375 aa, Rhodopirellula baltica; identical to SEQ ID NO: 2871

SEQ ID NO: 5444 - DNA, 1113 bp, Prochlorococcus marinus subsp; identical to SEQ ID NO: 2872
  CDS (1)..(1113)

SEQ ID NO: 5445 - protein, 370 aa, Prochlorococcus marinus subsp; identical to SEQ ID NO: 2873

SEQ ID NO: 5446 - DNA, 1140 bp, Prochlorococcus marinus; identical to SEQ ID NO: 2874
  CDS (1)..(1140)

SEQ ID NO: 5447 - protein, 379 aa, Prochlorococcus marinus; identical to SEQ ID NO: 2875

SEQ ID NO: 5448 - DNA, 1140 bp, Prochlorococcus marinus; identical to SEQ ID NO: 2876
  CDS (1)..(1140)

SEQ ID NO: 5449 - protein, 379 aa, Prochlorococcus marinus; identical to SEQ ID NO: 2877

SEQ ID NO: 5450 - DNA, 1038 bp, Helicobacter hepaticus; identical to SEQ ID NO: 2878
  CDS (1)..(1038)

SEQ ID NO: 5451 - protein, 345 aa, Helicobacter hepaticus; identical to SEQ ID NO: 2879

SEQ ID NO: 5452 - DNA, 1119 bp, Haemophilus ducreyi; identical to SEQ ID NO: 2880
  CDS (1)..(1119)

SEQ ID NO: 5453 - protein, 372 aa, Haemophilus ducreyi; identical to SEQ ID NO: 2881

SEQ ID NO: 5454 - DNA, 1048 bp, Campylobacter lari; identical to SEQ ID NO: 2882
  CDS (9)..(1043)

SEQ ID NO: 5455 - protein, 344 aa, Campylobacter lari; identical to SEQ ID NO: 2883

SEQ ID NO: 5456 - DNA, 1077 bp, Burkholderia fungorum; identical to SEQ ID NO: 2884
  CDS (1)..(1077)

SEQ ID NO: 5457 - protein, 358 aa, Burkholderia fungorum; identical to SEQ ID NO: 2885

SEQ ID NO: 5458 - DNA, 963 bp, Mycobacteriophage CJW1; identical to SEQ ID NO: 2886
  CDS (1)..(963)

SEQ ID NO: 5459 - protein, 320 aa, Mycobacteriophage CJW1; identical to SEQ ID NO: 2887

SEQ ID NO: 5460 - DNA, 1563 bp, Zymomonas mobilis; identical to SEQ ID NO: 2888
  CDS (231)..(1250)

SEQ ID NO: 5461 - protein, 339 aa, Zymomonas mobilis; identical to SEQ ID NO: 2889

SEQ ID NO: 5462 - DNA, 1038 bp, Bacillus megaterium; identical to SEQ ID NO: 2890
  CDS (1)..(1038)

SEQ ID NO: 5463 - protein, 345 aa, Bacillus megaterium; identical to SEQ ID NO: 2891

SEQ ID NO: 5464 - DNA, 1038 bp, Bacillus megaterium; identical to SEQ ID NO: 2892
  CDS (1)..(1038)

SEQ ID NO: 5465 - protein, 345 aa, Bacillus megaterium; identical to SEQ ID NO: 2893

SEQ ID NO: 5466 - DNA, 1044 bp, Bacillus amyloliquefaciens; identical to SEQ ID NO: 2894
  CDS (1)..(1044)

SEQ ID NO: 5467 - protein, 347 aa, Bacillus amyloliquefaciens; identical to SEQ ID NO: 2895

SEQ ID NO: 5468 - DNA, 1047 bp, Listeria monocytogenes; identical to SEQ ID NO: 2896
  CDS (1)..(1047): m means a or c

SEQ ID NO: 5469 - protein, 348 aa, Listeria monocytogenes; identical to SEQ ID NO: 2897
  misc_feature (228)..(228): Xaa can be Pro or Gln

SEQ ID NO: 5470 - DNA, 1035 bp, Oryza sativa; identical to SEQ ID NO: 2898
  CDS (1)..(1035)

SEQ ID NO: 5471 - protein, 344 aa, Oryza sativa; identical to SEQ ID NO: 2899

SEQ ID NO: 5472 - DNA, 1035 bp, Campylobacter lari; identical to SEQ ID NO: 2900
  CDS (1)..(1035)

SEQ ID NO: 5473 - protein, 344 aa, Campylobacter lari; identical to SEQ ID NO: 2901

SEQ ID NO: 5474 - DNA, 2035 bp, Borrelia hermsii; identical to SEQ ID NO: 2902
  CDS (256)..(1326)

SEQ ID NO: 5475 - protein, 356 aa, Borrelia hermsii; identical to SEQ ID NO: 2903

SEQ ID NO: 5476 - DNA, 1487 bp, Chlamydomonas reinhardtii; identical to SEQ ID NO: 2904
  CDS (121)..(1365)

SEQ ID NO: 5477 - protein, 414 aa, Chlamydomonas reinhardtii; identical to SEQ ID NO: 2905

SEQ ID NO: 5478 - DNA, 1669 bp, Streptococcus suis; identical to SEQ ID NO: 2906
  CDS (469)..(1500)

SEQ ID NO: 5479 - protein, 343 aa, Streptococcus suis; identical to SEQ ID NO: 2907

SEQ ID NO: 5480 - DNA, 1439 bp, Peanut witches; identical to SEQ ID NO: 2908
  CDS (218)..(1228)

SEQ ID NO: 5481 - protein, 336 aa, Peanut witches; identical to SEQ ID NO: 2909

SEQ ID NO: 5482 - DNA, 1377 bp, Myxococcus xanthus; identical to SEQ ID NO: 2910
  CDS (201)..(1277)

SEQ ID NO: 5483 - protein, 358 aa, Myxococcus xanthus; identical to SEQ ID NO: 2911

SEQ ID NO: 5484 - DNA, 1404 bp, Acidiphilium facilis; identical to SEQ ID NO: 2912
  CDS (187)..(1251)

SEQ ID NO: 5485 - protein, 354 aa, Acidiphilium facilis; identical to SEQ ID NO: 2913

SEQ ID NO: 5486 - DNA, 1059 bp, Actinobacillus actinomycetemcomitans; identical to SEQ ID NO: 2914
  CDS (1)..(1059)

SEQ ID NO: 5487 - protein, 352 aa, Actinobacillus actinomycetemcomitans; identical to SEQ ID NO: 2915

SEQ ID NO: 5488 - DNA, 1565 bp, Alcaligenes eutrophus; identical to SEQ ID NO: 2916
  CDS (194)..(1255)

SEQ ID NO: 5489 - protein, 353 aa, Alcaligenes eutrophus; identical to SEQ ID NO: 2917

SEQ ID NO: 5490 - DNA, 1047 bp, Amycolatopsis mediterranei; identical to SEQ ID NO: 2918
  CDS (1)..(1047)

SEQ ID NO: 5491 - protein, 348 aa, Amycolatopsis mediterranei; identical to SEQ ID NO: 2919

SEQ ID NO: 5492 - DNA, 1035 bp, Bacteroides thetaiotaomicron; identical to SEQ ID NO: 2920
  CDS (1)..(1035)

SEQ ID NO: 5493 - protein, 344 aa, Bacteroides thetaiotaomicron; identical to SEQ ID NO: 2921

SEQ ID NO: 5494 - DNA, 1194 bp, Bifidobacterium longum; identical to SEQ ID NO: 2922
  CDS (1)..(1194)

SEQ ID NO: 5495 - protein, 397 aa, Bifidobacterium longum; identical to SEQ ID NO: 2923

SEQ ID NO: 5496 - DNA, 1062 bp, Bordetella pertussis; identical to SEQ ID NO: 2924
  CDS (1)..(1062)

SEQ ID NO: 5497 - protein, 353 aa, Bordetella pertussis; identical to SEQ ID NO: 2925

SEQ ID NO: 5498 - DNA, 1089 bp, Bradyrhizobium japonicum; identical to SEQ ID NO: 2926
  CDS (1)..(1089)

SEQ ID NO: 5499 - protein, 362 aa, Bradyrhizobium japonicum; identical to SEQ ID NO: 2927

SEQ ID NO: 5500 - DNA, 2058 bp, Campylobacter fetus; identical to SEQ ID NO: 2928
  CDS (401)..(1438)

SEQ ID NO: 5501 - protein, 345 aa, Campylobacter fetus; identical to SEQ ID NO: 2929

SEQ ID NO: 5502 - DNA, 1458 bp, Chloroflexus aurantiacus; identical to SEQ ID NO: 2930
  CDS (116)..(1171)

SEQ ID NO: 5503 - protein, 351 aa, Chloroflexus aurantiacus; identical to SEQ ID NO: 2931

SEQ ID NO: 5504 - DNA, 1053 bp, Chlamydophila caviae; identical to SEQ ID NO: 2932
  CDS (1)..(1053)

SEQ ID NO: 5505 - protein, 350 aa, Chlamydophila caviae; identical to SEQ ID NO: 2933

SEQ ID NO: 5506 - DNA, 1087 bp, Chromatium vinosum; identical to SEQ ID NO: 2934
  CDS (1)..(1044)

SEQ ID NO: 5507 - protein, 347 aa, Chromatium vinosum; identical to SEQ ID NO: 2935

SEQ ID NO: 5508 - DNA, 1346 bp, Clostridium perfringens; identical to SEQ ID NO: 2936
  CDS (172)..(1230)

SEQ ID NO: 5509 - protein, 352 aa, Clostridium perfringens; identical to SEQ ID NO: 2937

SEQ ID NO: 5510 - DNA, 1053 bp, Clostridium tetani; identical to SEQ ID NO: 2938
  CDS (1)..(1053)

SEQ ID NO: 5511 - protein, 350 aa, Clostridium tetani; identical to SEQ ID NO: 2939

SEQ ID NO: 5512 - DNA, 1161 bp, Corynebacterium efficiens; identical to SEQ ID NO: 2940
  CDS (1)..(1161)

SEQ ID NO: 5513 - protein, 386 aa, Corynebacterium efficiens; identical to SEQ ID NO: 2941

SEQ ID NO: 5514 - DNA, 1402 bp, Corynebacterium glutamicum; identical to SEQ ID NO: 2942
  CDS (133)..(1263)

SEQ ID NO: 5515 - protein, 376 aa, Corynebacterium glutamicum; identical to SEQ ID NO: 2943

SEQ ID NO: 5516 - DNA, 1409 bp, Corynebacterium pseudotuberculosis; identical to SEQ ID NO: 2944
  CDS (223)..(1332)

SEQ ID NO: 5517 - protein, 369 aa, Corynebacterium pseudotuberculosis; identical to SEQ ID NO: 2945

SEQ ID NO: 5518 - DNA, 1032 bp, Coxiella burnetii; identical to SEQ ID NO: 2946
  CDS (1)..(1032)

SEQ ID NO: 5519 - protein, 343 aa, Coxiella burnetii; identical to SEQ ID NO: 2947

SEQ ID NO: 5520 - DNA, 1047 bp, Enterococcus faecalis; identical to SEQ ID NO: 2948
  CDS (1)..(1047)

SEQ ID NO: 5521 - protein, 348 aa, Enterococcus faecalis; identical to SEQ ID NO: 2949

SEQ ID NO: 5522 - DNA, 1072 bp, Erwinia carotovora; identical to SEQ ID NO: 2950
  CDS (1)..(1029)

SEQ ID NO: 5523 - protein, 342 aa, Erwinia carotovora; identical to SEQ ID NO: 2951

SEQ ID NO: 5524 - DNA, 1137 bp, Fusobacterium nucleatum; identical to SEQ ID NO: 2952
  CDS (1)..(1137)

SEQ ID NO: 5525 - protein, 378 aa, Fusobacterium nucleatum; identical to SEQ ID NO: 2953

SEQ ID NO: 5526 - DNA, 1613 bp, Herbaspirillum seropedicae; identical to SEQ ID NO: 2954
  CDS (199)..(1254)

SEQ ID NO: 5527 - protein, 351 aa, Herbaspirillum seropedicae; identical to SEQ ID NO: 2955

SEQ ID NO: 5528 - DNA, 1143 bp, Lactobacillus plantarum; identical to SEQ ID NO: 2956
  CDS (1)..(1143)

SEQ ID NO: 5529 - protein, 380 aa, Lactobacillus plantarum; identical to SEQ ID NO: 2957

SEQ ID NO: 5530 - DNA, 1101 bp, Leptospira interrogans; identical to SEQ ID NO: 2958
  CDS (1)..(1101)

SEQ ID NO: 5531 - protein, 366 aa, Leptospira interrogans; identical to SEQ ID NO: 2959

SEQ ID NO: 5532 - DNA, 1126 bp, Mycoplasma mycoides; identical to SEQ ID NO: 2960
  CDS (79)..(1116)

SEQ ID NO: 5533 - protein, 345 aa, Mycoplasma mycoides; identical to SEQ ID NO: 2961

SEQ ID NO: 5534 - DNA, 1050 bp, Mycobacterium smegmatis; identical to SEQ ID NO: 2962
  CDS (1)..(1050)

SEQ ID NO: 5535 - protein, 349 aa, Mycobacterium smegmatis; identical to SEQ ID NO: 2963

SEQ ID NO: 5536 - DNA, 1044 bp, Oceanobacillus iheyensis; identical to SEQ ID NO: 2964
  CDS (1)..(1044)

SEQ ID NO: 5537 - protein, 347 aa, Oceanobacillus iheyensis; identical to SEQ ID NO: 2965

SEQ ID NO: 5538 - DNA, 1071 bp, Paracoccus denitrificans; identical to SEQ ID NO: 2966
  CDS (1)..(1071)

SEQ ID NO: 5539 - protein, 356 aa, Paracoccus denitrificans; identical to SEQ ID NO: 2967

SEQ ID NO: 5540 - DNA, 1320 bp, Pasteurella haemolytica; identical to SEQ ID NO: 2968
  CDS (157)..(1263)

SEQ ID NO: 5541 - protein, 368 aa, Pasteurella haemolytica; identical to SEQ ID NO: 2969

SEQ ID NO: 5542 - DNA, 1500 bp, Pasteurella multocida; identical to SEQ ID NO: 2970
  CDS (175)..(1239)

SEQ ID NO: 5543 - protein, 354 aa, Pasteurella multocida; identical to SEQ ID NO: 2971

SEQ ID NO: 5544 - DNA, 1023 bp, Porphyromonas gingivalis; identical to SEQ ID NO: 2972
  CDS (1)..(1023)

SEQ ID NO: 5545 - protein, 340 aa, Porphyromonas gingivalis; identical to SEQ ID NO: 2973

SEQ ID NO: 5546 - DNA, 1824 bp, Prevotella ruminicola; identical to SEQ ID NO: 2974
  CDS (501)..(1523)

SEQ ID NO: 5547 - protein, 340 aa, Prevotella ruminicola; identical to SEQ ID NO: 2975

SEQ ID NO: 5548 - DNA, 978 bp, Proteus vulgaris; identical to SEQ ID NO: 2976
  CDS (1)..(978)

SEQ ID NO: 5549 - protein, 325 aa, Proteus vulgaris; identical to SEQ ID NO: 2977

SEQ ID NO: 5550 - DNA, 1047 bp, Pseudomonas oleovorans; identical to SEQ ID NO: 2978
  CDS (1)..(1047)

SEQ ID NO: 5551 - protein, 348 aa, Pseudomonas oleovorans; identical to SEQ ID NO: 2979

SEQ ID NO: 5552 - DNA, 1068 bp, Pseudomonas putida; identical to SEQ ID NO: 2980
  CDS (1)..(1068)

SEQ ID NO: 5553 - protein, 355 aa, Pseudomonas putida; identical to SEQ ID NO: 2981

SEQ ID NO: 5554 - DNA, 1110 bp, Pseudomonas syringae; identical to SEQ ID NO: 2982
  CDS (46)..(1110)

SEQ ID NO: 5555 - protein, 354 aa, Pseudomonas syringae; identical to SEQ ID NO: 2983

SEQ ID NO: 5556 - DNA, 1980 bp, Pseudomonas tolaasii; identical to SEQ ID NO: 2984
  CDS (414)..(1472)

SEQ ID NO: 5557 - protein, 352 aa, Pseudomonas tolaasii; identical to SEQ ID NO: 2985

SEQ ID NO: 5558 - DNA, 1501 bp, Rhizobium etli; identical to SEQ ID NO: 2986
  CDS (242)..(1327)

SEQ ID NO: 5559 - protein, 361 aa, Rhizobium etli; identical to SEQ ID NO: 2987

SEQ ID NO: 5560 - DNA, 1098 bp, Rhizobium loti; identical to SEQ ID NO: 2988
  CDS (1)..(1098)

SEQ ID NO: 5561 - protein, 365 aa, Rhizobium loti; identical to SEQ ID NO: 2989

SEQ ID NO: 5562 - DNA, 1092 bp, Rhodopseudomonas palustris; identical to SEQ ID NO: 2990
  CDS (1)..(1092)

SEQ ID NO: 5563 - protein, 363 aa, Rhodopseudomonas palustris; identical to SEQ ID NO: 2991

SEQ ID NO: 5564 - DNA, 1047 bp, Rhodopseudomonas viridis; identical to SEQ ID NO: 2992
  CDS (1)..(1047)

SEQ ID NO: 5565 - protein, 348 aa, Rhodopseudomonas viridis; identical to SEQ ID NO: 2993

SEQ ID NO: 5566 - DNA, 1074 bp, Shewanella oneidensis; identical to SEQ ID NO: 2994
  CDS (1)..(1074)

SEQ ID NO: 5567 - protein, 357 aa, Shewanella oneidensis; identical to SEQ ID NO: 2995

SEQ ID NO: 5568 - DNA, 1235 bp, Spirulina platensis; identical to SEQ ID NO: 2996
  CDS (54)..(1151)

SEQ ID NO: 5569 - protein, 365 aa, Spirulina platensis; identical to SEQ ID NO: 2997

SEQ ID NO: 5570 - DNA, 1074 bp, Staphylococcus epidermidis; identical to SEQ ID NO: 2998
  CDS (25)..(1074)

SEQ ID NO: 5571 - protein, 349 aa, Staphylococcus epidermidis; identical to SEQ ID NO: 2999

SEQ ID NO: 5572 - DNA, 1140 bp, Streptococcus agalactiae; identical to SEQ ID NO: 3000
  CDS (1)..(1140)

SEQ ID NO: 5573 - protein, 379 aa, Streptococcus agalactiae; identical to SEQ ID NO: 3001

SEQ ID NO: 5574 - DNA, 1119 bp, Streptomyces ambofaciens; identical to SEQ ID NO: 3002
  CDS (1)..(1119)

SEQ ID NO: 5575 - protein, 372 aa, Streptomyces ambofaciens; identical to SEQ ID NO: 3003

SEQ ID NO: 5576 - DNA, 1134 bp, Streptomyces avermitilis; identical to SEQ ID NO: 3004
  CDS (1)..(1134)

SEQ ID NO: 5577 - protein, 377 aa, Streptomyces avermitilis; identical to SEQ ID NO: 3005

SEQ ID NO: 5578 - DNA, 1152 bp, Streptococcus mutans; identical to SEQ ID NO: 3006
  CDS (1)..(1152)

SEQ ID NO: 5579 - protein, 383 aa, Streptococcus mutans; identical to SEQ ID NO: 3007

SEQ ID NO: 5580 - DNA, 1137 bp, Streptococcus pyogenes; identical to SEQ ID NO: 3008
  CDS (1)..(1137)

SEQ ID NO: 5581 - protein, 378 aa, Streptococcus pyogenes; identical to SEQ ID NO: 3009

SEQ ID NO: 5582 - DNA, 1356 bp, Streptococcus parasanguis; identical to SEQ ID NO: 3010
  CDS (118)..(1263)

SEQ ID NO: 5583 - protein, 381 aa, Streptococcus parasanguis; identical to SEQ ID NO: 3011

SEQ ID NO: 5584 - DNA, 1416 bp, Streptomyces rimosus; identical to SEQ ID NO: 3012
  CDS (229)..(1359)

SEQ ID NO: 5585 - protein, 376 aa, Streptomyces rimosus; identical to SEQ ID NO: 3013

SEQ ID NO: 5586 - DNA, 1916 bp, Streptococcus thermophilus; identical to SEQ ID NO: 3014
  CDS (555)..(1694)

SEQ ID NO: 5587 - protein, 379 aa, Streptococcus thermophilus; identical to SEQ ID NO: 3015

SEQ ID NO: 5588 - DNA, 1271 bp, Streptomyces violaceus; identical to SEQ ID NO: 3016
  CDS (75)..(1208)

SEQ ID NO: 5589 - protein, 377 aa, Streptomyces violaceus; identical to SEQ ID NO: 3017

SEQ ID NO: 5590 - DNA, 1068 bp, Synechococcus elongatus; identical to SEQ ID NO: 3018
  CDS (1)..(1068)

SEQ ID NO: 5591 - protein, 355 aa, Synechococcus elongatus; identical to SEQ ID NO: 3019

SEQ ID NO: 5592 - DNA, 1023 bp, Thermus thermophilus; identical to SEQ ID NO: 3020
  CDS (1)..(1023)

SEQ ID NO: 5593 - protein, 340 aa, Thermus thermophilus; identical to SEQ ID NO: 3021

SEQ ID NO: 5594 - DNA, 1405 bp, Thiobacillus ferrooxidans; identical to SEQ ID NO: 3022
  CDS (196)..(1236)

SEQ ID NO: 5595 - protein, 346 aa, Thiobacillus ferrooxidans; identical to SEQ ID NO: 3023

SEQ ID NO: 5596 - DNA, 1314 bp, Tropheryma whipplei; identical to SEQ ID NO: 3024
  CDS (1)..(1314)

SEQ ID NO: 5597 - protein, 437 aa, Tropheryma whipplei; identical to SEQ ID NO: 3025

SEQ ID NO: 5598 - DNA, 1411 bp, Vibrio cholerae; identical to SEQ ID NO: 3026
  CDS (183)..(1247)

SEQ ID NO: 5599 - protein, 354 aa, Vibrio cholerae; identical to SEQ ID NO: 3027

SEQ ID NO: 5600 - DNA, 1044 bp, Vibrio parahaemolyticus; identical to SEQ ID NO: 3028
  CDS (1)..(1044)

SEQ ID NO: 5601 - protein, 347 aa, Vibrio parahaemolyticus; identical to SEQ ID NO: 3029

SEQ ID NO: 5602 - DNA, 996 bp, Wigglesworthia glossinidia brevipalpis; identical to SEQ ID NO: 3030
  CDS (1)..(996)

SEQ ID NO: 5603 - protein, 331 aa, Wigglesworthia glossinidia brevipalpis; identical to SEQ ID NO: 3031

SEQ ID NO: 5604 - DNA, 1035 bp, Xanthomonas axonopodis; identical to SEQ ID NO: 3032
  CDS (1)..(1035)

SEQ ID NO: 5605 - protein, 344 aa, Xanthomonas axonopodis; identical to SEQ ID NO: 3033

SEQ ID NO: 5606 - DNA, 1594 bp, Xenorhabdus nematophilus; identical to SEQ ID NO: 3034
  CDS (142)..(1218)

SEQ ID NO: 5607 - protein, 358 aa, Xenorhabdus nematophilus; identical to SEQ ID NO: 3035

SEQ ID NO: 5608 - DNA, 1044 bp, Xylella fastidiosa; identical to SEQ ID NO: 3036
  CDS (1)..(1044)

SEQ ID NO: 5609 - protein, 347 aa, Xylella fastidiosa; identical to SEQ ID NO: 3037

SEQ ID NO: 5610 - DNA, 1020 bp, Zymomonas mobilis; identical to SEQ ID NO: 3038
  CDS (1)..(1020)

SEQ ID NO: 5611 - protein, 339 aa, Zymomonas mobilis; identical to SEQ ID NO: 3039

SEQ ID NO: 5612 - DNA, 1660 bp, primary endosymbiont of Sitophilus oryzae; identical to SEQ ID NO: 3040
  CDS (11)..(1078)

SEQ ID NO: 5613 - protein, 355 aa, primary endosymbiont of Sitophilus oryzae; identical to SEQ ID NO: 3041

SEQ ID NO: 5614 - DNA, 1110 bp, Azospirillum lipoferum; identical to SEQ ID NO: 3042
  CDS (1)..(1110)

SEQ ID NO: 5615 - protein, 369 aa, Azospirillum lipoferum; identical to SEQ ID NO: 3043

SEQ ID NO: 5616 - DNA, 1017 bp, Geobacter sulfurreducens; identical to SEQ ID NO: 3044
  CDS (1)..(1017)

SEQ ID NO: 5617 - protein, 338 aa, Geobacter sulfurreducens; identical to SEQ ID NO: 3045

SEQ ID NO: 5618 - DNA, 1230 bp, Mycobacterium paratuberculosis; identical to SEQ ID NO: 3046
  CDS (1)..(1230)

SEQ ID NO: 5619 - protein, 409 aa, Mycobacterium paratuberculosis; identical to SEQ ID NO: 3047

SEQ ID NO: 5620 - DNA, 1083 bp, Lactobacillus johnsonii; identical to SEQ ID NO: 3048
  CDS (1)..(1083)

SEQ ID NO: 5621 - protein, 360 aa, Lactobacillus johnsonii; identical to SEQ ID NO: 3049

SEQ ID NO: 5622 - DNA, 1245 bp, Treponema denticola; identical to SEQ ID NO: 3050
  CDS (1)..(1245)

SEQ ID NO: 5623 - protein, 414 aa, Treponema denticola; identical to SEQ ID NO: 3051

SEQ ID NO: 5624 - DNA, 1068 bp, Wolbachia pipientis wMel; identical to SEQ ID NO: 3052
  CDS (1)..(1068)

SEQ ID NO: 5625 - protein, 355 aa, Wolbachia pipientis wMel; identical to SEQ ID NO: 3053

SEQ ID NO: 5626 - DNA, 1074 bp, Desulfovibrio vulgaris; identical to SEQ ID NO: 3054
  CDS (1)..(1074)

SEQ ID NO: 5627 - protein, 357 aa, Desulfovibrio vulgaris; identical to SEQ ID NO: 3055

SEQ ID NO: 5628 - DNA, 1557 bp, Bacillus licheniformis; identical to SEQ ID NO: 3056
  CDS (369)..(1415)

SEQ ID NO: 5629 - protein, 348 aa, Bacillus licheniformis; identical to SEQ ID NO: 3057

SEQ ID NO: 5630 - DNA, 1119 bp, Corynebacterium diphtheriae; identical to SEQ ID NO: 3058
  CDS (1)..(1119)

SEQ ID NO: 5631 - protein, 372 aa, Corynebacterium diphtheriae; identical to SEQ ID NO: 3059

SEQ ID NO: 5632 - DNA, 1038 bp, Mycoplasma mycoides; identical to SEQ ID NO: 3060
  CDS (1)..(1038)

SEQ ID NO: 5633 - protein, 345 aa, Mycoplasma mycoides; identical to SEQ ID NO: 3061

SEQ ID NO: 5634 - DNA, 1134 bp, Bdellovibrio bacteriovorus; identical to SEQ ID NO: 3062
  CDS (1)..(1134)

SEQ ID NO: 5635 - protein, 377 aa, Bdellovibrio bacteriovorus; identical to SEQ ID NO: 3063

SEQ ID NO: 5636 - DNA, 1086 bp, Parachlamydia sp; identical to SEQ ID NO: 3064
  CDS (1)..(1086)

SEQ ID NO: 5637 - protein, 361 aa, Parachlamydia sp; identical to SEQ ID NO: 3065

SEQ ID NO: 5638 - DNA, 1071 bp, Photobacterium profundum; identical to SEQ ID NO: 3066

SEQ ID NO: 5639 - protein, 356 aa, Photobacterium profundum; identical to SEQ ID NO: 3067

SEQ ID NO: 5640 - DNA, 24 bp, artificial sequence
  Primer
atggctatcgacgaaaacaaacag

SEQ ID NO: 5641 - DNA, 27 bp, artificial sequence
  Primer
ttaaaaatcttcgttagtttctgctac

SEQ ID NO: 5642 - DNA, 1980 bp, Saccharomyces cerevisiae; identical to SEQ ID NO: 13
  CDS (1)..(1980)

SEQ ID NO: 5643 - protein, 659 aa, Saccharomyces cerevisiae; identical to SEQ ID NO: 14

SEQ ID NO: 5644 - DNA, 26 bp, artificial sequence
  Primer
atggatagtacgaatttgaacaaacg

SEQ ID NO: 5645 - DNA, 26 bp, artificial sequence
  Primer
ttagagtatttccagatctgaatctg

SEQ ID NO: 5646 - DNA, 4195 bp, Saccharomyces cerevisiae
  CDS (654)..(2900)
tggttagaactttcgtgataatttatttttatagttgaatatcttctttctctctcaactctgatccggattgtcgaggtttcaataagttactctgaacaactaatcaaaatatctccttatttctgtagattccttcagttccactttttacttttcttaattctctttgtatttattcctagcgacgaaaaatgcgagatctcgaccaaaaaaagggggtagggtaataaaattaaccctattattttttaactttaaaacctataatgtgctaatattttattataaacctcctttttttgcgttcaaaccctgacacattttaagccctatatttacggtattagttgattaaactccgaagcgaaaggaattcggtcattagcggctaatagccgttggggtaaatcacctacaagcaagtacacaagagaacgttggcgttgttaagtcaaagcactaatacattggggctttaagagtgtttataaaggtctaacctgtaaaaattatttaaacaacttgaacaggccttaaagttttcctcattccgctcatcatcactaatattgctctccgtttttgaatacacacttgacactaataagtatcacagaaaaaaagaaaatataataaattagtattgcgatatgacgagacgtactactattaatcccgattcggtggttctgaatcctcaaaaatttatccagaaagaaagggcggattcgaaaatcaaagttgaccaagttaacacatttttagagtcatccccggagaggagaactctgacgcacgccttaatagaccaaatagtgaatgatcctatattgaaaactgatacggactattacgatgctaaaaaaatgcaagagagagaaattactgccaaaaaaatagctaggcttgctagttatatggagcacgatatcaaaacagtgcgcaaacactttcgcgacactgacctgatgaaagagttgcaagcaaatgatccagacaaagcttcgcctttaacaaacaaagacctttttatattcgataagagattgtcacttgtagcaaatattgatcctcaattgggtacgcgcgtgggtgtacacttggggctatttggtaattgtatcaagggcaatggtactgatgagcaaatccggtattggttgcaggagagaggtgccactttgatgaaaggtatatatggctgttttgcaatgactgagttaggacatggttccaatgttgcccagctgcagactagggctgtgtacgataagcaaaatgatacttttgtaattgatacacctgatctaactgccaccaaatggtggattggtggggctgcccattctgccacgcacgctgccgtgtacgccagattgatcgttgaaggtaaagactacggtgtaaaaacattcgttgttcctctgagagacccttcgactttccaactgttagctggtgtttccataggggatattggagcgaagatgggtcgtgacggtattgataatggctggatccagttcagaaacgtagttatccctagagaatttatgctaagtagatttaccaaagttgtccgttctccagatggttcagtcaccgtcaaaactgagccacaattggatcaaatttctggttatagtgcattgttaagtggtagagttaacatggtcatggattcatttaggtttggctccaaatttgctactattgctgtacgttacgcggttggtcgtcagcaattcgcacctagaaagggattgtctgaaacacaattaatcgactatccccttcaccaatatcgtgttttaccacaattgtgtgttccatatttggtgtcacctgtagcttttaagttaatggacaactattattccactttggacgagttatacaacgcttcctcatctgcatacaaagctgctctggttaccgtgagtaaaaagttgaagaatttatttattgatagcgccagcttgaaagccaccaatacttggttaattgctacactgattgatgagttgagacagacttgcggaggacatgggtattcacagtataacggatttggtaaaggctatgacgactgggtggttcagtgcacatgggagggtgataataatgttttatctttaacttcagcaaaatcaatattgaaaaaatttatcgattcagccacaaagggtagatttgacaacacactggatgtggactcattctcttacttaaaacctcagtacataggatctgtggtttctggagaaataaagagtggtttaaaggagttgggtgattatactgaaatttggtctatcaccttaatcaaattactggcacatattggtactttagttgaaaaatcaagaagtattgatagcgtttctaagcttttagtcttagtatccaaatttcatgccttgcgctgcatgttgaaaacctattacgacaagttaaactctcgtgattcacatatttccgatgaaattacaaaggaatctatgtggaatgtttataagttattttccttgtattttattgacaagcattccggagaattccaacaattcaagatcttcactcctgatcagatctctaaagttgtgcagccacaactattggctcttttgccaattgtgaggaaagactgtataggtctgacagactcctttgaattacctgacgcgatgttaaattctcctataggttactttgatggcgatatctatcacaattacttcaatgaagtttgccgcaataatccagtggaggcagatggggcagggaagccttcttatcatgcgctgttgagcagcatgctcggtagaggtttcgaatttgaccaaaagttaggtggtgcagctaatgcggaaattttatcgaaaataaacaagtgagtagaggtttcctgttttccttcgaaccctctgttttgcgacttttgtttcaattcaactagtgtcgccaagttttaacaaaaagttacaaaatcctagtgagaggccatcttatgtgcataacggtactctctatctatttacatatctaatactattcacataactatgacgaatcaatgacatgactacatttaccaatgtatagtagtaaaaaaattgccatctcctagaatcgaaccagggtttcatcggccacaacgatgtgtactaaccactatactaagatggcaggtaattattgagtgtttactcaatatctcagaattatatacataacaaataataaatgtgctgtgttggcacttgttggaatgaagctctaaaacatcatgatgattgtgtggattctgatgtaattgttgggattccatttttaataaggcaatatgttggaacgagagtaattaatagtgacatgagttgctatggtaacaatctaatgcttacatcgtatattaatgtacacatcgtatacgtttaagtgtgattgcgcctattgcagaaggaatgttaaacgagaagctcagacaatactgaagctgtgttaaagacctattagctgaacatgatatggtaggtacatatatgaggaatatgagtcgtcacatcaatgtatagtaactaccggaatcactattatattggtcatgattaatatgaccaatcggcgtgtgttttatatacctctcttatttagtataagaagatcagtactcacttcttcattaatactaatttttaacctctaattatcaacacaataatattaggtatgtagatatactagaagttctcctccaggatttaggaatccataaaagggagtctgcaattctacacaattctataaatattatcatcatcgttttatatgttaatattcattgatcctattacattatcaatccttgcgtttcagcttccactaatttagatgactatttctcatcatttgcgtcatcttctaacaccgaatatcataatatactagtaacgtaaatactagttagtagatgatagttgatttttattccaacagtttatcaactagtagtcacactaccaatatattatcatatacggtgttagaagatgacataaggtatgagaagctttcatcgaaggtagaggaagcagaaatacaaggatttataatgtaatagggtaatggaacatataagggaggagaaatgatggtgatattaatatgcagaaatatcgattccattttt

SEQ ID NO: 5647 - protein, 748 aa, Saccharomyces cerevisiae
MTRRTTINPDSVVLNPQKFIQKERADSKIKVDQVNTFLESSPERRTLTHALIDQIVNDPILKTDTDYYDAKKMQEREITAKKIARLASYMEHDIKTVRKHFRDTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFVIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSAYKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGEIKSGLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 5648 - DNA, 2026 bp, Arabidopsis thaliana (mouse-ear cress)
  CDS (1)..(1995)
atggagagagttgatcaccttgccgatgagaggaacaaagcagagttcaacgtcgacgatatgaagatcgtctgggccggttcccgccacgctttcgatgtttcaaatcgtatgtctcgcctcgtcgctaatgatccggtctttgagaaaagcaaaagagctgtgatgagtaggaaagagttgttcaagaacacgttgaggaaaagtgttcacgcttggaagttgattaacgagcttcgtctctcagatgaggaaggactcaaattgagatctttcatggatcaaccaggcttcttggatctgcattggggaatgtttgtgcctgcaattaaaggacaaggcacagagcaacaacaacaaaagtggttgtctttagctactaagatgcagataattggatgttatgctcaaactgagcttggtcatggctctaatgttcaaggccttgagacaaccgctacttttgatccaaagacagatcagtttatcattcacagtccaactcagacatcatccaaatggtggcctggtgggttaggaaaagtttctactcatgctgttatttatgctcgtctaataaccaatggcaaagaccatggtgtacatggattcatcgtgcagctgcgtagtttggatgatcattctcctcttccgggtataaccgttggtgatatcggaatgaagtttggaaacggggcatataactcaatggacaatggttttcttatgtttgatcattttcgcattcctagagatcaaatgctcatgagactgtcaaaagttacaagagaaggaaaatatgtagcatcagatgttccaaggcaattggtgtatggtactatggtgtatgtgagacagtctattgtgtcaaatgcttccaccgcgctggctcgggcagtttgcattgctactaggtacagtgctgttcgaaggcagtttggctcacatgatggtggcattgagacacaggtgattaattataaaactcagcagaacaggttgtttcctctgctggcatctgcatatgcatttcggtttgtaggggaatggctgaagtggctctacactgatgtaacaaaaagactagaggccagtgatttcgcaacattgcctgaagctcatgcatgcactgctggattgaagtctatgactacctcagccacctctgatgggattgaagaatgtcgtaagttatgtggtggacatggatacttgtggtgtagtgggcttcctgaattgtttgctgtatatgttcctgcttgcacatacgagggagacaatgttgtgttgcagttacaggttgctagatttctgatgaagacagtttcacagttgggttctggaaaggctccttctgggacaactgcttatatgggcagagcaaaacaccttttgcaatgcagttccggagttcgaaatgctagggactggttaaaccctggtatggtgttggaagcttttgaagcaagagctttgagaatggctgttacttgtgctaacaatctaagcaagtttgagaatcaagaacaaggattctcagaactcttggctgatcttgttgaggctgctactgctcattgccagttaattgttgtttctaagtttatagccaaagtagagggagatattgaaggaaaaggagtgaagaaacagctcaagaatctatgctacatctacgcactctatctccttcacaaacaccttggtgatttcctcagtacaaactctgttactcctgaacaagcctcacttgcgaaccagcagcttcgatcactctactctcaggttcgaccaaacgcagtggccctagtggacgccttcgactacacggaccagtatcttggctctgtcttaggccgctatgacggaaacgtttatccaaagcttttcgaggaagcgttgaaggatccactcaatgactcggtggttcctgacggctaccgtgagtacatccgaccgttgattaagcaacgcttccgctctgccaaactctaactctttctttgtgcggctaaaaggggcaaca

SEQ ID NO: 5649 - protein, 664 aa, Arabidopsis thaliana (mouse-ear cress)
MERVDHLADERNKAEFNVDDMKIVWAGSRHAFDVSNRMSRLVANDPVFEKSKRAVMSRKELFKNTLRKSVHAWKLINELRLSDEEGLKLRSFMDQPGFLDLHWGMFVPAIKGQGTEQQQQKWLSLATKMQIIGCYAQTELGHGSNVQGLETTATFDPKTDQFIIHSPTQTSSKWWPGGLGKVSTHAVIYARLITNGKDHGVHGFIVQLRSLDDHSPLPGITVGDIGMKFGNGAYNSMDNGFLMFDHFRIPRDQMLMRLSKVTREGKYVASDVPRQLVYGTMVYVRQSIVSNASTALARAVCIATRYSAVRRQFGSHDGGIETQVINYKTQQNRLFPLLASAYAFRFVGEWLKWLYTDVTKRLEASDFATLPEAHACTAGLKSMTTSATSDGIEECRKLCGGHGYLWCSGLPELFAVYVPACTYEGDNVVLQLQVARFLMKTVSQLGSGKAPSGTTAYMGRAKHLLQCSSGVRNARDWLNPGMVLEAFEARALRMAVTCANNLSKFENQEQGFSELLADLVEAATAHCQLIVVSKFIAKVEGDIEGKGVKKQLKNLCYIYALYLLHKHLGDFLSTNSVTPEQASLANQQLRSLYSQVRPNAVALVDAFDYTDQYLGSVLGRYDGNVYPKLFEEALKDPLNDSVVPDGYREYIRPLIKQRFRSAKL

SEQ ID NO: 5650 - DNA, 2070 bp, Arabidopsis thaliana (mouse-ear cress)
  CDS (12)..(2039)
aatccctagaaatgtccgaaaatgttgaactccggcgagcccatattctcgctaatcacatactccgttcacctcggccttcttcaaacccctccctcacgccggaagtatgttttcagtactctccaccggagctcaacgagagctatggattcgaagtcaaggagatgagaaaactactcgacggacacaacttagaggaaagagactggctttatgggctcatgatgcagagcaatctgtttaacccgaaacagagaggaggtcagattttcgtctcgcccgattacaatcaaacaatggagcaacagcgccagatcagtatgaagcggatcttttacttgctcgaaaaaggggtctttcaaggatggctaacggagacaggtcctgaagctgagctcaagaagtttgctctctacgaagtttgcgggatttatgattactccctctccgccaaactcggtgttcacttcttgttgtggggtaatgctgttaagttctttgggacaaagcgtcaccatgaaaagtggctgaaagacactgaagattatgttgtcaagggctgctttgcaatgactgagctaggccatggaactaatgtacggggaattgaaacagtgactacttatgacccaacaactgaagagtttgtgataaatactccttgtgaatctgctcagaagtattggatcggtgaggcagctaaccatgcaaaccatgcaattgtgatttctcagcttagtatgaatgggaccaaccaggggattcatgtctttattgctcaaatcagagatcatgatggcaacacatgtcctaacgtccgcatagctgactgtggacacaaaattggtttgaatggtgttgacaatggccgtatatggtttgacaatcttcgaattccaagagagaatttattgaactcagttgctgatgttttagctgatgggaagtatgttagctcaattaaagatcctgatcagagatttggagcattcttggcccctttgacatctggtcgtgtcacaattgcttcaagtgcaatttattctgcaaagctcggattagctgttgctattagatactcactatcgagaagagccttctcagttgcagccaatggtcctgaagttctccttcttgattatccaagccatcaaagacgacttttaccactcctagcaaagacatatgctatgagttttgctgtaaatgacttgaagatgatttacgtgaagaggacacctgagaccaacaaagccatccatgtcgtttcaagtggattcaaagctgttctcacttggcacaatatgcgaacgcttcaggaatgtcgtgaagctgttggaggccaaggtttgaaaacagaaaaccgagtaggtcatttaaaaggagaatatgatgtgcagactacatttgagggtgacaataatgtactcatgcagctggtgagcaaggcactttttgctgaatatgtatcgtgtaagaagagaaataaacctttcaaaggattgggattggagcacatgaacagtccacgtcctgtattgccgactcaactcacatcatctacactaagatgcagccagttccagaaaagtgtgttttgcttaagagagcgagatcttctagaacggtttacttctgaagttgcagagcttcaagggagaggagaaagcagagagttcttattccttttgaatcatcaactttctgaagacttaagtaaagctttcacagaaaaagcaatactgcaaaccgttttggatgctgaggccaaattgcctcctggctcagttaaggatgtgttgggtcttgtaagatcaatgtacgcattgatcagcttggaagaagatccatcgctgctaagatatggtcacctctcaagggataatgttggagatgtgaggaaagaagtttcaaagctctgtggagagcttagacctcacgcacttgcactcgtggcttcattcgggattccagacgccttcttgagtccaattgcattcaactgggtcgaagccaacgcttggtcttcactttagttacttgctagtaataatctcttccactaat

SEQ ID NO: 5651 - protein, 675 aa, Arabidopsis thaliana (mouse-ear cress)
MSENVELRRAHILANHILRSPRPSSNPSLTPEVCFQYSPPELNESYGFEVKEMRKLLDGHNLEERDWLYGLMMQSNLFNPKQRGGQIFVSPDYNQTMEQQRQISMKRIFYLLEKGVFQGWLTETGPEAELKKFALYEVCGIYDYSLSAKLGVHFLLWGNAVKFFGTKRHHEKWLKDTEDYVVKGCFAMTELGHGTNVRGIETVTTYDPTTEEFVINTPCESAQKYWIGEAANHANHAIVISQLSMNGTNQGIHVFIAQIRDHDGNTCPNVRIADCGHKIGLNGVDNGRIWFDNLRIPRENLLNSVADVLADGKYVSSIKDPDQRFGAFLAPLTSGRVTIASSAIYSAKLGLAVAIRYSLSRRAFSVAANGPEVLLLDYPSHQRRLLPLLAKTYAMSFAVNDLKMIYVKRTPETNKAIHVVSSGFKAVLTWHNMRTLQECREAVGGQGLKTENRVGHLKGEYDVQTTFEGDNNVLMQLVSKALFAEYVSCKKRNKPFKGLGLEHMNSPRPVLPTQLTSSTLRCSQFQKSVFCLRERDLLERFTSEVAELQGRGESREFLFLLNHQLSEDLSKAFTEKAILQTVLDAEAKLPPGSVKDVLGLVRSMYALISLEEDPSLLRYGHLSRDNVGDVRKEVSKLCGELRPHALALVASFGIPDAFLSPIAFNWVEANAWSSL

SEQ ID NO: 5652 - DNA, 2070 bp, Homo sapiens (man)
  CDS (14)..(1996)
gctggtcgtcgccatgaacccggacctgcgcagggagcgggattccgccagcttcaacccggagctgcttacacacatcctggacggcagcctcgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatccgtgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatgaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgcgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcg

SEQ ID NO: 5653 - protein, 660 aa, Homo sapiens (man) [sequence omitted]

SEQ ID NO: 5654 - DNA, 2723 bp, Candida maltosa
  CDS (445)..(2619)
atcaatagatagagggaactacaattgttctatttctcttggaagtcgctttttttaacagatagttgtgcaaacttttgttttgaaaagtagtgcaaagacgaaaaattcgcacaaaaatttcctaattgggccaaacttctatgggggacagtccggaatgaggaaaatgcacttatactttttttttttcatccacaaagaaaaaaaaaggcggggcagctgaaaatgaaaaaaagcgggtttctatacacaaccgtggggatgaaaattcaagcatcaacaatagctagtttaatatttaaaaatactgatatcccccttataaataacttttgattcaatttcttttcttcttcttcttttttttttatttttcaagtctccatactttttctcttttttttttatatttatttcttatttatctatacttaactcaccatggctttgatttcaaacttaaaggatgaatacgatcatccaactaaaacagacccagataccaacccaaaaattgtcgctgatataatttcttctaaagaaccacctcaaccatctcaagatgttgctgaagaaagaagtcgtactgattgggacttgaaagaaatgcacgaattcttggaaggtgacgaagctaaatctgaagaaattttaagattgtatcaatccattgaacgtgatccaattttgcaaactagaccagaacaattcgactacaccaagaacgaagaaagagaatctgttgctctcagaatcaaccaaatgagtaaatacttggaaactgaaccttacgaaaaattcagaaggagattacaattgatgactgttaatgatccatctttaggtattagaatgttggtcaacattggtttgttcttgaactgtattagaggtaacggtacccaaaaacaatacgatttctgggctaaaaccaaagaagctggtaaagttaaacaacttttacggttgtttcggtatgacgaattgggtcacggtttcaacgttgctggatgtgaaatctttgctacttttgatgaaaaaacggatcaattcatcattgataccccacacattggtgctactaaatggtggattggtggtgctgcccactctgctacccataccgtttgttatgctagattgattgtcaaagacattgactatggtgtcaagactttcgttgtcccattgagagactcaacccataacttattaccaggtgttgccattggtgatattggtccaaaattgggtagacaaggggttgacaatggttggatccaatttaccgaagttagaatcccaagattcttcatgttgcaaagatggtgtaaagttgaccgtcaaggtaatgtcactttgccaccattggaacaattgtcttacatttcccttttggaaggtagagttggtatggctactgattcctacagaattggtgctagatacaccaccattgctttgagatatgctgttgccagaagacaattctccaaaggtgatggacaaccagaaactaaattgattgattacactttacatcaaagaagattgttaccttacttggctcttacttacttggccgctcttggtactgataaattagaacgtcaacacgatcaattattgaagaacttggacaaagctttggccactaacaacaaattgttgttgaaaaacactatccaaagtactaaatccatgtttgttgactctggttcattgaaatctactttgacttggttggcttctgatttgatcaatgaagctagacaatcttgtggtggtcacggttactctgcttacaatggttttggtaaaacatacggtgactgggctgtccaatgtacttgggaaggtgataacaatgtcttaggtatgtctgctggtaagactattatcaagactgttcaacaagttttgaatggtaaacaattgaaggattccactttagaattccttaacgatgctcctgctttatcttctgctaagaaagctgttattagaatcaagagccacgttgatgacactgacagagtcttgaaagctattgctggtttgatctccaaatatgctaaagatttgattccagtttcctaccaatcttgggactccattggtccacaaagagttgttttgtctaaattcagatgtcactactacttgttggaaactttcaatgaaagattaaacgacagaatcaaggccaaatctccagctagaccacatttggaaaacattatcaagttgtactacgtcaccaacgttttgggtccattcattgatgaattcttgagattcggtgttatttctccaagtgtggctaaatacattaccactgaatatccacaaaaattatgtgctgccattagaccatacgttattggtttgactgattctttccaacaaccagataacttcatcaactctttgattggtagatatgatggtaatgtttacaccaactacttgactaatgtcactaatgttaacgacccgaccaattacaaagctccatactctgaagctttagaagctatgttgaaccgtgcttctcttgaagaaagagaaagatttgaaaagagtaaagcagttgctgctaaattatctcaatagttttgctgctttttatcttttttttttctaaaaaataatcaaagtgtttatttatttcatttttatcagttgtttagataaatatatgtttatatgactttaaa

SEQ ID NO: 5655 - protein, 724 aa, Candida maltosa
MALISNLKDEYDHPTKTDPDTNPKIVADIISSKEPPQPSQDVAEERSRTDWDLKEMHEFLEGDEAKSEEILRLYQSIERDPILQTRPEQFDYTKNEERESVALRINQMSKYLETEPYEKFRRRLQLMTVNDPSLGIRMLVNIGLFLNCIRGNGTQKQYDFWAKTKEAGKVKQLLRLFRYDELGHGFNVAGCEIFATFDEKTDQFIIDTPHIGATKWWIGGAAHSATHTVCYARLIVKDIDYGVKTFVVPLRDSTHNLLPGVAIGDIGPKLGRQGVDNGWIQFTEVRIPRFFMLQRWCKVDRQGNVTLPPLEQLSYISLLEGRVGMATDSYRIGARYTTIALRYAVARRQFSKGDGQPETKLIDYTLHQRRLLPYLALTYLAALGTDKLERQHDQLLKNLDKALATNNKLLLKNTIQSTKSMFVDSGSLKSTLTWLASDLINEARQSCGGHGYSAYNGFGKTYGDWAVQCTWEGDNNVLGMSAGKTIIKTVQQVLNGKQLKDSTLEFLNDAPALSSAKKAVIRIKSHVDDTDRVLKAIAGLISKYAKDLIPVSYQSWDSIGPQRVVLSKFRCHYYLLETFNERLNDRIKAKSPARPHLENIIKLYYVTNVLGPFIDEFLRFGVISPSVAKYITTEYPQKLCAAIRPYVIGLTDSFQQPDNFINSLIGRYDGNVYTNYLTNVTNVNDPTNYKAPYSEALEAMLNRASLEERERFEKSKAVAAKLSQ

SEQ ID NO: 5656 - DNA, 2975 bp, Candida maltosa
  CDS (406)..(2535)
tctagagtatgatatctttcggcatcataacttctacttgatatcagaggttatttattatctaaacttacatagacaatacccagagaaactggtggtttttattttttttgctttttgtctgtgtggagttgttgttcgctatgtacattttttttgaaaaataacccccgcgataaaagttaacttgtgaaatttttcctctcttttttttcttttttagtgccagaaaaaattatttttttttcgccattcctgtgattataaaatcaatcagttacccccagattttgcttttttttttcaaaataatttttttttatactttttttttcttcttctttctccagacatatcaaatacaactgatttgttaatatttattccaatatctttaacgacataatgacattcacaaagaaaaacgtcagcgtatcacaaggaccagatcctagaacctctattcaaactgaaagagccaactccaaattcgacccagtcacaatgaactactttttggaaggttctaaagaaagatctgaattgatgaaatccttagctcaacaaattgaaagagatccaatcttattcaccgatggttcttactatgacttgactaaagatcaacaaagagaattgactgtcttgaaaatcaacagattgtccagatacagagaaggtgactctgttgatactttcaacaagagattatccattatgggtgttgttgatcctcaagttgctactagaattggtgtcaatttaggtttgttcctttcttgtatcagtggtaacggtactgctgaacaattcaaatactgggctattgacaaaggtacccacaacatccaaggtctttacggttgtttcggtatgactgaattgggtcacggttctaatgttgctggtgttgaaaccactgctacttttgacaaagaaaccgatgaatttgttattaataccccacacattggtgctactaaatggtggattggtggtgctgcccactctgctactcactgttctgtttacgccagattggttgttgacggtaaagattacggtgtcaagactttcgttgttccattgagagattctaatcacgaccttatgccaggtgtcactgttggtgatattggtgctaagatgggtagagatggtattgataacggttggattcaattctccaacgttagaattccaagattctttatgttgcaaaaattctgtaaagtttccgctgaaggtgaagttgttttaccaccattggaacaattatcctactccgctttattaggtggtagagttatgatggttttggattcctacagaatgttggccagagtctccaccattgctttgagatatgctattggtagaagacaattcaaaggtgacaatgtcgaccaaaacgatccaaatgctttggaaactcaattgattgactacccattacatcaaaagagattattcccatacttggctgctgcttacgttgtttccactggtgctcttaaagttgaacacactattcaatctactttggctactttagatgccgctgttgaaaacaatgatactactgctatcttcaaatctattgatgacatgaaatctttgttcattgactctggttccttgaaagctactactacttggttagctgctgaagctattgatcaatgtagacaagcttgtggtggtcatggttactcatcatacaatggtttcgctaaagctttcaacgattgggttgtccaatgtacttgggaaggtgacaacaacgttttatcattaagtgttggtaaaccaatcatcaaacaaattatcggtattgaagataatggtaagactgttagaggttctactgcattcttgaaccaagttaaagatttcactggttctaatgcttctaaagttgttttgaacaacacttctgacttgaacgacatcaataaagtcattaaatctattgaagttgctatcatcagattggctcatgaagctgctatcagtgtcagaaaagaatctcttgatttcgctggtgctgaattggtccaaatctctaaattgaaggctcaccactacttgttgactgaattcgtcaagagagttggtgaatttgaacacaaagaattggttccattcttgaacactattggtagattatattccgctactgttgttttggataaattcgctggtgtcttcttgaccttcaatgttgcttctccacaagctatcactgatttggcttccactcaaattccaaaattatgtgctgaagttagaccaaacgttgttgcttacactgactccttccaacaatccgatatggttatcaactctgctattggtaaatacgatggtgatgtttacgaaaactactttgatttggttaaacaattgaacccaccaaagaacactaaagctccatacactgctgctttggaaggtatgttgaacagaccatcattggaagctagagaaagatacgaaaaatccgatgaaactgctgctattttgtccaaatagataaaattaagggaataacagaaagtaaataaatttaagcattttttgcaatgattcttttgataagagtttttatttcgattttctttttttatattagtaaaaaaaataatataagtatatttatgtaaggtttttttagttgttaatgaatacaaaaataaaaaaaaaattgtttgttatttgatcattattagttaattacatattaggttgcgaattttttttttttgtatgtatctggtgatgtaatacggaaaaaccaaaactcactaaatcggttaaacttttttatttttacaccgaaccaacacatataaaagggggatgtaatcggtcatttgtagatatattattttttgtttgatgtaattattaaaacaactatctcaatgagttcggtacttttcagaatatttagtttaattttattaggatcc

SEQ ID NO: 5657 - protein, 709 aa, Candida maltosa
MTFTKKNVSVSQGPDPRTSIQTERANSKFDPVTMNYFLEGSKERSELMKSLAQQIERDPILFTDGSYYDLTKDQQRELTVLKINRLSRYREGDSVDTFNKRLSIMGVVDPQVATRIGVNLGLFLSCISGNGTAEQFKYWAIDKGTHNIQGLYGCFGMTELGHGSNVAGVETTATFDKETDEFVINTPHIGATKWWIGGAAHSATHCSVYARLVVDGKDYGVKTFVVPLRDSNHDLMPGVTVGDIGAKMGRDGIDNGWIQFSNVRIPRFFMLQKFCKVSAEGEVVLPPLEQLSYSALLGGRVMMVLDSYRMLARVSTIALRYAIGRRQFKGDNVDQNDPNALETQLIDYPLHQKRLFPYLAAAYVVSTGALKVEHTIQSTLATLDAAVENNDTTAIFKSIDDMKSLFIDSGSLKATTTWLAAEAIDQCRQACGGHGYSSYNGFAKAFNDWVVQCTWEGDNNVLSLSVGKPIIKQIIGIEDNGKTVRGSTAFLNQVKDFTGSNASKVVLNNTSDLNDINKVIKSIEVAIIRLAHEAAISVRKESLDFAGAELVQISKLKAHHYLLTEFVKRVGEFEHKELVPFLNTIGRLYSATVVLDKFAGVFLTFNVASPQAITDLASTQIPKLCAEVRPNVVAYTDSFQQSDMVINSAIGKYDGDVYENYFDLVKQLNPPKNTKAPYTAALEGMLNRPSLEARERYEKSDETAAILSK

SEQ ID NO: 5658 - DNA, 2288 bp, Candida tropicalis
  CDS (153)..(2282)
tataaaatcaactccatttccctaaaatctccccagattctaaaaacaacttcttctcttctgcttttcctttttttttgttatatttatttaccatcccttttttttgaatagttattccccactaacattgttcaaatcttcacgacataatgacttttacaaagaaaaacgttagtgtatcacaaggtcctgaccctagatcatccatccaaaaggaaagagacagctccaaatggaaccctcaacaaatgaactacttcttggaaggctccgtcgaaagaagtgagttgatgaaggctttggcccaacaaatggaaagagacccaatcttgttcacagacggctcctactacgacttgaccaaggaccaacaaagagaattgaccgccgtcaagatcaacagaatcgccagatacagagaacaagaatccatcgacactttcaacaagagattgtccttgattggtatctttgacccacaggtcggtaccagaattggtgtcaacctcggtttgttcctttcttgtatcagaggtaacggtaccacttcccaattgaactactgggctaacgaaaaggaaaccgctgacgttaaaggtatctacggttgtttcggtatgaccgaattggcccacggttccaacgttgctggtttggaaaccaccgccacatttgacaaggaatctgacgagtttgtcatcaacaccccacacattggtgccaccaagtggtggattggtggtgctgctcactccgccacccactgttctgtctacgccagattgattgttgacggtcaagattacggtgtcaagacttttgttgtcccattgagagactccaaccacgacctcatgccaggtgtcactgttggtgacattggtcccaagatgggtagagatggtatcgataacggttggattcaattctccaacgtcagaatcccaagattctttatgttgcaaaagttctgtaaggtttctgctgaaggtgaagtcaccttgccacctttggaacaattgtcttactccgccttgttgggtggtagagtcatgatggttttggactcctacagaatgttggctagaatgtctaccattgccttgagatacgccattggtagaagacaattcaagggtgataatgtcgatccaaacgatccaaatgctttggaaacccaattgatagattacccattgcaccaaaagagattgttcccatacttcgtgccgcctatgtcgtctccgctggtgccctcaaggttgaacacaccatcgagaccaccttggctgaattggacgctgccgttgaaaagaacgacaccaaggctaatctttaagtctattgacgacatgaagtcattgtttgttgactctggttccttgaagtccactgccacttggttgggtgctgaagccattgaccaatgtagacaagcctgtggtggtcacggtcactcttcctacaacggtttcggtaaggcctacaacgattgggttgtccaatgtacctgggaaggtgacaacaatgtcttgggcatgagtgttggtaagccaattgtcaagcaagtcatcagcattgaagatgccggcaagaccgtcagaggctccactgctttcttgaaccaattgaaggaatacactggttccaacagctccaaggttgttttgaacactgttgctgacttagacgacatcaagactgtcatcaaggctattgaagttgccatcatcagattatcccaagaagctgcttctattgtcaagaaggaatctttcgactatgtcggtgctgaattggttcaactctccaagttgaaggctcaccactacttgttgactgaatacatcagaagaattgacacctttgaccaaaaggagttggctccatacttgataaccctcggtaagttgtacgctgccactattgtcttggacagatttgctggtgtctttttgactttcaacgttgcctccaccgaagccatcactgctttggcctctgtgcaaattccaaagttgtgtgctgaagtcagaccaaacgttgttgcttacaccgactccttccaacaatccgacatgattgtcaattctgctattggtagatacgatggtgacatctatgagaactactttgacttggtcaagttgcagaacccaccatccaagaccaaggctccttactctgatgctttggaagccatgttgaacagaccaaccttggacgaaagagaaagatttcaaaagtctgatgaaaccgctgctatcttgtccaagtaagataag

SEQ ID NO: 5659 - protein, 709 aa, Candida tropicalis
MTFTKKNVSVSQGPDPRSSIQKERDSSKWNPQQMNYFLEGSVERSELMKALAQQMERDPILFTDGSYYDLTKDQQRELTAVKINRIARYREQESIDTFNKRLSLIGIFDPQVGTRIGVNLGLFLSCIRGNGTTSQLNYWANEKETADVKGIYGCFGMTELAHGSNVAGLETTATFDKESDEFVINTPHIGATKWWIGGAAHSATHCSVYARLIVDGQDYGVKTFVVPLRDSNHDLMPGVTVGDIGPKMGRDGIDNGWIQFSNVRIPRFFMLQKFCKVSAEGEVTLPPLEQLSYSALLGGRVMMVLDSYRMLARMSTIALRYAIGRRQFKGDNVDPNDPNALETQLIDYPLHQKRLFPYFVPPMSSPLVPSRLNTPSRPPWLNWTLPLKRTTPRLIFKSIDDMKSLFVDSGSLKSTATWLGAEAIDQCRQACGGHGHSSYNGFGKAYNDWVVQCTWEGDNNVLGMSVGKPIVKQVISIEDAGKTVRGSTAFLNQLKEYTGSNSSKVVLNTVADLDDIKTVIKAIEVAIIRLSQEAASIVKKESFDYVGAELVQLSKLKAHHYLLTEYIRRIDTFDQKELAPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFQKSDETAAILSK

SEQ ID NO: 5660 - DNA, 2845 bp, Candida tropicalis
  CDS (532)..(2661)
gagctccaattgtaatatttcgggagaaatatcgttggggtaaaacaacagagagagagagggagagatggttctggtagaattataatctggttgttgcaaatgctactgatcgactctggcaatgtctgtagctcgctagttgtatgcaacttaggtgttatgcatacacacggttattcggttgaattgtggagtaaaaattgtctgagttgtgtcttagctactggctggccccccgcgaaagataatcaaaattacacttgtgaatttttgcacacacaccgattaacatttcccttttttgtccaccgatacacgcttgcctcttcttttttttctctgtgcttccccctcctgtgactttttccaccattgatataaaatcaactccatttccctaaaatctccccagattctaaaaacaacttcttctcttctgcttttcctttttttttgttatatttatttaccatcccttttttttgaatagttattccccactaacattgttcaaatcttcacgacataatgacttttacaaagaaaaacgttagtgtatcacaaggtcctgaccctagatcatccatccaaaaggaaagagacagctccaaatggaaccctcaacaaatgaactacttcttggaaggctccgtcgaaagaagtgagttgatgaaggctttggcccaacaaatggaaagagacccaatcttgttcacagacggctcctactacgacttgaccaaggaccaacaaagagaattgaccgccgtcaagatcaacagaatcgccagatacagagaacaagaatccatcgacactttcaacaagagattgtccttgattggtatctttgacccacaggtcggtaccagaattggtgtcaacctcggtttgttcctttcttgtatcagaggtaacggtaccacttcccaattgaactactgggctaacgaaaaggaaaccgctgacgttaaaggtatctacggttgtttcggtatgaccgaattggcccacggttccaacgttgctggtttggaaaccaccgccacatttgacaaggaatctgacgagtttgtcatcaacaccccacacattggtgccaccaagtggtggattggtggtgctgctcactccgccacccactgttctgtctacgccagattgattgttgacggtcaagattacggtgtcaagacttttgttgtcccattgagagactccaaccacgacctcatgccaggtgtcactgttggtgacattggtgccaagatgggtagagatggtatcgataacggttggatccaattctccaacgtcagaatcccaagattctttatgttgcaaaagttctgtaaggtttctgctgaaggtgaagtcaccttgccacctttggaacaattgtcttactccgccttgttgggtggtagagtcatgatggttttggactcctacagaatgttggctagaatgtccaccattgccttgagatacgccattggtagaagacaattcaagggtgacaatgtcgatccaaaagatccaaacgctttggaaacccaattgatagattacccattgcaccaaaagagattgttcccatacttggctgctgcctacgtcatctccgctggtgccctcaaggttgaagacaccatccataacaccttggctgaattggacgctgccgttgaaaagaacgacaccaaggctatctttaagtctattgacgacatgaagtcattgtttgttgactctggttccttgaagtccactgccacttggttgggtgctgaagccattgaccaatgtagacaagcctgtggtggtcacggttactcgtcctacaacggcttcggtaaagcctacaacgattgggttgtccaatgtacttgggaaggtgacaacaatgtcttggccatgagtgttggtaagccaattgtcaagcaagttatcagcattgaagatgccggcaagaccgtcagaggttccaccgctttcttgaaccaattgaaggactacactggttccaacagctccaaggttgttttgaacactgttgctgacttggacgacatcaagactgtcatcaaggctattgaagttgccatcatcagattgtcccaagaagctgcttctattgtcaagaaggaatctttcgactatgtcggcgctgaattggttcaactctccaagttgaaggctcaccactacttgttgactgaatacatcagaagaattgacacctttgaccaaaaggacttggttccatacttgatcaccctcggtaagttgtacgctgccactattgtcttggacagatttgccggtgtcttcttgactttcaacgttgcctccaccgaagccatcactgctttggcctctgtgcaaattccaaagttgtgtgctgaagtcagaccaaacgttgttgcttacaccgactccttccaacaatccgacatgattgtcaattctgctattggtagatacgatggtgacatctatgagaactactttgacttggtcaagttgcagaacccaccatccaagaccaaggctccttactctgatgctttggaagccatgttgaacagaccaaccttggacgaaagagaaagatttgaaaagtctgatgaaaccgctgctatcttgtccaagtaagaatagaagagagtgactcttttgataagagtcgcaaatttgatttcataagtatatattcattatgtaaagtagtaaatggaaaattcattaaaaaaaaagcaaatttccgttgtatgcatactccgaacacaaaactagccccggaaaaacccttagttgatagttgcgaatttaggtcgac

SEQ ID NO: 5661 - protein, 709 aa, Candida tropicalis
MTFTKKNVSVSQGPDPRSSIQKERDSSKWNPQQMNYFLEGSVERSELMKALAQQMERDPILFTDGSYYDLTKDQQRELTAVKINRIARYREQESIDTFNKRLSLIGIFDPQVGTRIGVNLGLFLSCIRGNGTTSQLNYWANEKETADVKGIYGCFGMTELAHGSNVAGLETTATFDKESDEFVINTPHIGATKWWIGGAAHSATHCSVYARLIVDGQDYGVKTFVVPLRDSNHDLMPGVTVGDIGAKMGRDGIDNGWIQFSNVRIPRFFMLQKFCKVSAEGEVTLPPLEQLSYSALLGGRVMMVLDSYRMLARMSTIALRYAIGRRQFKGDNVDPKDPNALETQLIDYPLHQKRLFPYLAAAYVISAGALKVEDTIHNTLAELDAAVEKNDTKAIFKSIDDMKSLFVDSGSLKSTATWLGAEAIDQCRQACGGHGYSSYNGFGKAYNDWVVQCTWEGDNNVLAMSVGKPIVKQVISIEDAGKTVRGSTAFLNQLKDYTGSNSSKVVLNTVADLDDIKTVIKAIEVAIIRLSQEAASIVKKESFDYVGAELVQLSKLKAHHYLLTEYIRRIDTFDQKDLVPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFEKSDETAAILSK

SEQ ID NO: 5662 - DNA, 2624 bp, Candida tropicalis
  CDS (457)..(2445)
gaattcacatggctaatttggcctcggttccacaacgcactcagcattaaaaaaaaaatacgcaatggcagctcggtcgacgcagcagaagcgccgacgtaccgtcgcgttgccccgcccatgcctcgccgacccctccaccgccatcgtttgcccattgtttgtggtagtgcgccgtgacacaaaaacttgtcctgtcacatgctgaagttacaccaacataactactatgggattacgtaatcaaaaatttcacagttttaacaaaaaaaaaatcatacaatcaacattgggacatcttgccctcccccacaaaacttgcttctgcatcaatcatatataaacatcatgaaataagcctaaactcacttctttttttttcatccttcctacttcttctttcatagtaactactttttttttattaccacacttattcattcataccacgctatcatgcctaccgaacttcaaaaagaaagagaactcaccaagttcaacccaaaggagttgaactacttcttggaaggttcccaagaaagatccgagatcatcagcaacatggtcgaacaaatgcaaaaagaccctatcttgaaggtcgacgcttcatactacaacttgaccaaagaccaacaaagagaagtcaccgccaagaagattgccagactctccagatactttgagcacgagtacccagaccaacaggcccagagattgtcgatcctcggtgtctttgacccacaagtcttcaccagaatcggtgtcaacttgggtttgtttgtttcctgtgtccgtggtaacggtaccaactcccagttcttctactggaccataaataagggtatcgacaagttgagaggtatctatggttgttttggtatgactgagttggcccacggttccaacgtccaaggtattgaaaccaccgccacttttgacgaagacactgacgagtttgtcatcaacaccccacacattggtgccaccaagtggtggatcggtggtgctgcgcactccgccacccactgctccgtctacgccagattgaaggtcaaaggaaaggactacggtgtcaagacctttgttgtcccattgagagactccaaccacgacctcgagccaggtgtgactgttggtgacattggtgccaagatgggtagagacggtatcgataacggttggatccagttctccaacgtcagaatcccaagattctttatgttgcaaaagtactgtaaggtttcccgtctgggtgaagtcaccatgccaccatctgaacaattgtcttactcggctttgattggtggtagagtcaccatgatgatggactcctacagaatgaccagtagattcatcaccattgccttgagatacgccatccacagaagacaattcaagaagaaggacaccgataccattgaaaccaagttgattgactacccattgcatcaaaagagattgttcccattcttggctgccgcttacttgttctcccaaggtgccttgtacttagaacaaaccatgaacgcaaccaacgacaagttggacgaagctgtcagtgctggtgaaaaggaagccattgacgctgccattgtcgaatccaagaaattgttcgtcgcttccggttgtttgaagtccacctgtacctggttgactgctgaagccattgacgaagctcgtcaagcttgtggtggtcacggttactcgtcttacaacggtttcggtaaagcctactccgactgggttgtccaatgtacctgggaaggtgacaacaacatcttggccatgaacgttgccaagccaatggttagagacttgttgaaggagccagaacaaaagggattggttctctccagcgttgccgacttggacgacccagccaagttggttaaggctttcgaccacgccctttccggcttggccagagacattggtgctgttgctgaagacaagggtttcgacattaccggtccaagtttggttttggtttccaagttgaacgctcacagattcttgattgacggtttcttcaagcgtatcaccccagaatggtctgaagtcttgagacctttgggtttcttgtatgccgactggatcttgaccaactttggtgccaccttcttgcagtacggtatcattaccccagatgtcagcagaaagatttcctccgagcacttcccagccttgtgtgccaaggttagaccaaacgttgttggtttgactgatggtttcaacttgactgacatgatgaccaatgctgctattggtagatatgatggtaacgtctacgaacactacttcgaaactgtcaaggctttgaacccaccagaaaacaccaaggctccatactccaaggctttggaagacatgttgaaccgtccagaccttgaagtcagagaaagaggtgaaaagtccgaagaagctgctgaaatcttgtccagttaatagagcactaggttttgataatttggttcttacagtttatgtattttgattcttccttttttagatacttttttttatattttattattccttattgatgtaacgacagtcccactataattaacttaaactttgctgtaaatcagatgacaagtgtttccctgtttgcaggggagctc

SEQ ID NO: 5663 - protein, 662 aa, Candida tropicalis
MPTELQKERELTKFNPKELNYFLEGSQERSEIISNMVEQMQKDPILKVDASYYNLTKDQQREVTAKKIARLSRYFEHEYPDQQAQRLSILGVFDPQVFTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGVTVGDIGAKMGRDGIDNGWIQFSNVRIPRFFMLQKYCKVSRLGEVTMPPSEQLSYSALIGGRVTMMMDSYRMTSRFITIALRYAIHRRQFKKKDTDTIETKLIDYPLHQKRLFPFLAAAYLFSQGALYLEQTMNATNDKLDEAVSAGEKEAIDAAIVESKKLFVASGCLKSTCTWLTAEAIDEARQACGGHGYSSYNGFGKAYSDWVVQCTWEGDNNILAMNVAKPMVRDLLKEPEQKGLVLSSVADLDDPAKLVKAFDHALSGLARDIGAVAEDKGFDITGPSLVLVSKLNAHRFLIDGFFKRITPEWSEVLRPLGFLYADWILTNFGATFLQYGIITPDVSRKISSEHFPALCAKVRPNVVGLTDGFNLTDMMTNAAIGRYDGNVYEHYFETVKALNPPENTKAPYSKALEDMLNRPDLEVRERGEKSEEAAEILSS

SEQ ID NO: 5664 - DNA, 3741 bp, Rattus norvegicus (Norway rat)
  CDS (74)..(2059)
acacgggtcgttgctttggtgtctgtcacttctgtcgccacctcctctgccaacaccaacactgacctccgtcatgaaccccgacctgcgcaaggagcgggcctccgccaccttcaatccggagttgatcacgcacatcttggatggcagtccggagaatacccggcgccgtcgagaaattgagaacttgattctgaacgacccagacttccagcatgaggactataacttcctcactcgaagccagcgttatgaggtggctgttaagaagagtgccaccatggtgaagaagatgagggaatatggcatctcggaccctgaagaaatcatgtggtttaaaaaactatatttggccaattttgtggaacctgttggcctcaattactccatgtttattcctaccttgctgaatcagggcaccactgctcagcaggagaaatggatgcgcccgtcccaagaactccagataattggcacctacgcccagacggagatgggccacggaactcatcttcgaggcttggaaaccactgccacatatgaccccaagacccaagagttcattctcaacagccctactgtgacttccattaagtggtggcctgggggacttgggaaaacttccaatcacgcaatagttctggctcagctcatcactcaaggagagtgctacgggttacatgcctttgttgtccctatccgtgaaattgggacccacaagcccttgccaggcatcactgtcggggatatcggtcccaaatttggttatgaagagatggataacggctacctgaagatggacaattaccgtattcccagagagaacatgctgatgaaatacgcccaggtgaagcctgatggcacatatgtaaagcctttgagtaacaagctgacgtatgggaccatggtttttgtgaggtccttcctcgtgggaaatgcagctcagagtctgtccaaggcttgcacaatcgccatacgatacagcgctgtgaggcgccagtctgaaatcaagcaaagcgaaccagaaccacagattttggattttcaaacccagcagtataaactcttcccgctcctggccactgcctatgccttccacttcgtaggaaggtacatgaaggagacctaccttcgaattaatgagagcattggccaaggggacctgagtgaactgcctgagcttcacgccctcactgctgggctgaaggcttttactacttggacagccaatgctggcatcgaagaatgtcgaatggcctgcggcgggcacggctattctcacagcagtgggattccaaatatttacgtcacttttaccccggcctgcaccttcgagggagagaacactgttatgatgctgcagacagccaggttcttgatgaaaatctatgaccaggtgcggtcggggaagttggtgggtggtatggtgtcatacctgaatgacctgccgagtcagcggatccagccacagcaggtggcagtctggccaactatggtggacatcaacagcctggagggcctgacagaagcctacaagcttcgtgcagccagattggtagaaatcgctgcaaaaaaccttcagactcacgtgagtcacaggaagagcaaggaagtagcatggaacctaacctctgtcgaccttgttcgggcaagtgaggcgcattgccactacgtggtcgttaaggtcttctcagacaaactccccaagattcaagacaaagccgtccaagctgtgctgaggaacctgtgtctcttgtattctctctatgggatcagccagaaaggaggggactttcttgaggggagcatcatcacaggggctcagctgtcacaagtaaacgctcggatcctggagctgctcaccctgatccgccccaatgctgttgctctggtggatgcctttgactttaaggacatgacacttggctctgttcttggccgctatgatggaaatgtgtatgaaaacttgtttgagtgggccaagaaatccccactgaacaaaacagaggtccatgaatcttaccacaagcacttgaagcccctgcagtccaagctttgaagtttccctgggacacgtctgagctccacaagcagcagaaactctctcctctactcactaatccttgtgaaatcgtcatcaaatttgtgtagctacagagcaaatgatgggtttcttttcctccctataagtaaagagaaatgaacagactttagagattaaatgagaaattcggtgttgtaagtgcagtaatgcagacagagacgtaggaactcagaaagcttcagagctgtggtctgacttgcatttgtactgctgctaatctcagtaggccttgactctggagaattaacagagttttaactacaaatacttacttattttcacatttttactgctaatcactggatatatgttttttaaacaaaagtgttatatagagtggaattttccaggcattcgtgcctaccactttctgatctactgctaagagcaggagtttgggggccagaaactaatagaaaccttgatgtgggtgtgtggctgtcacacaggccgctgctgcctgccatgtgggtgtgtcacccctattaactgtcacattaacatagtcaacaagaggactccttcaacacccacccaccaagaaaccagagttcccgatgggcacaagcacccactccaggctcagccttcgtggtagtggcactactgtgcctttgaccccactttttgacacagttaagttacttgtcttacctccaggctttcagccattgcctggatttcagtcatggtggctgaccttccctttcttgcttgccttccttctcctgaaagagataaaagagatagtagtcagcctctcctcatagattaagtatatggagagccctcagctatggtattactgtattttggtgactttgttaagtaaatttcctgggacaatcctgatttgaaagattctgtattctgttgcacaagctattaaaatgctcagtggtcaccaaagtatttcacacacacacactcacaaatcactcaggtcaccttttacactagaaataacaggaaagccctggccacagccatctgctgagagtgttagttgagatgtttcgttgaagatggctgaagaaagtgcaggccctggggagtttctccttgctgagagccggctctgtggtgagcccctagcagccttacgaggcggtgaaacggccccttcagatgggagcagcctctacaatcattctgagcttaaaggtgaaatatgcaccttttgtcctataaatgtcctataaatgcttggggggaggggtaatgttttgttttttttttcttgaaacagagcccagaatggccttgaactctgatcctcacagcctggtaaatgctgggcctacaggtgtgcgccgacatgtctggctgatcggagctctttattcttaaaagcacagtagggagatgattgtaacattaagtctgtgtctgtggcattcgcattgtgagagcagttccttagaacagttctgagagcacagcatcaatgtagtgaaaacgatgtcgacgcctgacatgaaatcacaaccctccgggtcatcgacacaagccttaacctttctcctggaatgactggtaatcccttaagattgacagtacacagcatgtcaccttgttggggtttctattgacagtaattcatattctggaaaggaactaataaatataaatgaccg

SEQ ID NO: 5665 - protein, 661 aa, Rattus norvegicus (Norway rat)
MNPDLRKERASATFNPELITHILDGSPENTRRRREIENLILNDPDFQHEDYNFLTRSQRYEVAVKKSATMVKKMREYGISDPEEIMWFKKLYLANFVEPVGLNYSMFIPTLLNQGTTAQQEKWMRPSQELQIIGTYAQTEMGHGTHLRGLETTATYDPKTQEFILNSPTVTSIKWWPGGLGKTSNHAIVLAQLITQGECYGLHAFVVPIREIGTHKPLPGITVGDIGPKFGYEEMDNGYLKMDNYRIPRENMLMKYAQVKPDGTYVKPLSNKLTYGTMVFVRSFLVGNAAQSLSKACTIAIRYSAVRRQSEIKQSEPEPQILDFQTQQYKLFPLLATAYAFHFVGRYMKETYLRINESIGQGDLSELPELHALTAGLKAFTTWTANAGIEECRMACGGHGYSHSSGIPNIYVTFTPACTFEGENTVMMLQTARFLMKIYDQVRSGKLVGGMVSYLNDLPSQRIQPQQVAVWPTMVDINSLEGLTEAYKLRAARLVEIAAKNLQTHVSHRKSKEVAWNLTSVDLVRASEAHCHYVVVKVFSDKLPKIQDKAVQAVLRNLCLLYSLYGISQKGGDFLEGSIITGAQLSQVNARILELLTLIRPNAVALVDAFDFKDMTLGSVLGRYDGNVYENLFEWAKKSPLNKTEVHESYHKHLKPLQSKL

SEQ ID NO: 5666 - DNA, 1980 bp, Caenorhabditis elegans
  CDS (1)..(1980)
atgccgctgaataagttgattcaagatggagacaatcaagatttgactgatgaaagatttaaagcaacattcgatactgatgctcttgccgccgtgttccatggaggagaagatgcactgaaaagaattcgagaattgagagatgaagtaaccaagcggtggcatttatttgatgctcttccaggtgctcataggacaagagccgagagaatggaggatgtcagcaggaagctgaaaaacctcatggaatctgtgggcgagtttgctgatttcaccaataatctcgatatgttggttatcattcgagatgtaatgggcattgaaggatttccattggctcttcataacttgatgtttgtgccaactattcaaaatcaagccgacgatgagcaaactgagtggtggctgatggatgcacttcagggcaagatcattggaacttatgcccaaacggaactcggacacggaaccaatctcggagccatcgaaactacagccacttacgataagctaacggaagaatttatcattcatacgccaactacaacggccacaaaatggtggcctggaggtcttggaaccagttgtacacatgtcgtccttgttgcaaacttgattattgacaccaaaaactatgggcttcatccattcttcgtcccaattcgtgaccgtaattcctattctgtaatgtctggagtacgtgttggagatattggaactaaaatgggagtgaactgtgtcgataacggatttttggcctttgacaactaccgtattccaagacgcaatatgcttatgaagcacagtaaagtatcaaaagaagggctctacacggctccatctcatccaaaagtcggatatactacaatgttatatatgagatctgaaatgatttatcatcaagcatattatcttgcaatggcaatggctatttcaattcgatattcagctgttcgtagacaaggagagattaagccaggaacacaagaagttcaaattctcgattatcaaactcaacagtatcgtattttcccgggacttgctcgttgttttgcttttaacacggcagctgcaactgttcgtcaaatgactgaaaactgtattaaacaactttcacatggaaactctgatgttcttgctgatttgcatgctctttcctgtggactcaaggcagttgtaactcatcaagcatctcaatcaattgatcaagcaagacaagcatgtggtggacatggatattcggatgccagttatttaccgactttgtatacttgctcggttggtgcatgcacatatgaaggagaaaacatggtaatgctactgcagctgtccaagtacctaatgaaagcggcggcaaaagccgaaaagggagaagaaatggcaccattggttgcatatcttgtaaaaccggacattaccgagactaatgataagttcgcaaagatgctcagccacttcgagcacattgcacgtcatcgtgtaatgcatgcttatcgtcaaatgattgaagaagagaaacagggaatcgagagagattatgcttttgcaaatcattcagttgactggactaaggctgctcgtgctcatacaaagttgtttatcgcccgtggtttcgtgaaaagtgtgcaggaagttagtgatgaagcagttcatgatgtacttacaacacttgctgaactctatctctcttatgaacttattgaaatgtcggctgatttgacagctaatggatatctttccgaatcggatgtccaacaaattcgacatcaaatctacgattcaatgagaaaaactcgccgcaatgctgtttcaattgtcgactcatttgatatttgtgatcgagagcttcgttcagtactcggtcgccgtgatggacatgtatatgagaatctgtacaaatgggctcaaatgagcccactcaatgagagaaatcttcctcatgttgaaaagtatttgaagccaatgacaagcaaactttaa

SEQ ID NO: 5667 - protein, 659 aa, Caenorhabditis elegans [sequence omitted]

SEQ ID NO: 5668 - DNA, 2273 bp, Hordeum vulgare (barley)
  CDS (61)..(1992)
cggggggagcccgaccacctggccggggagagggccaccgcccacttcgacgtcgacgccatgaaggtcgcatgggcaggctcccaacacgccgtcgaggtcgcagaccgcatggccaggctcgtcgcatcagacccagtgttccgcaaggataccaggacgatgctctctaggaaggagctcttcaaggacacgctcaagaaggcggcgcacgcgtggaagcgcatcgtcgagctacgtctcacagaagaggaggcaaacttgctaaggctatacgtcgaccagcctggctatgtcgatctccattggggcatgttcgttcctgccataaaaggacaaggaactgaggagcaacagaagaagtggttaccgatggcgtacaagttccaaataattggttgctatgctcagactgaacttggccatggttcaaatgttcagggtcttgagacaactgccacatttgatccaagtaccgatgagtttgttatgcacagcccaactctagcctcatgcaagtggtggcctggtggcttgggcaaagcttccacttcattgcggttgtcatgctcgtctcataacggaaggaaaagactatggcatacatggtttcattgtgcagttgcgaagttagatgaccactctcctcttcctggcgttactctcggtgatattggtggaaagtttggcagtggggcgtataacagcatggataatggtgttctgcgcttcgaccatgtgcgcatcccaagggatcaaatgttgatgaggctttcccaagttacaagggagggaaagtatgtgcattcagatgtaccaaagcagctgctatacgggacaatggtttatgtccgtcagacaattgtcgcagatgcttccaaggctttgtcccgtgctgtttgcattgctgtaaggtatagtgctatccggaagcagtttggttcccaggctggtggccctgagactcaggtcatcaattacaagactcaacagcgcaggctcttccctttgctggcttcagcttatgcatacagatttgtgggccagtggctgaagtggctatacacggatgtcacacagaagctggaagctaaggattactcaacactgccagaggcttcatgcctgtactgctgggctcaagtctgtgacaacatctgccacactgacgcgattgaagagtgccgaaagctctgcggtggacatggttacctgaacagcagtgggctccctgaactgtttgcggtctatgttcctgcctgcacctatgaaggagcaatgcgttttgctgttgcaggttgcaaggtttttgatgaagaccgtctctcaggtggccactgggaaccaacctgtcggcaccgtagctcacatgggcaacatacagcacttgatgcaatgcaaaagcgctgtaaatacagccgaagactggtcaatcctgctgccgtaaaggaggtgtttgaagctagggccctgaggatggccgtgaactgtgcccagaacatcagcaaggcgccaagccaagaagaaggtttctctgagctctcacctgatttgctcgaggctgccgtggctcacgtccagctgatcattgtgaccaagtttatcgagaagatcgaggaggacatccctggccctggggtgaaggagcagcttcagaagctgtgcagcatctacgcgctccacctcctgcacaagcacctgggcgactccctgtcgacggggtgcgtcacggccaggcagggcgcgctggccaatgagcagctcggcaagctctacgcccaagtgcgtcctaacgcggtggcgctggtggacgcgtttgactacacggaccactacctggggtcggtgctggggcggtacgacggggacgtgtacccggcgctgtacgaggaggcgtggaaggaccccctgaacgagacggtggtgccggacggttaccaggagcacctccggccgctgctcaagcagcagctcaagctctcgaggctatgaatccttccttggtccctgaagtctgtcccccaatccatgttggacagcggatgtggagcgataattaataagagatcaaatcaaggggagaggtgattggttgttgttcactttgttggaaaggcaagagcgacaggcactgttgttggtagaagaataaaaggatttttactccctcctgggtaattaattagcatttggtggtattattactagaacagctgctgtggttgtgattcggttaatacatgtttagcaaatgtgtcgagatacttagtagt

SEQ ID NO: 5669 - protein, 643 aa, Hordeum vulgare (barley)
MKVAWAGSQHAVEVADRMARLVASDPVFRKDTRTMLSRKELFKDTLKKAAHAWKRIVELRLTEEEANLLRLYVDQPGYVDLHWGMFVPAIKGQGTEEQQKKWLPMAYKFQIIGCYAQTELGHGSNVQGLETTATFDPSTDEFVMHSPTLASCKWWPGGLGKASTSLRLSCSSHNGRKRLWHTWFHCAVAKLDDHSPLPGVTLGDIGGKFGSGAYNSMDNGVLRFDHVRIPRDQMLMRLSQVTREGKYVHSDVPKQLLYGTMVYVRQTIVADASKALSRAVCIAVRYSAIRKQFGSQAGGPETQVINYKTQQRRLFPLLASAYAYRFVGQWLKWLYTDVTQKLEAKDYSTLPEASCLYCWAQVCDNICHTDAIEECRKLCGGHGYLNSSGLPELFAVYVPACTYEGAMRFAVAGCKVFDEDRLSGGHWEPTCRHRSSHGQHTALDAMQKRCKYSRRLVNPAAVKEVFEARALRMAVNCAQNISKAPSQEEGFSELSPDLLEAAVAHVQLIIVTKFIEKIEEDIPGPGVKEQLQKLCSIYALHLLHKHLGDSLSTGCVTARQGALANEQLGKLYAQVRPNAVALVDAFDYTDHYLGSVLGRYDGDVYPALYEEAWKDPLNETVVPDGYQEHLRPLLKQQLKLSRL

SEQ ID NO: 5670 - DNA, 2324 bp, Cucurbita sp. (cucurbit)
  CDS (24)..(2096)
ctctactggtttgcgattgacggatggcatcaccgggagaaccaaatcggacggcggaggatgaatctcaagcagccgcccggcgaatcgaacggctgtctttacacctgactccgattccccttgatgattcgcagggggtggagatggaaacgtgcgcggcggggaaagcgaaggcgaaaatcgaagtggatatggggagtttatcactgtatatgagggggaaacacagggagattcaagagcgagtgtttgagtacttcaattcgaggcctgaattgcagacgccggtggggatctccatggccgatcatcgggagctctgtatgaagcaattggtaggtctggtcagggaagccggaattaggccgtttaggtttgttaatgaagatcctgctaagtatttcgctattatggaggctgttggaagtgtggatgtctctctcgccattaaaatgggcgtccagttcagtctatggggtggctctgtcatcaatttaggaaccaaaaagcacagagacagattctttgatggtattgacaatgtggattatcctggctgctttgctatgactgaacttcatcatggctcaaacgttcagggtctccaaacaacagctacattcgatccgatcacggacgaattcattatcaatacaccaaatgacggagccatcaaatggtggattggcaatgctgcagttcacggcaagtttgccacggttttcgctaagctcgtgttgccaactcatgattctagaaagactgctgatatgggcgtccatgctttcattgttccaataagagatctcaagtctcataaaacacttccaggaattgaaatccatgattgtggccacaaggtaggcctcaatggtgtcgataatggagcgttgagattccgttcagtgagaattccacgagataatctcctcaatcgatttggagaggtatcccgggacgggaagtataagagtagtctaccatctatcaataaaagatttgcagcaacattaggagaacttgtaggtggaagagttgggctagcatattcttcagctagtgttcttaagattgcttccacaattgctattcgttattcgctgttgcgccagcagtttggcccaccaaagcagcctgaagtcagtattttggattaccagtctcagcagcacaagcttatgccaatgctggcttcaacttacgccttccatttctctactatgcaacttgtggaaaagtatgcacagatgaagaagactcatgatgaagaactagttggagatgtgcacgcgttatcggcaggcctcaaggcttacgttacttcttacacggcgaaatccttgagtacctgcagggaagcctgtggcggccatggatacgctgtcgtcaatcgcttcggtactcttaggaacgatcacgacattttccagacttttgaaggagacaatactgttcttctacaacaggttgcagcctacctcttgaagcaataccaggagaaatttcaaggtgggacacttgcagttacatggaactacctgcgagagtcgatgaatacatatctgtctcaaccgaatcccgtcacggcacggtgggaaagtgcagaccatctccgagatcctaagtttcagttagatgccttccaatatcgaacgtctcgattacttcaaagtgtagctgttcgtctccggaaacatactaaaaaccttggaagctttggtgcatggaatagatgcctgaatcacctcttgactcttgcagaatcccacattgaatctgtaatcctcgctcagtttatcgaatctgtacaaagatgtcccaatgcaaatacacaggctactctgaaactcgtatgcgacctttacgccttggatcgaatctggaatgacatcggaacataccgaaatgtcgactacgtagctcccaacaaagcaaaggctatccacaagctcactgaatatctatgttttcaagtgagaaacatcgcacaagaactggtcgatgcattcgatcttccagatcatgtaactcgggcacccatcgcaatgaagtcgaatgcttactcccagtacacgcagtacatcggattctgatagccaaccagtacaaaattgcattcaaacttggaccactggtgagtggttagctaccaaaacctcatatcagtattgtgatcactgataaaaactattggctgtgtcaattctataccaattgtcatgttgtctttgttcttttcttctctatgtattggaaaagatcgagacaactaaattgtcaataataagttatatggatgtttacaggaagaaaaaaaaaaa

SEQ ID NO: 5671 - protein, 690 aa, Cucurbita sp. (cucurbit)
MASPGEPNRTAEDESQAAARRIERLSLHLTPIPLDDSQGVEMETCAAGKAKAKIEVDMGSLSLYMRGKHREIQERVFEYFNSRPELQTPVGISMADHRELCMKQLVGLVREAGIRPFRFVNEDPAKYFAIMEAVGSVDVSLAIKMGVQFSLWGGSVINLGTKKHRDRFFDGIDNVDYPGCFAMTELHHGSNVQGLQTTATFDPITDEFIINTPNDGAIKWWIGNAAVHGKFATVFAKLVLPTHDSRKTADMGVHAFIVPIRDLKSHKTLPGIEIHDCGHKVGLNGVDNGALRFRSVRIPRDNLLNRFGEVSRDGKYKSSLPSINKRFAATLGELVGGRVGLAYSSASVLKIASTIAIRYSLLRQQFGPPKQPEVSILDYQSQQHKLMPMLASTYAFHFSTMQLVEKYAQMKKTHDEELVGDVHALSAGLKAYVTSYTAKSLSTCREACGGHGYAVVNRFGTLRNDHDIFQTFEGDNTVLLQQVAAYLLKQYQEKFQGGTLAVTWNYLRESMNTYLSQPNPVTARWESADHLRDPKFQLDAFQYRTSRLLQSVAVRLRKHTKNLGSFGAWNRCLNHLLTLAESHIESVILAQFIESVQRCPNANTQATLKLVCDLYALDRIWNDIGTYRNVDYVAPNKAKAIHKLTEYLCFQVRNIAQELVDAFDLPDHVTRAPIAMKSNAYSQYTQYIGF

SEQ ID NO: 5672 - DNA, 2040 bp, Caenorhabditis elegans
  CDS (1)..(2040)
atggcgaaccgatcaattcgtgatggagataaccccgaattgctggaagaacggaggatggcaacttttgatacggataagatggcagcggtgatctatggaagtgaagagttcgctcgtcgccgtcgtgagatcaccgacgccgtgtccaagatccctgagctcgccgacatcaagccctatccatttttgactcgagaggagaaggtgaccgagggcaccagaaaaatatcgattttgacaaaatatctgaatcagctgattgatagagataatgaagaagaaagtttgcacctgcatcgagaagtgattggctacgagggtcatcccttcgctctccatgacgctttgtttattccaacccttcagtcacaggctagtgatgaacagcaggagaaatggctcgagagagctcggcgacgagagatcattggatgttatgcgcaaactgagctcggtcacggctcaaatcttaggaatcttgaaacaactgcagtctatgacattgcttcccaggagtttgtactacatactcctacgacaacggcgttgaagtggtggcctggagcacttgggaagagctgtaactatgcattggttgtagctgaactgattataaagagaaataactatggcccccacttttttatggtgcagctgagagatgaaaaaacccatattccactaaaaggcgttaccgtaggagatatcgggcctaaaatgaacttcaatgcggcggataatgggtaccttgggttgaacaacttgagagttccacgaacaaatcttttgatgagacattgcaaagtagaggcggatgggacgtatgtgaagccaccgcatgcaaagatcgggtactctggaatggtgaagatcagaagtcagatggctatggagcaggggttgtttttagcacatgcattgacaattgcagcgaggtattcggcagtgaggaggcaaggacatttggatgataagcaagtcgaagtaaaagtccttgactaccagacccagcagcatcgtctattcccatcattagcccgtgcgtatgcatttatattcactggatttgagacaattcacttatattctcaattattaaaagatgttgatatgggtaatacatctggaatggctgatttacatgcattgacttctggtttaaaatcagttgttgctcatgaaactggagaaggtattgaacaggcgaggatggcttgtggtggacatggatactctatggtaggttttgaaaatcaagtaaaaaagaaaaagcattttatggagttgtttcaggctagttatatatctgtcgtatatgggattgctattggcggatgcacttatgaaggggagaacatggtgatgctcctgcaacttgcacggtatttagtgaaatccgtggaacttatcaaggccggtaaagctaagaaattaggaccagtggcatcatatctagcagacaagagtgatgaaactgatctaaccagcctgaatggatatgtaaagatgttcgagaacatggctagaaggcaggcttggaaagcaacagagaaattcttgaaattgatggaaagtggggaatcaagagaagtggcatggaataaatcagcagtggagttgactagagctagccgtctacacacccgtctattcataatcgaagcttttatgagaagagtgtctcgaattgaagatattccagtgaaagaggttctaacagatcttctccatcttcatgtcaactatgaactattggatgttgccacgtatgcactggaattcatgtcattcactcagttggattatgttagagatcaactatatttgtatctggagaagattcgaccaaatgcagtatctctagttgactcttttcagattagtgatatgcaattgagatctgtccttggccgccgggatggtcacgtctacgagaatctcttcaaatgggcaaagtcaagtcccttgaacaacgcagatgttctaccgtcagtcgagaagtacttaaagcctatgatggaaaaggcgaagctttaa

SEQ ID NO: 5673 - protein, 679 aa, Caenorhabditis elegans
MANRSIRDGDNPELLEERRMATFDTDKMAAVIYGSEEFARRRREITDAVSKIPELADIKPYPFLTREEKVTEGTRKISILTKYLNQLIDRDNEEESLHLHREVIGYEGHPFALHDALFIPTLQSQASDEQQEKWLERARRREIIGCYAQTELGHGSNLRNLETTAVYDIASQEFVLHTPTTTALKWWPGALGKSCNYALVVAELIIKRNNYGPHFFMVQLRDEKTHIPLKGVTVGDIGPKMNFNAADNGYLGLNNLRVPRTNLLMRHCKVEADGTYVKPPHAKIGYSGMVKIRSQMAMEQGLFLAHALTIAARYSAVRRQGHLDDKQVEVKVLDYQTQQHRLFPSLARAYAFIFTGFETIHLYSQLLKDVDMGNTSGMADLHALTSGLKSVVAHETGEGIEQARMACGGHGYSMVGFENQVKKKKHFMELFQASYISVVYGIAIGGCTYEGENMVMLLQLARYLVKSVELIKAGKAKKLGPVASYLADKSDETDLTSLNGYVKMFENMARRQAWKATEKFLKLMESGESREVAWNKSAVELTRASRLHTRLFIIEAFMRRVSRIEDIPVKEVLTDLLHLHVNYELLDVATYALEFMSFTQLDYVRDQLYLYLEKIRPNAVSLVDSFQISDMQLRSVLGRRDGHVYENLFKWAKSSPLNNADVLPSVEKYLKPMMEKAKL

SEQ ID NO: 5674 - DNA, 1983 bp, Caenorhabditis elegans
  CDS (1)..(1983)
atgagctcaatttgcaaaggagataactcagatctcacagaagaacgaaagaatgcgacttttgatacggataagatggctgccgtgatatatggacgtgaagagattgctagtcgccgtcgacaactcactgaatccatctcccggatccatgagcttgcagaatccaaacccctagttttcatgacacgagaggaaaaaatcgctgagtcctgtagaaagctggaggttttgagtcgacactggaatcagaccccgttcaacagagacaacgaagaagatgcactgcacatctacagagaggtattggggatggagggacatccgttggcgcttcacgatacaatgttcataccgactttggttgcacaggcgagccaagagcagcaggagaagtggttggggagagctagaaggaaggagattattggatgttatgcacagaccgagatgggtcatggtaccaatctccgaaaacttgaaaccacagccacctactccccggacacccaggaattcatcctgaacaccccaaccatcacagctctcaaatggtggcccggagcactcgggaagagttccaacaacgctatagtagttgctaatttgcttatcaaagaccaaaactatggaccacatcctttcatggttcaactgagagatgagaagactcatattccactaaaaggaatcgtagttggagatattggcccgaaaatggcattcaatggagcggataatggatatcttggcttcaataaccaccgaattccaagaacaaatcttttgatgagacataccaaagtagaagcaaatgggacttatataaaaccttctcatgcaaagattgggtactcgagtatggtaaaagtgagaagtcgaatggcaatggatcagggattgttcttagcatcggctttggtaatagctgtgagatactcggcagtgaggagacaaggtttcttggaagacaaaacccaaaaagtaaaagtccttgactaccagacccagcagcatcgtctattcccatcattagcccgtgcctatgcatttatatttactggatttgagacaattcacttatattctcaattattaaaagatgttgatatgggtaatacatctggaatggctgatttacatgcattgacttctggtttaaaatctgttgttactcatcaaactggagaaggtatcgaacaagcgaggatggcttgtggtgaacatggatattctatggctagttatatctctgaaatctatggagttgcaattggaggatgtacttatgaaggggaaaatatggtaatgcttctgcaacttgcacggtatttagtgaagtccgtggaacttatcaaatccggagaagaaaagaagctaggaccaatggtgtcatatctagcagctaaaggtggccaccctgatctatcaagtctgaatggatatgtaacagctttcgagcatatggctagaaggcaggcttggaaagcaacagagaaattcttgaaattgatggaaactggagaatcaagagaagtggcgtggaataaatcagcagtggagttgactagagctagtcgtctacacacccgtctattcataatcgaagctttcatgagaagagtgtctcgaattgaagatattccagtgaaagaggttctaacagatcttctccatcttcatgtcaactatgaactattggatgttgccacgtatgcactggaattcatgtcatccactcagttggattatatcagagatcaactatatttatatctggagaagattcgaccaagtgcagtatctctagttgactctttccagattagtgatatgcaattgagatctgttcttggccgccgggatggtaatgtctacgagaatctcttcaagtgggcaaagtcgagtcccttgaacaaatctgatgttctaccgtcagtcgataagtacttgaagcctatgatggaaaaggcgaagctttga

SEQ ID NO: 5675 - protein, 660 aa, Caenorhabditis elegans
MSSICKGDNSDLTEERKNATFDTDKMAAVIYGREEIASRRRQLTESISRIHELAESKPLVFMTREEKIAESCRKLEVLSRHWNQTPFNRDNEEDALHIYREVLGMEGHPLALHDTMFIPTLVAQASQEQQEKWLGRARRKEIIGCYAQTEMGHGTNLRKLETTATYSPDTQEFILNTPTITALKWWPGALGKSSNNAIVVANLLIKDQNYGPHPFMVQLRDEKTHIPLKGIVVGDIGPKMAFNGADNGYLGFNNHRIPRTNLLMRHTKVEANGTYIKPSHAKIGYSSMVKVRSRMAMDQGLFLASALVIAVRYSAVRRQGFLEDKTQKVKVLDYQTQQHRLFPSLARAYAFIFTGFETIHLYSQLLKDVDMGNTSGMADLHALTSGLKSVVTHQTGEGIEQARMACGEHGYSMASYISEIYGVAIGGCTYEGENMVMLLQLARYLVKSVELIKSGEEKKLGPMVSYLAAKGGHPDLSSLNGYVTAFEHMARRQAWKATEKFLKLMETGESREVAWNKSAVELTRASRLHTRLFIIEAFMRRVSRIEDIPVKEVLTDLLHLHVNYELLDVATYALEFMSSTQLDYIRDQLYLYLEKIRPSAVSLVDSFQISDMQLRSVLGRRDGNVYENLFKWAKSSPLNKSDVLPSVDKYLKPMMEKAKL

SEQ ID NO: 5676 - DNA, 1989 bp, Caenorhabditis elegans
  CDS (1)..(1989)
atgcatttaaacacatcaatttgcgaagttgataacccggatctcaccgaggaacgggagaagggaacttttgatacggataagatggcggctgtgatctatggaagtgagaagctcgcccgccggcgtcgagaaatctcagaagctgtctcaaaaattccggagctagcggatacccaaccctttccgttcatggaccgacttgaaaaaattacagaaggatcccgtaaactagaggtgctcaataacaacatccgtgatataattgactacgatgataacggcgagagacttcatatctatcaagaggttacggggatggaaggacacccattggctttgcatgaggtcatgtttattcctgcattagtgtcacaggctagcaaagagcagcaggaaaaatggttggggagagctagaaggagggagattattggatgttatgcacagaccgaaatgggtcacggtaccaacctccggaaactggaaaccactgccacctacttcccagacacccaggaatttgtacttaacaccccaacgactacagctctcaagtggtggcccggagctctcgggaaaagttccaactatgcagttgtggtagttgatatgattatcaagggaaaaagctatggaccgcaccccttcatggttcaacttcgagatgagaagactcatattccactaaaaggaatcgtagttggagatattggcccgaaaatgtcatttaatggaggtgacaatgggttccttggattcgataaattccgagtgccccggacgaaccttctgatgcggcatgttagggtggaagctgatggaacatatgttaagcctccacatgcaaaggtgaatcactctgcaatggttcatgtgagaagtcatatggcaacaggacaaggggcactactggcacaggctttgattattgcagtgagatattcggcagtaagaagacaagggtttttggagaataaaacccaagaagtaaaagtccttgactaccagacccagcagcatcgtctattcccatcattagcccgtgcctatgcatttatatttactggatttgagacaattcacttatattctcaattattaaaagatgttgatatgggtaatacatctggaatggctgatttacatgcattgacttctggtttaaaatctgttgttactcatcaaactggagaaggtattgaacaggcgaggatggcttgtggtggacatggatactctatggctagttatatctctgaaatctatggaattgcaattggaggatgcacatacgaaggagaaaatatggtgatgctcctgcaacttgcacggtatcttgtcaaatctgtagaacttatcaaatccggagaagcaaagaagctaggaccaatggtgtcatatctagcagctaaaggtggccaccctgatctatcaagtctgaatggatatgtaacagctttcgagcatatggctagaaggcaagcttggaaggcaactgagaaattcttgaaattgatggaaagtggggaatcgagagaaatagcatggaacaaatcaacagtggagttgactagagccagtcgtctacacacccgtctattcataatcgaagctttcatgagaagagtgtctcgaattgaagatattccagtgaaagaggttctaacagatcttctccatcttcatgtcaactatgaactattggatgttgccacgtatgcactggaattcatgtcatccactcagttggattatatcagagatcaactatatttatatctggagaagattcgaccaagtgcagtatctctagttgactctttccagattagtgatatgcaattgagatctgttcttggccgccgggatggtaatgtctacgagaatctcttcaagtgggcaaagtcgagtcccttgaacaaatctgatgttctaccgtcagtcgataagtacttgatgcctatgatggaaaaggcgaaactttaa

SEQ ID NO: 5677 - protein, 662 aa, Caenorhabditis elegans
MHLNTSICEVDNPDLTEEREKGTFDTDKMAAVIYGSEKLARRRREISEAVSKIPELADTQPFPFMDRLEKITEGSRKLEVLNNNIRDIIDYDDNGERLHIYQEVTGMEGHPLALHEVMFIPALVSQASKEQQEKWLGRARRREIIGCYAQTEMGHGTNLRKLETTATYFPDTQEFVLNTPTTTALKWWPGALGKSSNYAVVVVDMIIKGKSYGPHPFMVQLRDEKTHIPLKGIVVGDIGPKMSFNGGDNGFLGFDKFRVPRTNLLMRHVRVEADGTYVKPPHAKVNHSAMVHVRSHMATGQGALLAQALIIAVRYSAVRRQGFLENKTQEVKVLDYQTQQHRLFPSLARAYAFIFTGFETIHLYSQLLKDVDMGNTSGMADLHALTSGLKSVVTHQTGEGIEQARMACGGHGYSMASYISEIYGIAIGGCTYEGENMVMLLQLARYLVKSVELIKSGEAKKLGPMVSYLAAKGGHPDLSSLNGYVTAFEHMARRQAWKATEKFLKLMESGESREIAWNKSTVELTRASRLHTRLFIIEAFMRRVSRIEDIPVKEVLTDLLHLHVNYELLDVATYALEFMSSTQLDYIRDQLYLYLEKIRPSAVSLVDSFQISDMQLRSVLGRRDGNVYENLFKWAKSSPLNKSDVLPSVDKYLMPMMEKAKL

SEQ ID NO: 5678 - DNA, 2025 bp, Caenorhabditis elegans
  CDS (1)..(2025)
atggtgcatctcaacaaaacaattcaggagggtgataacccggatctcactgccgaacgcttgacggcaacatttgatactcatgcgatggctgcacagatttatgggggagaaatgcgcgcccgtcgtcgtcgtgagatcaccgcgaagcttgcagaaatcccagagctccatgactcgatgccacttccgtatatgacaagagaggagaaaattatggaaagtgctaggaaactgacggttttgacacaaagaatgtcagagatcattgatccaactgatgcaggcgagttgtatcatttgaacaacgaagttctcggaatcgaaggaaatcctatggctcttcacggtgtgatgttcattccagccctcaacgctcaagctagtgatgagcagcaagccaagtggctcattcgagcgctccgacgagaaatcatcggaacctacgcccaaactgaaatgggtcatggcacaaatcttcaaaatctggaaacaactgctacttatgacattggaactcaggagtttgtgcttcacactccaaagatcaccgcattgaagtggtggccagggaatcttggaaaaagcagcaactatgcagttgtagttgcacatatgtatataaagggaaagaactttggaccacataccttcatggttccattgagagacgagaaaactcacaaaccacttccagggattacaattggagatattggaccaaaaatggcttataatattgtagacaatggattcctaggcttcaacaactaccgtatcccaagaacgaatcttttgatgagacataccaaagtagaggctgacgggacttatatcaaaccaccacatgcaaagatcaattactctgcaatggtacatgtgagaagttatatgcttactggacaggcgattatgttgtcgtatgcgttgaatattgcaacaagatactcggcagtgagaagacaggggcagattgataaaaatgaaccagaggtaaaagtgctcgagtaccaaacccagcagcaccgtctcttcccattcatcgcccgtgcctacgctttccagtttgctggtgccgagaccgtgaagctttacgaacgagtactcaaggagatgaaatctggaaatgtgtctcttatggctgacttacatgcattgacttctggtttaaaatcagttgttactcatcaaactggagaaggtatcgaacaagcgagaatggcttgtggtgggcatggatattctatggctagttacatctctgaaatctacggagttgcaattggaggatgcacgtatgaaggagaaaatatggttatgcttcttcaactcgctcgttacctcgtcaaatccgctgcccttgtgaagtccggaaaagcttctcagcttggaccactggtagcctacttgggcgccagaagtgagccaactagcctgatagatagagttccaaatggtggaatcacggaatacatcaagacattccaacatatcgcaaagagacagacgttgaaggctgccaacaagttcttcggattaatggagaatggagaaaagagagaaatcgcctggaacaagtcatccgtggagttgaatagggcgagtcgcctccacacccgcctcttcatcgtcgaagcctttgccagacgagtcaacgaaatcggagatatcaccatcaaagaggctctcagcgatctcctccatcttcacgtcaactatgaacttttggatgttgccacgtatgcactggaagatggattcatgtcatccactcagttggattatgtcagagatcaattgtacttctatctccagaaaattcgaccaaacgcagtttcattgctagattcctgggagtttagtgatagagagctgagatctgtcctaggccgccgtgatggtcatgtctacgagaaccttttcaagtgggcaaaggaaagtccgttgaacaagacagatgttcttccgtcagtggatacatatttgaagccaatgatggaaaaagccaggcagagcaagctataa

SEQ ID NO: 5679 - protein, 674 aa, Caenorhabditis elegans
MVHLNKTIQEGDNPDLTAERLTATFDTHAMAAQIYGGEMRARRRREITAKLAEIPELHDSMPLPYMTREEKIMESARKLTVLTQRMSEIIDPTDAGELYHLNNEVLGIEGNPMALHGVMFIPALNAQASDEQQAKWLIRALRREIIGTYAQTEMGHGTNLQNLETTATYDIGTQEFVLHTPKITALKWWPGNLGKSSNYAVVVAHMYIKGKNFGPHTFMVPLRDEKTHKPLPGITIGDIGPKMAYNIVDNGFLGFNNYRIPRTNLLMRHTKVEADGTYIKPPHAKINYSAMVHVRSYMLTGQAIMLSYALNIATRYSAVRRQGQIDKNEPEVKVLEYQTQQHRLFPFIARAYAFQFAGAETVKLYERVLKEMKSGNVSLMADLHALTSGLKSVVTHQTGEGIEQARMACGGHGYSMASYISEIYGVAIGGCTYEGENMVMLLQLARYLVKSAALVKSGKASQLGPLVAYLGARSEPTSLIDRVPNGGITEYIKTFQHIAKRQTLKAANKFFGLMENGEKREIAWNKSSVELNRASRLHTRLFIVEAFARRVNEIGDITIKEALSDLLHLHVNYELLDVATYALEDGFMSSTQLDYVRDQLYFYLQKIRPNAVSLLDSWEFSDRELRSVLGRRDGHVYENLFKWAKESPLNKTDVLPSVDTYLKPMMEKARQSKL

SEQ ID NO: 5680 - DNA, 1806 bp, Caenorhabditis elegans
  CDS (1)..(1806)
atgaaccgttacatttgtgaaggtgataaccccgatattaccgaagagaggaaaaaagcttcgttcaatgttgataagctaactgaatactactatggaggggagaaaagattgaaggctcgccgagaagtagaaaaatgcgttgaagatcacaaagagttacaggacttaaagccaacaccatttatgagtcgagatgaactaattgataactccgttcgaaaactggctgggatggccaaaaattataaaatgattgatttaaccaacattgagaaaacgacatattttttgcagctggtgcacgttagagactccatggcgttttcccttcattatctcatgtttttgcctgttcttcaatctcaggcatcgcctgaacaacttgctgagtggatgcctagagctctttctggaaccataattggaacgtatgctcaaacggagatgggtcatggcaccaatttatcaaaacttgaaaccacagccacatatggtcaaaaaacttcggaatttgtgcttcacacaccgactatcagtggcgccaagtggtggcccggtagccttggaaagttttgcaattttgcaatcattgttgccaatctatggactaatggagtttgcgttggacctcatccgtttttggtgcagataagagacctcaaaacacataaaactctaccgaatatcaagttaggagatattggaccaaaactggggtcgaatggttcagataatggatatcttgtgttcacaaactacagaatatctagggggaatatgctaatgagacattccaaagtacatcccgatggtacctaccaaaaaccaccacactcgaagttggcatatggtggtatggtgttcgtccgatcaatgatggttagggatattgccaattatttagcaaacgcggttactattgcaacaagatattctaccgtgcgacggcagggtgaaccgcttcccggcgcgggagaggtcaaaattttggactaccaaactcagcaatatagaattcttccgtatattgcaaaaacgattgcgtttagaatggctggagaagaacttcagcaagctttccttaatatttcgaaagaccttcggcagggaaacgcgtctttgctacccgatttgcattcactttctagtggtttgaaggctgtggtcacatttgaagtccaacaaggaattgagcagtgtcgactagcatgcggtggccacggttattctcacgctagtggtattccagagctgtccgcgttttcttgtggcagctgtacttatgaaggagacaacatagtgttgctattgcaagtggcaaacgaatgcgaactctacccagaacatgaagcttggaatcgttgctctatcgagctatgcaaggctgcaaggtggcacgtccgactttatatagtacggaattttcttcaaaaagtttgcacagctccaaaggatctgcaaccagttcttcgagcgctttcaaatctgtatatatttgatcttcaagtatctaataaaggtcattttatggaaaacggatatatgacatctcaacagatagaccaactcaaaatgggtattaacgagtcactttccacgattcgtccggatgctgtttccattgtggacggttttgctatacacgaatttgaactcaaaagtgttctcggtcgacgagatggaaatgtttatcctggactatttgaatggacaaaacatagtcagttaaacaacaaagaggttcaccctgcatttgataaatacttaacacccatcatggataagattagggccaaaatgtag

SEQ ID NO: 5681 - protein, 601 aa, Caenorhabditis elegans
MNRYICEGDNPDITEERKKASFNVDKLTEYYYGGEKRLKARREVEKCVEDHKELQDLKPTPFMSRDELIDNSVRKLAGMAKNYKMIDLTNIEKTTYFLQLVHVRDSMAFSLHYLMFLPVLQSQASPEQLAEWMPRALSGTIIGTYAQTEMGHGTNLSKLETTATYGQKTSEFVLHTPTISGAKWWPGSLGKFCNFAIIVANLWTNGVCVGPHPFLVQIRDLKTHKTLPNIKLGDIGPKLGSNGSDNGYLVFTNYRISRGNMLMRHSKVHPDGTYQKPPHSKLAYGGMVFVRSMMVRDIANYLANAVTIATRYSTVRRQGEPLPGAGEVKILDYQTQQYRILPYIAKTIAFRMAGEELQQAFLNISKDLRQGNASLLPDLHSLSSGLKAVVTFEVQQGIEQCRLACGGHGYSHASGIPELSAFSCGSCTYEGDNIVLLLQVANECELYPEHEAWNRCSIELCKAARWHVRLYIVRNFLQKVCTAPKDLQPVLRALSNLYIFDLQVSNKGHFMENGYMTSQQIDQLKMGINESLSTIRPDAVSIVDGFAIHEFELKSVLGRRDGNVYPGLFEWTKHSQLNNKEVHPAFDKYLTPIMDKIRAKM

SEQ ID NO: 5682 - DNA, 2004 bp, Caenorhabditis elegans
  CDS (1)..(2004)
atgagtcgatggattcagccaggcgataatgtagacattaccaatgaacggaaaaaagctacgtttgacacagaacgtatgtcagcttggatacatggagggactgaagttatgaagcgtcgccgtgaaattctggattttgtcaaaagcgttgacgacttcaaagatccggttccaacagagtttatgtctcgcgaagaacgcattctgaacaatgctcgtaaagttgtggcaatgacaaataacaccgatcagattgatggatctgacttcttcggagaaggaatgtattatcaagcattgacgatgggccgtgatcttcatgcaatgtcgcttcattacgttatgtttattccaacacttcaaggtcaaactgacgatgatcaactggacgagtggcttaccaaaacaatttcccgtgcagtagttggaacttatgctcaaacagaactcggtcatggtacaaacctttcaaaactggaaaccactgcaacttatgatccagccacagaagagtttgttatgaactcgccaacaatcactgcagccaaatggtggccgggaggcttgggtaaatcgtcgaactacgctgtggttgttgcacagttgtacacaaaaggagagtgtaaaggacctcatccgttcattgtgcaacttcgcgatgaagacactcactatccactcaagggaattcgtttgggagatattggaccaaaacttggcatcaatggaaatgacaatggattcttacttttcgataaagtcagaattccaagaaaagcattgctgatgagatacgcaaaagtgaatccagatggaacttacattgctccggctcattccaaattgggatatggaactatggtgtttgtgagatcaattatgatcaaggatcagtcgactcaacttgcggcagctgcaacaattgctacgagatatgcagcagtgagaagacagggagaaatcactccaggaaaaggggaagttcaaatcattgactaccaaacccaacaatttcgtgtcttccctcaactcgccagagcgtttgctttcatggcagcggccactgaaatccgtgatctctacatgacagtcaccgagcagcttacacatggaaacaccgaacttctcgccgagcttcatgtcttgtcttccggtctcaagtcgttagtgtcgtgggatactgctcaaggaattgagcaatgcagattggcgtgtggaggtcatgggtattcacaagcttctggattcccagaaatctatggatatgctgttggtggatgcacttacgagggtgaaaatattgtgatgcttctgcaagtagcaagattcctgatgaaagcagccgaaggagttagaaaaggaactgctaacctagcagacatcggagcttacattggaaagcctggaaggaaaacctcgcgcttaacaactcaccaccactacacagatgctgatatcgttgaagatcttgagcacgttgctcgcaaacaagtattccgagcctacgaccgcctgaaaaaggctcaggagcatcttcgtccggaagatgcttggaactcggtttctgtggaacttgctaaagcttcgagatggcacgttcgtctgtatctcgtgaagaacttattgcacaaagtttctattgctcctcaggatttgaagattgtgctcttcgatgttgctcggctgtatgcttatgacatcattacatcatcaattggagcatttttggaggatggctacatgagctctaatcagatgaatgaagttaaagaaggtatttataaatgcttgtccaatatgcgtccaaatgcggttggcctagttgactgttgggattatgacgataaagagctcaaatcagttttgggaagacgtgacggaaacgtgtaccctgctcttctccagtgggctcaaaatagtcaactcaacagatcggaagttcttccggcctacgaaaagtatcttggtccaatgatgaaagacgctcgatcaaaattgtaa

SEQ ID NO: 5683 - protein, 667 aa, Caenorhabditis elegans
MSRWIQPGDNVDITNERKKATFDTERMSAWIHGGTEVMKRRREILDFVKSVDDFKDPVPTEFMSREERILNNARKVVAMTNNTDQIDGSDFFGEGMYYQALTMGRDLHAMSLHYVMFIPTLQGQTDDDQLDEWLTKTISRAVVGTYAQTELGHGTNLSKLETTATYDPATEEFVMNSPTITAAKWWPGGLGKSSNYAVVVAQLYTKGECKGPHPFIVQLRDEDTHYPLKGIRLGDIGPKLGINGNDNGFLLFDKVRIPRKALLMRYAKVNPDGTYIAPAHSKLGYGTMVFVRSIMIKDQSTQLAAAATIATRYAAVRRQGEITPGKGEVQIIDYQTQQFRVFPQLARAFAFMAAATEIRDLYMTVTEQLTHGNTELLAELHVLSSGLKSLVSWDTAQGIEQCRLACGGHGYSQASGFPEIYGYAVGGCTYEGENIVMLLQVARFLMKAAEGVRKGTANLADIGAYIGKPGRKTSRLTTHHHYTDADIVEDLEHVARKQVFRAYDRLKKAQEHLRPEDAWNSVSVELAKASRWHVRLYLVKNLLHKVSIAPQDLKIVLFDVARLYAYDIITSSIGAFLEDGYMSSNQMNEVKEGIYKCLSNMRPNAVGLVDCWDYDDKELKSVLGRRDGNVYPALLQWAQNSQLNRSEVLPAYEKYLGPMMKDARSKL

SEQ ID NO: 5684 - DNA, 2004 bp, Caenorhabditis elegans
  CDS (1)..(2004)
atgagtgctcctttaattgacaaataccggaaaatggcaactttcgactggaaaaaattgaaagcagccgttgaaggagaagaacatgttagactgaagtcagaagtagttgctaaaatgaagtcagaaccagtatttcacagagattatcgagtattgagtagagaagagcaaagagaagttgttcatcagagatggaagaaaattgtcgaatgggggttgttcaaagatccgtactccgatcttgaaaacttccatgcattgactgaaactcttgaagcttatgatcaaggcacatctgcaaggcttttcctccacggaaatgtttttggagcagctgttaagtcaatgggaacagatagacataaggatttgattcagaaaactgaaaacaatgagatcgtcggagcattttgtctgacagaagtaggccatggttcaaacactgctgaaattcaaacaacagctacatttgacaatggagaacttgttttcaatactccaagtgtcagtgcaatcaaatgttgggctggaaatctcgctcactcggccactcacgtagttgtttatgctcaacttcatgtcgaaggaaagaacgagggatttcatggatttgtgattcaagttcgttgccctagaactttccaaactctaccaggaattaccattggagacatgggctcgaaaccaggatgctggcagggagtagaaaatggctggatggagtttaagaaccatagagctcctctgagtgcacttttgaataagggttgtgatattactccggatggaaaatatgtgacaagtttcaaatctgcaagtgagaagcagagtgtcagtttgggaacattgtcagttggaagactcggaattatcgcaaaaggaatgatggcttgcacttttgcatctacaattgctattcgatacagtgttgctcggcgacagtttggaccagtaaaaggcgctgaaaatgagatcccagttctcgagtatccacttcaacagtatcgtctattcccgtacctatccgctgcaatttgcattagaatattccagaagaagtttgtcggacatttcactgaatatatgatgagagtcataatgggagaaaagtcagacgagctctccgagttctcaaaagaagtacatgcattgtcgtctggagctaaaccggttgcaacgtggcttggtgtagaatcccttggagaagctagaaaagcttgtggaggtcatggatacctacaaatgtcacgattgaacaccctccgagatgacaacgatccatcacaaacatttgaaggagaaaactttatgattttgcaacaaaccagcaatattttgctaggaaaagctcaatcaattggatccattgagaccccgatgtctactatgtcattcttgaatcaaaaaccttcaaagttctcatcatggtcttcgaatccagttaatgacgtgttgtctgcgtaccgatatctcacttatcacttacttcaaacaacttcggcagaagcttacagactaaaagcatctggaaagaattcattcgaagttcgaaatgaaattcaaattcatagagctgtcaatttgtctgttgcatacacagaacatacaatgatccattgggttcaacagttcttgaaagaaattgaagatcaaagtgtgaagccggttcttcaaaaagttttgaatcttttctcacttttccttttggaaagacatcttgcaactctttatattactggatatgcttctggtggaaagtttggagaagatcttcgagagaagcttagactcgctgtagccgaattaaaacccgaggccattgctttagtggactcgattgctccagatgatttcattttacattcagctctgggagcatctgatggaaaagcgtacgagcatataatggaagaattccggaagtatacaaatgaacaaccaagatgggtttgcgatttggctcagtttttgcaaaagagatcacaaggatccaagctataa

SEQ ID NO: 5685 - protein, 667 aa, Caenorhabditis elegans
MSAPLIDKYRKMATFDWKKLKAAVEGEEHVRLKSEVVAKMKSEPVFHRDYRVLSREEQREVVHQRWKKIVEWGLFKDPYSDLENFHALTETLEAYDQGTSARLFLHGNVFGAAVKSMGTDRHKDLIQKTENNEIVGAFCLTEVGHGSNTAEIQTTATFDNGELVFNTPSVSAIKCWAGNLAHSATHVVVYAQLHVEGKNEGFHGFVIQVRCPRTFQTLPGITIGDMGSKPGCWQGVENGWMEFKNHRAPLSALLNKGCDITPDGKYVTSFKSASEKQSVSLGTLSVGRLGIIAKGMMACTFASTIAIRYSVARRQFGPVKGAENEIPVLEYPLQQYRLFPYLSAAICIRIFQKKFVGHFTEYMMRVIMGEKSDELSEFSKEVHALSSGAKPVATWLGVESLGEARKACGGHGYLQMSRLNTLRDDNDPSQTFEGENFMILQQTSNILLGKAQSIGSIETPMSTMSFLNQKPSKFSSWSSNPVNDVLSAYRYLTYHLLQTTSAEAYRLKASGKNSFEVRNEIQIHRAVNLSVAYTEHTMIHWVQQFLKEIEDQSVKPVLQKVLNLFSLFLLERHLATLYITGYASGGKFGEDLREKLRLAVAELKPEAIALVDSIAPDDFILHSALGASDGKAYEHIMEEFRKYTNEQPRWVCDLAQFLQKRSQGSKL

SEQ ID NO: 5686 - DNA, 1803 bp, Streptomyces coelicolor
  CDS (1)..(1803)
atgacgcaacgcgaagaagagctggcccgtgtcctctccgggcccgagttcgccaccatccgaccggacgacctgagcgtcctcgactacagcctgctgacgctgcgccgggcgcggctcctcaacggcgccggtttcgcggcgaactccctctggctgggccggggcgacagtgcccgcttcccggagttcctgcgcaccatgggctggatcggcgcgtacgacctgtccctgctcaacgtcctggtctcgcaccagatcgcgggcgacgcgctgctcagccacggcggtccggagcaactggacgcctgggctggggagatcgacgcgatggagcggatgtactgcttcgccggttccgaactcctcgccggctcggacctgaagcgggtgcggaccaccgcggtctacgacccgcacgggcggagcctggtgctgaacacgccccggcccgccgacagcaaggtgtggaccggcaacagcctgcacaccggcgacgtggccatggtgctggcccggctggaggtcggcgggcgcgacgagggacaccactggctgcgggtaccgctgcgcgaggccggggccgtactgcccggcgtgcgcatcggccgggccgagccgaagggcggtgtcacggccaaccagaccggcgtactgaccttcacggaccaccggctgccgctgtccgcgctgatgaaccgctgggcgtcgatcgacgaggacggcacctaccggtccccgctgccgcgccaccggcggttcgaggagtgcctggccaccttcacccacgagcggcttttcccgtcggtgggagcggcgtacgcgcaactgctcgcctgcacgatcaccacgcggttcgcggccgtcaagcagaccttcggcaggccgctgatcggccacgagcactaccgcatgcggctgtcggcggccgtggggcgctcgctggccgcccggcacgccatgacggcgctggccgaggtggcggtggcccggagcgccgagggagcaccggcccgcgaccaggtgctgcacgccctgatctcgtgcggcaagtccggctgcaccggcgacgcccggcaaacgctggccgagacccgggagctgtgcggcgggctcggctaccacgacgccaaccagatcgcgccgctgctgcacgactacgagatcgcggtcaccttcggcggtgacaacaccgtcctcggctaccaggcgacccggttcgccctgcgccaccgcgaggacttcgaccgggtgctggacgaggcggtcgccggggccggacggctggacgccgtccgggtgctgcgggccgtctgcgacgtcctgctcgaccgggtggagcgggacggcgccggtgaggccagcgcgcagtggagccgtgccgtccaccagacgctggcgatcggccactgggcccggcaggcatcgaccccgctgtccgagcggctgctcgcgcagtacgcggcggtctgcgtgctggaacacgcgctggccgccctgcgggccgggatcctcgaccaggacgccctcctggggttcgaggcggcccggcacgaggcggcgggcgcccccctcgacgccgacgcgctgctgcgcgaactggccgtgcccgagggcctgatcagcgccccgatcgcccacccggacttcgcggaacggcacgccgccgcggcccatgccggcaccgccgcggcccatgccggcaccgtcccgagcccgggtaccggaccgagcccgggtaccggaccggccccgggcaccgtgcaggcccccggcaccgtgcaggccggagtacgcccgtga

SEQ ID NO: 5687 - protein, 600 aa, Streptomyces coelicolor
MTQREEELARVLSGPEFATIRPDDLSVLDYSLLTLRRARLLNGAGFAANSLWLGRGDSARFPEFLRTMGWIGAYDLSLLNVLVSHQIAGDALLSHGGPEQLDAWAGEIDAMERMYCFAGSELLAGSDLKRVRTTAVYDPHGRSLVLNTPRPADSKVWTGNSLHTGDVAMVLARLEVGGRDEGHHWLRVPLREAGAVLPGVRIGRAEPKGGVTANQTGVLTFTDHRLPLSALMNRWASIDEDGTYRSPLPRHRRFEECLATFTHERLFPSVGAAYAQLLACTITTRFAAVKQTFGRPLIGHEHYRMRLSAAVGRSLAARHAMTALAEVAVARSAEGAPARDQVLHALISCGKSGCTGDARQTLAETRELCGGLGYHDANQIAPLLHDYEIAVTFGGDNTVLGYQATRFALRHREDFDRVLDEAVAGAGRLDAVRVLRAVCDVLLDRVERDGAGEASAQWSRAVHQTLAIGHWARQASTPLSERLLAQYAAVCVLEHALAALRAGILDQDALLGFEAARHEAAGAPLDADALLRELAVPEGLISAPIAHPDFAERHAAAAHAGTAAAHAGTVPSPGTGPSPGTGPAPGTVQAPGTVQAGVRP

SEQ ID NO: 5688 - DNA, 1926 bp, Streptomyces fradiae
  CDS (1)..(1926)
atgtcattgctcacgccccgcagggcccccggccacaccgacaccgaccacagctcctcggacgccgacgctccgttagccggctccgcgccgttcaccgcatcccggaccgacgcgcaggacaccgccgcctccgaactcacccacctgctcttcgaccgcgacgaccggacacgcctccacggcccgtggcggaatctgctgaccacagaaatgttccggcaccggccgggcctccccgccgcgcggcggaccgcactcgcctacgaccggctccggttcgtcaacgaactcgtcggcgaaccggcggaactggcccgcgacgtccggctcctggcctccctgcacgagtggaccggcgtcgtggacggcgctgcgggcaccctcgcgggcatccactacaacctgttcctcggcagcctgctcgaccacgaccggtccgacgagcgggatctctccgagttcctctccatgcgccgtaccggaacgtttctgtgcacggagctggcccacgggaacgatgccgccgcactgcgcaccaccgcggaactggatcgccggaccgacaagttcgtgctgaacacgccgactcccggagcgcagaagttcatgcccaacaccagcaccacgggcggccccaagaccgccctggtcgccgcccggctggtggtggacggcacggaccacggcgtcttcctcttcctgaccccgctcagcgacccggccggcaccctccccggcatacggatccgccgcctgccggagcgcaccggccacccggtcgaccactgcctcacatccttcgaccatgtgcggctgccccgggaggccctgctggaaggggtgcacggccggctggcgtccggcggcttcgagagcttcctcggaaaccggcggaaacggtttctgcacgccctcggccgggtgacggcgggcaagctctgtatgagcgccgccgcggtcggcgtcacccgagccgccctctccatcgccgtgcgctattcgcaccaccggcacatcagcgcgtccaggaccggtgagcgcgtgcccctggcccgccaccgcagccaccacggacggctgctggaaggtctggccgacgcctacgccatgacgtttctgcaccgccgggccctgtcccggtgggccgggcgcgacgaaaccgaccaggccgaggcggaacgcctcgtcgccatcgccaagggatggatcacctggcaggcccgcgccgtcaccatcgagtgccgcgaacgctgcggggcccagggcctgttccccgtcaacggcctcgcggatcacccgctcaatctggagggcaccatcacggccgagggcgacaacctcgtcatctggctgaaggccgcgagcgagatgctcttccaccggcgtaccgagcagcgcccccgcctcgacggtcccccggaggaacagtcgctgaccgacccgcggttcctgcacgacctcctcgcggacgccgaagggctgtggcgggaaagggcccgcggagcgctgcgccagggcccttcgggagatcccctgggccgctggaatggcgcgtcgtcggccgcggtggagatggtccgcgcccacgccgtactgcaggccgccggcagtctgctggaggcggccggacacgcggacggcgccgccccgcggcagttgctggtgtggctgtcccggctcttcatgctccggcatctggcgccgcacaccggtgatctgctggccgagggccgcatgaccgccgatcaggtgcgggccctgccgggatccgtggacgaggtgatcgcgggcctcgccccgcacatgatgacgctcgtcgaggccttcgatctgcccggggagttcctcggcggcatccccctggcgaacgccgcccacgagacgcgcttcgaccagatcgtcgacaccctcctgtccgcgtag

SEQ ID NO: 5689 - protein, 641 aa, Streptomyces fradiae
MSLLTPRRAPGHTDTDHSSSDADAPLAGSAPFTASRTDAQDTAASELTHLLFDRDDRTRLHGPWRNLLTTEMFRHRPGLPAARRTALAYDRLRFVNELVGEPAELARDVRLLASLHEWTGVVDGAAGTLAGIHYNLFLGSLLDHDRSDERDLSEFLSMRRTGTFLCTELAHGNDAAALRTTAELDRRTDKFVLNTPTPGAQKFMPNTSTTGGPKTALVAARLVVDGTDHGVFLFLTPLSDPAGTLPGIRIRRLPERTGHPVDHCLTSFDHVRLPREALLEGVHGRLASGGFESFLGNRRKRFLHALGRVTAGKLCMSAAAVGVTRAALSIAVRYSHHRHISASRTGERVPLARHRSHHGRLLEGLADAYAMTFLHRRALSRWAGRDETDQAEAERLVAIAKGWITWQARAVTIECRERCGAQGLFPVNGLADHPLNLEGTITAEGDNLVIWLKAASEMLFHRRTEQRPRLDGPPEEQSLTDPRFLHDLLADAEGLWRERARGALRQGPSGDPLGRWNGASSAAVEMVRAHAVLQAAGSLLEAAGHADGAAPRQLLVWLSRLFMLRHLAPHTGDLLAEGRMTADQVRALPGSVDEVIAGLAPHMMTLVEAFDLPGEFLGGIPLANAAHETRFDQIVDTLLSA

SEQ ID NO: 5690 - DNA, 2267 bp, Arabidopsis thaliana (mouse-ear cress)
  CDS (8)..(2086)
cattgaaatggaatcgcggcgagagaagaatccgatgacggaggaggaatctgatgggctaattgcggcgaggcggatccaacgattgtctttacacctatctccctccttgacgctgtcgccgtcgttaccgttggtgcagacggagacgtgttcggcgaggtcgaagaagctggatgtcaacggcgaagctttgtcgctgtatatgagaggaaaacatatagatatacaagagaaaattttcgactttttcaattcccgacccgatttgcagacgccgatcgagatctccaaggatgatcatcgggaattgtgtatgaatcagcttatagggcttgttagagaagctggggtaaggccgtttaggtatgttgctgatgatcctgagaagtatttcgcaatcatggaagctgttggaagtgttgatatgtcccttgggattaagatgggcgttcaatacagtctctggggaggctctgtgatcaatttagggactaagaagcatagagacaagtattttgatggcattgacaatcttgattacaccggttgctttgccatgactgaattacaccatgggtcaaatgtgcaaggtcttcagaccacggcgacattcgatccacttaaagacgaatttgtgatcgatacacctaatgatggagctatcaaatggtggattggaaatgctgcagttcatgggaagtttgccactgtttttgccaggcttatacttccaactcatgattccaaaggagtctcggatatgggtgttcacgccttcattgttccgataagggatatgaaaacacaccagacactccctggtgttgaaatccaagattgtggacataaagtgggacttaatggagtggataatggtgcgttgagattccgttctgtgagaataccccgtgataatcttctcaatcgttttggagatgtgtcccgagatgggacgtatacaagtagtttgccaacaatcaataaaagatttggtgcaacactcggtgagcttgtaggtggtcgagttggccttgcctatgcatctgttggcgtccttaaaatctctgcaacgattgccattcgttattctcttctaagacaacaattcgggcctccaaagcaacctgaggtcagtattctcgattaccagtctcaacaacacaagctcatgccgatgttagcctccacctatgcataccattttgcaactgtataccttgtggagaaatattcagagatgaagaagactcacgatgagcaattggttgctgatgtccatgcactctctgctgggctcaaatcttatgtgacgtcttacaccgccaaggcgctctcggtctgcagagaagcctgtggaggtcatggttacgcagctgttaaccgatttggaagcttgagaaatgatcatgacattttccaaacatttgaaggagacaacactgtacttctgcaacaggtggctgctgatttattgaagcgttataaagaaaagttccaaggcgggacattgacagttacatggagctacttgagagaatcaatgaacacttatttgtctcagccaaatcccgttacagcgcgttgggaaggtgaagatcatctaagagatcctaaattccaactagatgctttccggtatcgaacatcgcgattgctacaaaatgtggcagcgagattgcagaagcattcaaagactcttggtggtttcggggcatggaacagatgcttgaatcatcttttaacgcttgcagaatctcacattgaaacagtcattcttgccaagttcatcgaagctgttaaaaactgcccggacccaagtgcaaaagctgctctgaaactagcatgtgatctttacgcattggaccgaatctggaaagatataggaacgtaccgtaacgtggattatgtggcgcctaacaaagctaaggcgattcataaactgacagagtatttgagttttcaagtaaggaatgtggccaaggaactagtggatgcgttcgagctccctgatcatgttactcgagcaccaattgctatgcagtccgatgcttattcccagtatactcaagttgttggattctaaaaacacaagaacaaaacatatatcatcacaatgatcttttaattcgaagcaaaaaaaagatgaaaaacaatttacagggggtacaaaagaatctgcagtcctttgtatgtgtttttagttgttgtttgttttcacaggagaataaaaaaaaacagagtaataaaaatgtcatttttttcgt

SEQ ID NO: 5691 - protein, 692 aa, Arabidopsis thaliana (mouse-ear cress)
MESRREKNPMTEEESDGLIAARRIQRLSLHLSPSLTLSPSLPLVQTETCSARSKKLDVNGEALSLYMRGKHIDIQEKIFDFFNSRPDLQTPIEISKDDHRELCMNQLIGLVREAGVRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPNDGAIKWWIGNAAVHGKFATVFARLILPTHDSKGVSDMGVHAFIVPIRDMKTHQTLPGVEIQDCGHKVGLNGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATVYLVEKYSEMKKTHDEQLVADVHALSAGLKSYVTSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSAKAALKLACDLYALDRIWKDIGTYRNVDYVAPNKAKAIHKLTEYLSFQVRNVAKELVDAFELPDHVTRAPIAMQSDAYSQYTQVVGF

SEQ ID NO: 5692 - DNA, 1995 bp, Arabidopsis thaliana (mouse-ear cress)
  CDS (1)..(1995)
atggaaggaattgatcacctcgccgatgagagaaacaaagcagagttcgacgttgaggatatgaagatcgtctgggctggttcccgccacgcttttgaggtttccgatcgaattgcccgccttgtcgccagcgatccggtatttgagaaaagcaatcgagctcggttgagtaggaaggagctgtttaagagtacgttgagaaaatgtgcccatgcgtttaaaaggattatcgagcttcgtctcaatgaggaagaagcaggaagattgaggcactttatcgaccagcctgcctatgtggatctgcactggggaatgtttgtgcctgctattaaggggcagggtacagaggagcagcagaagaagtggttgtcgctggccaataagatgcagattattgggtgttatgcacagactgagcttggtcatggctcaaatgttcaaggacttgagacaactgccacatttgatcccaagactgatgagtttgtaattcacactccaactcagactgcatccaaatggtggcctggtggtttgggaaaagtttctactcatgctgttgtttacgctcgtctcataactaacggaaaagactacggtatccatggattcatcgtgcaactgcgaagcttagaagatcattctcctcttccgaatataactgttggtgatatcgggacaaagatgggaaatggagcatataattcaatggacaacgggtttcttatgtttgatcatgttcgcattcctagagatcaaatgctcatgaggctgtcaaaagttacaagagaaggagaatatgttccatcggatgttccaaagcagctggtatatggtactatggtgtatgtgagacaaacaattgtggctgatgcttccaatgcactatctcgagcagtttgcatagctacaagatacagtgcagtgcggaggcaatttggcgcacataatggtggcattgagacacaggtgattgattataaaactcagcagaacaggctatttcctctgctagcatctgcatatgcatttcgatttgttggagagtggctaaaatggctgtacacggatgtaactgaaagactggcggctagtgatttcgcaactttgcctgaggctcatgcatgcactgcaggattgaagtctctcaccaccacagccactgcggatggcattgaagaatgtcgtaagttatgtggtggacatggatacttgtggtgcagtgggctccccgagctgtttgctgtatatgttcctgcctgcacatacgaaggagacaatgttgtgctgcaattacaggttgctcgattcctcatgaagacagtcgcccagctgggatctggaaaggttcctgttggcacaactgcttatatgggccgggcagcacatcttttgcaatgtcgttctggtgttcaaaaggctgaggattggttaaaccctgatgttgtactggaagctttcgaagctagggctctcagaatggctgttacgtgtgccaaaaatctcagcaagtttgagaatcaggaacaaggattccaagagctcttggctgatttggttgaggccgctattgctcattgccaattgattgttgtttccaagttcatagcgaaactggagcaagacataggtggcaaaggagtgaagaaacagctgaataatctgtgttacatttatgctctttatctcctccacaaacatctcggcgatttcctctccactaactgcatcactcccaaacaagcctctcttgctaacgaccagctccgttccttatacactcaggtccggcctaatgcggttgcacttgtggacgccttcaattacaccgaccattacttgaactcggttcttggccgttacgacggtaatgtgtacccaaagctctttgaggaagcgttgaaggatccattgaacgactcggtggttcctgatgggtaccaagaataccttcgacctgtgcttcagcagcaacttcgtaccgctaggctctga

SEQ ID NO: 5693 - protein, 664 aa, Arabidopsis thaliana (mouse-ear cress)
MEGIDHLADERNKAEFDVEDMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLANKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYQEYLRPVLQQQLRTARL

SEQ ID NO: 5694 - DNA, 2070 bp, Yarrowia lipolytica
  CDS (1)..(2070)
atgacaaccaacacattcaccgatcctcctgtggagatggccaaggagcgaggtaagactcaattcactgtccgagatgtgaccaacttcctcaatggtggagaagaagagacccagattgtcgagaagatcatgagcagtattgaacgtgatccagtactgtctgtcactgctgactacgactgcaaccttcagcaggcccgaaaacagaccatggagcgggtggctgctctgtcgccttatctggtcaccgatactgagaagctatctctgtggcgtgcgcaactgcatggaatggttgatatgtctactcgtacgcggttgtcgatccacaacaacctgttcattggttccatcaggggatctggtactcctgaacagttcaagtactgggtcaagaagggagcggtggctgttaagcagttctatggatgctttgccatgacagagttgggccatggaagcaacctcaagggactagagacaaccgccacttatgaccaggacagtgaccagttcattatcaacactcctcatattggtgctaccaagtggtggattggcggtgcagcccacacttccacccattgtgtttgtttcgcgaaactgattgtgcatggcaaggactatggtactcgaaactttgtggtacctctccgaaatgtccacgatcacagtctcaaggtcggtgtttcaattggagacattggaaagaagatgggcagagatggtgttgacaatggctggatccagttcaccaatgttcgaatccccagacagaacatgctaatgagatatgccaaggtgtctgatactggagtggtaaccaaacccgctcttgaccaactcacttatggagccctcattcgaggtcgagtgtccatgattgccgactcgttccacgtctccaaacgattcctcacaattgctcttcggtacgcttgtgtccgacgacagtttggaacctctggagacactaaggagaccaagatcatcgactacccttaccaccagcgacgattgctgcctcttctggcctactgctacgctatgaagatgggtgctgatgaggctcagaagacttggattgagaccaccgatcgaattctggctctcaatcccaacgaccccgcccagaagaacgatctggagaaggccgtcaccgacacaaaggagctgtttgctgcgtctgcaggaatgaaggcatttaccacgtggggatgtgccaaaatcattgatgagtgccgacaggcctgtggaggtcatggatactctggatataacggatttggccagggctacgctgactgggttgtccagtgtacctgggaaggagacaacaacgttctgtgtctgtcaatgggccgagggctggttcagtcagctctacagattttggctggaaagcacgtcggtgcttctattcagtacgtaggagacaagtctaaaatctcccagaacggccagggtacccccagagagcaacttctgtcccccgagtttctagtagaagctttcagaacggcttctcgaaacaacattctcagaaccaccgataaataccaagagcttgtcaaaactctcaatcccgaccaggcctttgaggagctgtctcagcagagattccagtgtgctcgaatccacacacgacagcatcttatctcttcattctatgcccgaattgccactgccaaagacgatatcaagccccatctgctgaaactggccaatctgtttgccctctggtcaattgaggaggacactggaatcttcctgcgggagaacatcctcacccctggagacattgacctgatcaacagtcttgtggacgagctctgtgttgcagttcgagatcaggtaattggactcactgatgcctttggtctctctgacttcttcattaacgctcccatcggctcctacgatggtaatgtttacgaaaagtactttgccaaggtcaaccagcaaaaccccgctactaaccctcgtcctccctactacgagtcgactctcaagcccttcttgttccgagaagaggaggacgatgaaatttgcgatctcgatgagtga

SEQ ID NO: 5695 - protein, 689 aa, Yarrowia lipolytica
MTTNTFTDPPVEMAKERGKTQFTVRDVTNFLNGGEEETQIVEKIMSSIERDPVLSVTADYDCNLQQARKQTMERVAALSPYLVTDTEKLSLWRAQLHGMVDMSTRTRLSIHNNLFIGSIRGSGTPEQFKYWVKKGAVAVKQFYGCFAMTELGHGSNLKGLETTATYDQDSDQFIINTPHIGATKWWIGGAAHTSTHCVCFAKLIVHGKDYGTRNFVVPLRNVHDHSLKVGVSIGDIGKKMGRDGVDNGWIQFTNVRIPRQNMLMRYAKVSDTGVVTKPALDQLTYGALIRGRVSMIADSFHVSKRFLTIALRYACVRRQFGTSGDTKETKIIDYPYHQRRLLPLLAYCYAMKMGADEAQKTWIETTDRILALNPNDPAQKNDLEKAVTDTKELFAASAGMKAFTTWGCAKIIDECRQACGGHGYSGYNGFGQGYADWVVQCTWEGDNNVLCLSMGRGLVQSALQILAGKHVGASIQYVGDKSKISQNGQGTPREQLLSPEFLVEAFRTASRNNILRTTDKYQELVKTLNPDQAFEELSQQRFQCARIHTRQHLISSFYARIATAKDDIKPHLLKLANLFALWSIEEDTGIFLRENILTPGDIDLINSLVDELCVAVRDQVIGLTDAFGLSDFFINAPIGSYDGNVYEKYFAKVNQQNPATNPRPPYYESTLKPFLFREEEDDEICDLDE

SEQ ID NO: 5696 - DNA, 2103 bp, Yarrowia lipolytica
  CDS (1)..(2103)
atgaaccccaacaacactggcaccattgaaatcaacggtaaggagtacaacaccttcaccgagccccccgtggccatggctcaggagcgagccaagacctccttccccgtgcgagagatgacctacttcctcgacggtggcgagaagaacaccctcaaaaacgagcagatcatggaggagattgagcgagaccctcttttcaacaacgacaactactacgatctcaacaaggagcagatccgagagctcaccatggagcgagtcgccaagctgtctctgtttgtgcgtgatcagcccgaggacgacatcaagaagcgatttgctctcattggtatcgccgatatgggaacctacacccgacttggtgtccactacggcctcttctttggcgccgtccgaggtaccggaactgccgagcagtttggccactggatctccaagggagccggagacctgcgaaagttctacggatgtttctccatgaccgagctgggccatggctccaacctggctggtctcgagaccaccgccatctacgatgaggagaccgacgagttcatcatcaacacccctcacattgccgccaccaagtggtggattggaggagccgcccacaccgccacccacactgtcgtgttcgcccgactcattgtcaagggcaaggactacggtgtcaagacctttgttgtccagctgcgaaacatcaacgaccacagcctcaaggtcggtatctctattggtgatatcggaaagaagatgggccgagacggtatcgataacggatggatccagttcaccaacgtgcgaatcccccgacagaacctgctcatgaagtacacaaaggtcgaccgagagggtaacgtgacccagcctcctctggctcagcttacctacggttctcttatcactggtcgagtctccatggcctctgattctcaccaggtcggaaagcgattcatcaccattgctctgcgatacgcctgcattcgacgacagttctccaccacccccggccagcccgagaccaagatcatcgactacccctaccatcagcgacgacttctgcctcttctggcctatgtctatgctcttaagatgactgccgatgaggttggagctctcttctcccgaaccatgcttaagatggacgacctcaagcccgacgacaaggccggcctcaatgaggttgtttccgacgtcaaggagctcttctccgtctccgccggtctcaaggccttctccacctgggcttgtgccgacgtcattgacaagacccgacaggcttgcggtggccacggttactctggatacaacggtttcggccaggcctacgccgactgggttgtccagtgcacctgggagggtgacaacaacattctcaccctttctgccggccgagctcttatccagtctgccgttgctctgcgaaagggcgagcctgttggtaacgccgtttcttacctgaagcgatacaaggatctggccaacgctaagctcaatggccgatctctcaccgaccccaaggtcctcgtcgaggcctgggaggttgctgccggtaacatcatcaaccgagccaccgaccagtacgagaagctcattggcgagggtcttaacgccgaccaggcctttgaggttctgtctcagcagcgattccaggccgccaaggtccacacacgacgacacctcattgccgctttcttctcccgaattgacaccgaggctggcgaggccatcaagcagcccctgcttaacctggctctgctgtttgccctgtggtccatcgaagaggactctggtctgttcctgcgagagggcttcctcgagcccaaggatatcgacaccgtcaccgagctcgtcaacaagtactgcaccactgtgcgagaggaggtcattggctacaccgatgccttcaacctgtccgactacttcatcaacgctcctattggatgctacgatggtgacgcttaccgacactacttccagaaggtcaacgagcagaaccctgcccgagacccccgacctccttactacgcctctactctcaagcccttccttttccgagaggaggaggatgatgacatttgcgagcttgatgaggaatag

SEQ ID NO: 5697 - protein, 700 aa, Yarrowia lipolytica
MNPNNTGTIEINGKEYNTFTEPPVAMAQERAKTSFPVREMTYFLDGGEKNTLKNEQIMEEIERDPLFNNDNYYDLNKEQIRELTMERVAKLSLFVRDQPEDDIKKRFALIGIADMGTYTRLGVHYGLFFGAVRGTGTAEQFGHWISKGAGDLRKFYGCFSMTELGHGSNLAGLETTAIYDEETDEFIINTPHIAATKWWIGGAAHTATHTVVFARLIVKGKDYGVKTFVVQLRNINDHSLKVGISIGDIGKKMGRDGIDNGWIQFTNVRIPRQNLLMKYTKVDREGNVTQPPLAQLTYGSLITGRVSMASDSHQVGKRFITIALRYACIRRQFSTTPGQPETKIIDYPYHQRRLLPLLAYVYALKMTADEVGALFSRTMLKMDDLKPDDKAGLNEVVSDVKELFSVSAGLKAFSTWACADVIDKTRQACGGHGYSGYNGFGQAYADWVVQCTWEGDNNILTLSAGRALIQSAVALRKGEPVGNAVSYLKRYKDLANAKLNGRSLTDPKVLVEAWEVAAGNIINRATDQYEKLIGEGLNADQAFEVLSQQRFQAAKVHTRRHLIAAFFSRIDTEAGEAIKQPLLNLALLFALWSIEEDSGLFLREGFLEPKDIDTVTELVNKYCTTVREEVIGYTDAFNLSDYFINAPIGCYDGDAYRHYFQKVNEQNPARDPRPPYYASTLKPFLFREEEDDDICELDEE

SEQ ID NO: 5698 - DNA, 2103 bp, Yarrowia lipolytica
  CDS (1)..(2103)
atgatctcccccaacctcacagctaacgtcgagattgacggcaagcagtacaacaccttcacagagccacccaaggcgctcgccggcgagcgagccaaggtcaagttccccatcaaggacatgacggagtttctgcacggtggcgaggagaacgtgaccatgatcgagcgactgatgacggagctcgagcgagaccccgtgctcaacgtgtcgggcgactacgacatgcccaaggagcagctgcgagagacggccgtggcgcgaattgcggcgctgtccggccactggaagaaggacacagaaaaggaggcgctgctgcggtcccagctgcacggcattgtggacatgggcacccgaatccgactcggtgtgcacacgggcctgttcatgggcgccatccggggttccggcaccaaggagcagtacgactactgggtgcgaaagggcgccgcggacgtcaagggcttctacggctgctttgctatgaccgagctgggccatggctccaacgtggccggtcttgagaccaccgccacctacatccaggacacggacgagttcatcatcaacacccccaacactggagccaccaagtggtggattggaggagccgcccactcggccacccacaccgcctgctttgctcgtctgcttgtcgacggcaaggactacggcgtcaagatctttgttgtccagctgcgagacgtctcttctcactctctcatgcccggcatcgctctcggcgacattggaaagaagatgggccgagacgccatcgacaacggctggatccagttcaccaatgtgcgaatcccccgacagaacatgctcatgaagtacgccaaggtctcgtctaccggcaaggtgtcgcagcctcctctggcccagctcacctacggcgctctcattggcggccgagtcaccatgattgccgactccttctttgtctcccagcgattcatcaccattgctctgcgatacgcctgtgtgcgacgacagtttggcaccacccccggccagcccgagactaagatcatcgactacccctaccatcagcgacgtctgctgcctcttctggccttcacctacgccatgaagatggccgccgaccagtcccagattcagtacgatcagaccaccgatctgctgcagaccatcgaccctaaggacaagggcgctctgggcaaggccattgtcgacctcaaggagctgtttgcctcttctgctggtctcaaggccttcaccacctggacctgtgccaacatcattgaccagtgccgacaggcctgcggtggccacggctactctggctacaacggctttggccaggcctacgccgactgggttgtccagtgcacctgggagggtgacaacaacgtcctgtgtctgtccatgggccgaggtctcatccagtcgtgtctgggccaccgaaagggtaagcctctgggctcttctgtcggctacctggctaacaagggtcttgagcaggctactctgagcggccgagacctcaaggaccccaaggttctcatcgaggcctgggagaaggtcgccaacggcgccatccagcgggccactgacaaatttgtcgagctcaccaagggcggcctctctcctgaccaggcctttgaggagctgtcgcagcagcgattccagtgtgccaagatccacacccgaaagcacctggtgactgccttctacgagcgaatcaacgcctctgcgaaggccgacgtcaagccttacctcatcaacctcgccaacctcttcactctgtggtccattgaggaggactctggtctcttcctgcgagagggtttcctgcagcccaaggacattgaccaggtgactgagctggtgaaccactactgcaaggaggttcgagaccaggttgccggctacaccgatgcctttggtctgtctgactggttcatcaacgctcccattggaaactacgatggtgacgtttacaagcattactttgccaaggttaaccagcagaaccctgctcagaacccccgacctccttactatgagagcactcttcgacctttcctgttccgagaggatgaggatgacgacatttgcgagctggacgaggaatag

SEQ ID NO: 5699 - protein, 700 aa, Yarrowia lipolytica
MISPNLTANVEIDGKQYNTFTEPPKALAGERAKVKFPIKDMTEFLHGGEENVTMIERLMTELERDPVLNVSGDYDMPKEQLRETAVARIAALSGHWKKDTEKEALLRSQLHGIVDMGTRIRLGVHTGLFMGAIRGSGTKEQYDYWVRKGAADVKGFYGCFAMTELGHGSNVAGLETTATYIQDTDEFIINTPNTGATKWWIGGAAHSATHTACFARLLVDGKDYGVKIFVVQLRDVSSHSLMPGIALGDIGKKMGRDAIDNGWIQFTNVRIPRQNMLMKYAKVSSTGKVSQPPLAQLTYGALIGGRVTMIADSFFVSQRFITIALRYACVRRQFGTTPGQPETKIIDYPYHQRRLLPLLAFTYAMKMAADQSQIQYDQTTDLLQTIDPKDKGALGKAIVDLKELFASSAGLKAFTTWTCANIIDQCRQACGGHGYSGYNGFGQAYADWVVQCTWEGDNNVLCLSMGRGLIQSCLGHRKGKPLGSSVGYLANKGLEQATLSGRDLKDPKVLIEAWEKVANGAIQRATDKFVELTKGGLSPDQAFEELSQQRFQCAKIHTRKHLVTAFYERINASAKADVKPYLINLANLFTLWSIEEDSGLFLREGFLQPKDIDQVTELVNHYCKEVRDQVAGYTDAFGLSDWFINAPIGNYDGDVYKHYFAKVNQQNPAQNPRPPYYESTLRPFLFREDEDDDICELDEE

SEQ ID NO: 5700 - DNA, 2106 bp, Yarrowia lipolytica
  CDS (1)..(2106)
atgatcaccccaaaccccgctaacgacattgtccatgacggcaagctctacgacaccttcactgagccccccaagctgatggctcaggagcgagctcagctggacttcgaccctagagacatcacctactttctggatggctctaaggaggagaccgagctgctggagtcgctcatgctcatgtacgagcgagaccctctcttcaacaaccagaacgagtacgatgaatcgtttgaaacactgcgagagcgatctgtgaagcgaattttccagctgtccaagtccatcgccatggaccccgagcccatgtctttccgaaagattgggttcctgggtattcttgacatgggaacgtatgctcgactgggagtccactacgcgctcttctgtaactccatccggggccagggaacccccgatcagctcatgtactggctggaccagggagccatggtcatcaagggcttctacggctgttttgccatgaccgaaatgggccatggatctaacctgtcgcgtctggaaaccatcgccactttcgacaaagagaccgacgaatttatcattaacacgccccacgttggagccacaaagtggtggattggtggtgctgctcacactgctactcacacacttgcctttgcccgtcttcaagtagacggaaaggactacggtgtgaaatcgtttgtcgtacctctccgaaacctggacgaccattcgctgcgtcctggaatcgccacaggtgatattggtaagaagatgggtcgagatgccgttgacaacggctggattcagttcaccaacgtccgagtgccccgaaactacatgctcatgaagcataccaaggttcttcgagacggtaccgtcaagcagccgcctttggcccaactgacttacggatctctcatcactggacgagtccagatgaccactgactctcacaatgtgtccaaaaagttcctcaccattgccctgagatacgccaccatccgacgacagttctcgtcaactccaggagagcccgaaacccgactaattgactacctgtaccaccaaagacgactcctgcctcttatggcttactcttacgccatgaaactagctggagatcacgtccgagagctgttctttgcatcccaggagaaggctgagagcctcaaggaggacgacaaagccggagttgagtcttacgtccaggatatcaaggagctcttctctgtttctgctggtctcaaggctgccactacatgggcttgtgctgacatcattgacaaggcccgacaggcgtgtggaggccacggatactctgcctacaacggctttggacaggccttccaggactgggttgtccagtgcacttgggagggtgacaatactgttctgactctatctgccggccgagctctgatccaatctgctctcgtctaccgaaaggagggcaaactaggtaacgccacgaagtacctctctcggtccaaggagcttgccaacgccaagagaaacggacgatccctggaagaccccaagctgctcgtggaggcatgggaggctgtctctgccggtgctatcaacgctgctactgacgcttacgaggagctctccaagcagggagtttctgttgacgagtgctttgagcaggtgtcccaggagcgattccaggctgcccgaatccacactcgacgagctcttatcgaggccttctactcacgaatcgccactgctgatgagaaggtgaagcctcatctgatccctctggccaacctgtttgccctgtggtccattgaggaggactctgctctgttcctggctgagggctactttgagcctgaggatatcattgaggtgacttctcttgtcaacaagtactgcggaattgttcgaaagaacgttattggatacaccgatgccttcaacctgtccgactacttcatcaacgctgccattggacgatacgacggagacgtgtacaagaactactttgagaaggtcaaacagcagtaccctcctgagggtggcaagcctcactactacgaggatgtcatgaagcccttcctgcatcgagagcgaattcccgatgtccccatggagcccgaggatattcagtaa

SEQ ID NO: 5701 - protein, 701 aa, Yarrowia lipolytica
MITPNPANDIVHDGKLYDTFTEPPKLMAQERAQLDFDPRDITYFLDGSKEETELLESLMLMYERDPLFNNQNEYDESFETLRERSVKRIFQLSKSIAMDPEPMSFRKIGFLGILDMGTYARLGVHYALFCNSIRGQGTPDQLMYWLDQGAMVIKGFYGCFAMTEMGHGSNLSRLETIATFDKETDEFIINTPHVGATKWWIGGAAHTATHTLAFARLQVDGKDYGVKSFVVPLRNLDDHSLRPGIATGDIGKKMGRDAVDNGWIQFTNVRVPRNYMLMKHTKVLRDGTVKQPPLAQLTYGSLITGRVQMTTDSHNVSKKFLTIALRYATIRRQFSSTPGEPETRLIDYLYHQRRLLPLMAYSYAMKLAGDHVRELFFASQEKAESLKEDDKAGVESYVQDIKELFSVSAGLKAATTWACADIIDKARQACGGHGYSAYNGFGQAFQDWVVQCTWEGDNTVLTLSAGRALIQSALVYRKEGKLGNATKYLSRSKELANAKRNGRSLEDPKLLVEAWEAVSAGAINAATDAYEELSKQGVSVDECFEQVSQERFQAARIHTRRALIEAFYSRIATADEKVKPHLIPLANLFALWSIEEDSALFLAEGYFEPEDIIEVTSLVNKYCGIVRKNVIGYTDAFNLSDYFINAAIGRYDGDVYKNYFEKVKQQYPPEGGKPHYYEDVMKPFLHRERIPDVPMEPEDIQ

SEQ ID NO: 5702 - DNA, 2100 bp, Yarrowia lipolytica
  CDS (1)..(2100)
atgaacaacaaccccaccaacgtgatccttggaggcaaggagtacgacaccttcaccgagcctccggcccagatggagctggagcgagccaagacacaattcaaggtccgagacgtgaccaacttcctcacaggcagcgagcaggagacactgctgaccgagcgaatcatgcgggagattgagcgagatcccgttctcaacgtcgccggcgactacgacgccgatcttcccaccaagcgacgacaagctgttgagcgaatcggggctctggcccgatacctgcccaaggattccgagaaggaggccattttgcgaggccagctgcatggtattgtggacatgggtacccgaacccgaatcgccgttcactacggtctgtttatgggcgccattcgtggctcaggaaccaaggagcagtacgattactgggtcgccaagggcgccgctactctgcacaaattctatggctgctttgccatgactgagctgggtcacggatctaacgtggccggtctcgagaccaccgccacccttgataaggacaccgacgagttcatcatcaacacccccaactcgggagccacaaagtggtggattggaggagctgcccactctgctacccacacggcttgtcttgcccgactcattgttgatggcaaggactatggtgttaagatcttcattgttcagctgcgagacctcaactcccactctctactcaacggtattgccattggagatatcggcaagaagatgggccgagatgccattgataatggttggatccagttcacagacgtccgaattccccgacagaacatgctcatgcgatacgaccgggtgtctcgagacggcgaggttaccacctccgagcttgcccagctcacctacggagcacttctgtctggccgagtgaccatgattgccgagtctcacctcctgtctgctcggttcctcaccattgctcttcggtacgcctgtatccgtcgacagttcggagctgtgcctgacaagcccgagactaagctcatcgactacccctaccaccaacgacgtctgctgcctcttctggcctacacctacgccatgaagatgggcgccgacgaggcccagcagcagtacaactcctcctttggcgctcttctcaagctcaaccccgtcaaggacgctgagaagtttgctgtcgccactgccgacctcaaggctctgtttgcctcttctgccggaatgaaggccttcaccacctgggctgccgccaagatcattgacgagtgccgacaggcctgtggtggccatggctactccggctacaacggtttcggtcaggcttacgccgactgggtcgtccaatgcacttgggagggtgacaacaacgtgctgtgtctgtccatgggtcgatcgctcatccagtcgtgcattgccatgagaaagaagaagggccatgtcggcaagtcggtcgagtacctgcagcgacgagacgagctgcagaatgcccgagttgacaacaagcctctcactgaccctgctgtgctcatcactgcatgggagaaggttgcctgcgaggccatcaacagagccactgactccttcatcaagctcacccaggagggtctgtctcctgaccaggcctttgaggagctgtctcaacagagatttgagtgtgcgcgaatccacacccgaaagcatctgatcacctcgttctacgctcgaatctccaaggccaaggcccgagtcaagccccaccttactgttcttgccaacctctttgccgtctggtccatcgaggaggactctggtctcttccttcgggagggctgcttcgagcctgccgagatggacgagatcaccgctctggtcgacgagctgtgctgcgaggctcgagagcaggtcattggattcaccgacgccttcaacctgtccgacttcttcattaacgcccccattggccgattcgacggagacgcctacaagcactacatggacgaggtcaaggctgccaacaaccctcgtaacacccatgctccttactacgagaccaagctgcgacccttcctgttccgacccgatgaggacgaggagatttgcgacctggacgagtag

SEQ ID NO: 5703 - protein, 699 aa, Yarrowia lipolytica
MNNNPTNVILGGKEYDTFTEPPAQMELERAKTQFKVRDVTNFLTGSEQETLLTERIMREIERDPVLNVAGDYDADLPTKRRQAVERIGALARYLPKDSEKEAILRGQLHGIVDMGTRTRIAVHYGLFMGAIRGSGTKEQYDYWVAKGAATLHKFYGCFAMTELGHGSNVAGLETTATLDKDTDEFIINTPNSGATKWWIGGAAHSATHTACLARLIVDGKDYGVKIFIVQLRDLNSHSLLNGIAIGDIGKKMGRDAIDNGWIQFTDVRIPRQNMLMRYDRVSRDGEVTTSELAQLTYGALLSGRVTMIAESHLLSARFLTIALRYACIRRQFGAVPDKPETKLIDYPYHQRRLLPLLAYTYAMKMGADEAQQQYNSSFGALLKLNPVKDAEKFAVATADLKALFASSAGMKAFTTWAAAKIIDECRQACGGHGYSGYNGFGQAYADWVVQCTWEGDNNVLCLSMGRSLIQSCIAMRKKKGHVGKSVEYLQRRDELQNARVDNKPLTDPAVLITAWEKVACEAINRATDSFIKLTQEGLSPDQAFEELSQQRFECARIHTRKHLITSFYARISKAKARVKPHLTVLANLFAVWSIEEDSGLFLREGCFEPAEMDEITALVDELCCEAREQVIGFTDAFNLSDFFINAPIGRFDGDAYKHYMDEVKAANNPRNTHAPYYETKLRPFLFRPDEDEEICDLDE

SEQ ID NO: 5704 - DNA, 2365 bp, Phalaenopsis cv
  CDS (4)..(2103)
gggatgacgaaggaagcccagatgacgtccctcgcctctgagcacgacacccaacaagctctccggcgaatccagaagctctccctccatctccttcaaccttcgccatttcttgatcctgaaagttccggcgacaagaactggatagtcccgtcgccttgtaccggtggccgcgggagaccgcttctatctgtcagccgggcggagttggtggaatacatgaaggggaggcatcgagagatccaggaacgggtcttcaactttttcgtctcgcggccggagttgcagacgccggtggagatctccacagcagaccatcgtgtgctctgcatgcggcagctcacagccctggtccgcgaggccggaatccgtccgttccggtatgcgattgaggatccttctgtttattttgccatcgttgaagccgtcgggggcatagacatctctctcgggatcaagttgggtgtgcagtacagtctttggggaggctccgtgatgaatctaggaactaaaaaacataaggaaaagtactttaagggcattgataatattgattatccaggttgctttgctatgactgaactccatcatggatccaatgtccagggcctccaaacaactgcaacatttgatcctctcactgatgaatttgtaatcaacacaccaaatgatggggccatcaaatggtggataggtaatgccgctgttcatggaaagtttgcaaccgtctttgccaggttgattttaccattccaaggcaaaggaggaaaatctattgatatgggtgttcatgctttcatagtccccataagggacatggaaacccatgatactcttcccatggttgagatacatgactgcggccacaaagtaggccttaatggggtggataatggtgcactgagatttcaatctgtcagaatccctcgagacaatctcttgaaccgattcggggatgtttctcgtgatgggacttacacaagctctctcccaactattaataagaggtttgctgctacacttggggaactggtaggtggaagagtaggccttgcttactcctctgtaggggttcttaaagtttctgtcactattgctgtaagatattccttactccgtcagcaatttggtcctcccaagcagccagagatcagtatacttgattaccagtctcagcagcacaagctcatgcccatgcttgcatcaacatatgctttccactttgccaccctatatctgattgataagtactcggagatgaagaagtctcatgatgatgacattgttggtgatgttcatgctctatctgctggtctgaaggcttatgtaacatcttatacagctaaatcaatcagtgtttgcagagaatcatgtggtggccatggctatgcagctgtcaatcgctttggtgttctccgtaatgaccatgatatttttcaaacatttgaaggggacaacactgttctcttgcagcaggttgcaggtgatctcttgaagcaatataagtcaaagtttcgtggagggactcttactgtgacatggaattaccttagagagtccatggcttcatacacagcccagccaaatccagtcactgctcgatggcaaggtgaagagcatcttcgggatccaaatttccagctggatgctttcaggtaccgaacttctcgattgcttcaaagcttgggactgcgtcttcgcaaacacacaaagacccttggtggttttggtgcatggaaccggtgtttgaatcatctactgacactggcagagtctcatattgaatctgtcatccttgcaaaatttatagaggctgttcaaaaatgcccagataaaaacacgggtaatgttttgaagcttttgtgtgacttgtatgcattggaccgcatatggaatgacataggcacttaccgcaatgtagattatgttgctcctaataaggccaaggcaatacacaagttggttgattacttgagtttccaagttagggggattgcaggggagttggttgacgctttcggtcttcctgaaattgttgtccgggctcccatcggcatgtcatcagaagcatactcccaatatacagaatatgttgggttttagttcataaaaagtcatacatgcacagctctggagaaagtcatctgatcctggtaaacatatagtaaataggcaaatacataatgaaatcttccatattttcctactgttttgtatatatttaagtacaaattttctataagtttaaaagcatatgatattcgtggaatttcatgataaccatgaaagcctccaaagcaatgctctcctcttattgttattaatgttgttatcttgtacatgtaggaaatgtttggttctgttg

SEQ ID NO: 5705 - protein, 699 aa, Phalaenopsis cv
MTKEAQMTSLASEHDTQQALRRIQKLSLHLLQPSPFLDPESSGDKNWIVPSPCTGGRGRPLLSVSRAELVEYMKGRHREIQERVFNFFVSRPELQTPVEISTADHRVLCMRQLTALVREAGIRPFRYAIEDPSVYFAIVEAVGGIDISLGIKLGVQYSLWGGSVMNLGTKKHKEKYFKGIDNIDYPGCFAMTELHHGSNVQGLQTTATFDPLTDEFVINTPNDGAIKWWIGNAAVHGKFATVFARLILPFQGKGGKSIDMGVHAFIVPIRDMETHDTLPMVEIHDCGHKVGLNGVDNGALRFQSVRIPRDNLLNRFGDVSRDGTYTSSLPTINKRFAATLGELVGGRVGLAYSSVGVLKVSVTIAVRYSLLRQQFGPPKQPEISILDYQSQQHKLMPMLASTYAFHFATLYLIDKYSEMKKSHDDDIVGDVHALSAGLKAYVTSYTAKSISVCRESCGGHGYAAVNRFGVLRNDHDIFQTFEGDNTVLLQQVAGDLLKQYKSKFRGGTLTVTWNYLRESMASYTAQPNPVTARWQGEEHLRDPNFQLDAFRYRTSRLLQSLGLRLRKHTKTLGGFGAWNRCLNHLLTLAESHIESVILAKFIEAVQKCPDKNTGNVLKLLCDLYALDRIWNDIGTYRNVDYVAPNKAKAIHKLVDYLSFQVRGIAGELVDAFGLPEIVVRAPIGMSSEAYSQYTEYVGF

SEQ ID NO: 5706 - DNA, 1764 bp, Photorhabdus luminescens
  CDS (1)..(1764)
atggataaatcattgtacaattcagaatcaacattaaagtcttatttaggtataggaaatgagggagtatctgataaccttttagcggtacttaaaagcaattgtgtcaattatcagtcgtcagtaaaaaaattcatagaacttcttgaatatattcaaaataataatattcgcacgaaaccatttaatgaattagttgcgcttcatgaacttgtagctccacatgattgcgctgtagtttctatgctatcaattcattataatttagccatcggcactgtcgctaacttaggcgtgcaaactccatatgtggaagatctttaccaaaaactttgttcaggtcgtgccattggagtatatctggcgactgagctagctcacgggaatgatctaatcgcaatcgaaacacaggctaattatctgccggaaaaaggcgtattcatgctaaattcacctagcccaaatgcatataaatttatgcctaataccatgccttgtgaattacccaaagtggctgtaattttagctcagttaaatgtatcaggaaaaaaatatggtattttcccatttcttcttcctctgtctgtaaatggaaaattaacgcccggcgttaaaattaccccacttggcgataagcccgggttttatttagataatgcaataacttcatttgataatgtcgaaattccctttgaaggactccttgcgggtaatatgataaccctgaccagggagggtaaagtatcattgcatattaaagaattaagagaaagattctcgttaattacaaatagaatacattcagggaagttatgcatggcaatgatctcagtgacagcggccaaatcagttcttcatataactagcacatatggaaataaacgacaaacattcggctattcaggtgctatgccaataattaattattctcatttcaaagaaggtatcgcctgggataccctgagcaccatcactcatacgttatacttaagagagctaacaagaaaagtttcaactatattatcagaatcaattaaaaactttaagttttcagatgaactacttattgaaatcattactaccaagtccctgtgcacatggcgtacacaagaaatattaattaattgtcgtgagcgttgcggcgcacaggggttatttacggttaacaagatatccccttatttgatatctaattttggtacgattacttcggaaggtgataaccttgtattatcactaaaagccggagggatgatcattctcaataagatgaaagaaataaacaaagcatctttccaacataacctatttcccattttgcatgactatatgaactttttatataaaaagttaaatggattaatagcgagtaacaataaaaagataaacttagatattcttaataagcatagtggggattttctagaactaagccaaacatatgccgttttatccgtggtgacgacaactattgatgcataccatgataataatgatgatgatctttgtatgatcatcgaaggttatcttctcgactggattcatcgtaacatgagcaatctcctgagaagtgaagtgatcaatttacaagaatctaaaaaaatagatgagagacgcattgagtatatacgccagcatgcagacagaataaatgattatattcccagttttggcgtagataaggctggaatcgaaacgccgatatccagtgatgattatatttcctggtatgcaaataatcaccatcagttaaaaaacaattaa

SEQ ID NO: 5707 - protein, 587 aa, Photorhabdus luminescens
MDKSLYNSESTLKSYLGIGNEGVSDNLLAVLKSNCVNYQSSVKKFIELLEYIQNNNIRTKPFNELVALHELVAPHDCAVVSMLSIHYNLAIGTVANLGVQTPYVEDLYQKLCSGRAIGVYLATELAHGNDLIAIETQANYLPEKGVFMLNSPSPNAYKFMPNTMPCELPKVAVILAQLNVSGKKYGIFPFLLPLSVNGKLTPGVKITPLGDKPGFYLDNAITSFDNVEIPFEGLLAGNMITLTREGKVSLHIKELRERFSLITNRIHSGKLCMAMISVTAAKSVLHITSTYGNKRQTFGYSGAMPIINYSHFKEGIAWDTLSTITHTLYLRELTRKVSTILSESIKNFKFSDELLIEIITTKSLCTWRTQEILINCRERCGAQGLFTVNKISPYLISNFGTITSEGDNLVLSLKAGGMIILNKMKEINKASFQHNLFPILHDYMNFLYKKLNGLIASNNKKINLDILNKHSGDFLELSQTYAVLSVVTTTIDAYHDNNDDDLCMIIEGYLLDWIHRNMSNLLRSEVINLQESKKIDERRIEYIRQHADRINDYIPSFGVDKAGIETPISSDDYISWYANNHHQLKNN

SEQ ID NO: 5708 - DNA, 2085 bp, Anopheles gambiae str
  CDS (1)..(2085)
atgccagtagacgaggagcgtacagtcataccggatgtgccccgtggaccgctgtgtgattaccgttcgaaggcacagtttaactggaaagattttaggctagtgctagaagataaggagctggttaagatcaaatacgacatatggcgccgattagagagggaacccctgtttgccccggtcacgtccacgctgtcggtcgatcagcagaaagaacgggcggcccgtcaggtgaaccgtatcgccgatctggagctcgccccgcccgaaatctactcgaagccgtacaagtaccgggtgcgctatctcatgagcatcaacgaagcgctgcacgcggtctgcccgagcctgtcggtcaagatagcgctcggcgtggggctgttcacgaactcgctgctagcgatgggtaccgaccggcaccaggagatctacaaccaggcgtggaaccgggagatcatcacctgtctagcgattacggaggtttcgcacggcagcaacacgaagcgctgtcgaacgaccgcaacgtacgatccggccacgcaagagttcatcatccacacgcccgatttcgaggcggctaaatgttgggtgggcaatttgggcaaaaccgcctcgatggcgctgctgtttgccatcctctacacagccgacggggaaaaccatgggctgcagggctttctggtgccgattagggacccaaaaacgttacttccgtatcccggggtgacggtgggcgatattggcgagaagattgggctgaacggtatcgacaatgggttcgtgatgttcaaccactatcgcataccgcgggagaatctgcttaaccgaactggggacgtgacgccggagggtgtgtacgagagtacgttcagtgagccgggcaaaatcttgggcgccgtgctggaatcgttctcggccggacggttgggcatcatgcaggagtcgtcaaatacgctgtcgcatgcggctgtgattgcggtgcggtatgcggcactgaggaaacagttcggcacggataggaacggtccggagcagtcgatcatcgagtatcagttacatcaatggcgcatcttcccctatctggccgctgcctgcgtacttaaggtgtccgtgtttgccatgaccgagatctatctggagacggtgcagaagtcgcaggcggaatcgaacgggttcgagctgctgacgcagatcgtgtccgagatacacgcgcttgtgtcgtcctcgaagccgctcgtcacgtggacggctcgtgatgcgattcaagagtcgcgcgaagcgtgtggtggccatggctatctgcgggcggccaatttgggcgagctgcgcaacaaccacgatcctagctgtacttacgagggggacaataatgtgctcggtcagcaggcctcaaactggctgattaggcagtggaagaatgcgaaggtagagagtccggtcgggacggctagctttattacgcgcagggatgctatactgagcggcgattacgatgcactgctgcgtacgggagtgcgtctcgaaagcacggaatttgtcagtcagtgttacgaatggctgatgtgttggctgctgaagcaaagcgtagctcagatggaagaagcgagtaaggccggcgtggacacgtttaccgcacgcaacaactgccaggtgtaccgtgcgagggatctaagccgtgcgtacgccgagtattacgcactcgaaagtttcagatcccgctgtgctcgagccgatgtaaacgcagatctgaagccggtgctgttccgcgtctatttaatctacggtatgtggtgcctcgaccgacacatgaccaccttctacgccggttcgttcgctaagggatccgccttcgcggatgcagtgcgcggtacactgctgcgaatgtgcggcgagctgaaggactctgccgttgcgattgccgatgcgctcgctccccccgactgggtgctaaactcggtaatcgccaaatcggacggccggctgtacgagaacattcagtcagtattcatgaccaatccgggtgcgctcgagcgagcctcctggtggaaggacgtgataccgtccaagctgagggccaagctgtaa

SEQ ID NO: 5709 - protein, 694 aa, Anopheles gambiae str
MPVDEERTVIPDVPRGPLCDYRSKAQFNWKDFRLVLEDKELVKIKYDIWRRLEREPLFAPVTSTLSVDQQKERAARQVNRIADLELAPPEIYSKPYKYRVRYLMSINEALHAVCPSLSVKIALGVGLFTNSLLAMGTDRHQEIYNQAWNREIITCLAITEVSHGSNTKRCRTTATYDPATQEFIIHTPDFEAAKCWVGNLGKTASMALLFAILYTADGENHGLQGFLVPIRDPKTLLPYPGVTVGDIGEKIGLNGIDNGFVMFNHYRIPRENLLNRTGDVTPEGVYESTFSEPGKILGAVLESFSAGRLGIMQESSNTLSHAAVIAVRYAALRKQFGTDRNGPEQSIIEYQLHQWRIFPYLAAACVLKVSVFAMTEIYLETVQKSQAESNGFELLTQIVSEIHALVSSSKPLVTWTARDAIQESREACGGHGYLRAANLGELRNNHDPSCTYEGDNNVLGQQASNWLIRQWKNAKVESPVGTASFITRRDAILSGDYDALLRTGVRLESTEFVSQCYEWLMCWLLKQSVAQMEEASKAGVDTFTARNNCQVYRARDLSRAYAEYYALESFRSRCARADVNADLKPVLFRVYLIYGMWCLDRHMTTFYAGSFAKGSAFADAVRGTLLRMCGELKDSAVAIADALAPPDWVLNSVIAKSDGRLYENIQSVFMTNPGALERASWWKDVIPSKLRAKL

SEQ ID NO: 5710 - DNA, 3798 bp, Brachydanio rerio
  CDS (73)..(2151)
tgacaagtgccttaggttaagaacatgagtgatccagccatcacagatgctaaatatgtattgggagacaaaatggatgaaggcatcccagattttcccaatggtcctctggacatctacaggaagaaagcatccttcagctggaaggacatgatgcgctttctggagggggatgaactcattgcattcaagcagcacgtgttcaggactctggagagcgacccgctttttgcccggcagcctggtgaggacgtcccagtggagcagaagcgagagctcaccttcctccgctgtaaacagttgtttaagtatgactttataacacgagaagagctaatgcagaacccctggaagatgaccgtcctcaacgactgcctgggaatgtatgactggtctttatgtgccaagtacttccttaacaaagggatgtttggagccactgtggtaaacacaggatctcagaggcacttgaagtttgtgaaggacatcgagcgaatgatgacatttggatgcttttcattgacagagctgagccatggcagtaacacaagagccctgaggacaacagccaaatatgaccccaacactcaggagtttgtgatcaactcaccagactttgaagcagcaaagttctgggtggggaacttgggaaagaccgccactcattcagttgtatttgcccagctctacacacctgatggaaaatgtcacggcctccactctttcatagtacaagtcagggatccaaagaccttgttggctatgccaggagtgatggttggggatatgggaaagaaactgggtcagaacggtctggataatggttttgcagtgtttcacaatgtgaggatacctcgggaaaacttgctaaacaaaactggagatgttgctcctgatgggcaatatgtttcaccttttaaagaccccaataagcggtttggggcttctttaggtgctctgtcaggaggtagggtgggcattacgaggatggcactggtcaatctgaagctggcagtgactgtggctgtgcgattctctgccacacgcagacagtttgggcccaaagaggacgaggagattccagtgctggaatatcaactgcagcaatggcgtcttattccattcctggcagccgtgtatgcactggagcacttcaccaaatctttcagcatgaactttgtggaatttcaaatgggacttttaatgaaggacaagagcgacagacaggctgaactgggcagagagatccatgccttgtcctgtgcgagtaaacctttgggatcatggactgctcagcgaggtattcaggaatgtcgagaggcctgtggaggacacggttaccttgccatgaaccgactgggggacatgcgggacgacaacgacccaaactgcacatatgagggagacaacaacgtcctcctgcagcagaccagcaactacctgctcagctggatccaacacaaacaagaaggtaaaggaaggatcgaatcccctctcgagactgtcaacttcttagacgacatgagcagcattctgcagagcaagttcacagttggctcagtggaagagtgcatgaactcagccgtgcccctggcagcgtataagtggctggtgtgtttcttgctgggtgagagccagaagaagctgtttgaggaaaaatcttctggactgggagactttgaggcacgaaacaacagccaagtgtattactgtcgttcattggctatcgcctttattgagcacacagtactgcagcgtttccatgatctgattcaggatgaacagactccagctgttctcagatcagtgctggggcgtctctgtgctctctatggcttgtggactctcaccaatcacatggcaatcttgtatcaaggaggttatttttctggtgggcagccggttgacttcatccagacagccattctcactctgtgtgggcagctgaaggatgacgctgtggcattggttgatgttttcgctcctcctgacttcatcctcaactctcccattggcaaatcggatggtgagctctacaaaaacctgtggtctacagtcatgcagggtaagaacgttctggaacggccatcttggtgggctgaattttgttctgacaaacctgttgttggatctctccgagccaaactctaaatcctcagtctggaaaaatcatggcagacatccttctgtatacccttcaagccaagcagttttatcctgatattgcaaaactgtcgtacagttgtcacaattaaatgaactgaatgttgcatctaagaagatgttaattttgctgtaatatcatgaaccgattcagtaaagcttcttaagatcagaaaaaaacagcacgtggtgtgctgtaaacattaataaaagtatttttgcagcgcttccttattcactatgccacgataaacttttaataataactccatatatattttgctgtcttgattgaacctaaattgccagatatgttgctttaaaggtgacattggctggctaattacaaatgttgatatgattctgaagggttaagctttttaatggtactgtaaaaaaaaaaaattttaccctgtcaaaaacacctcaattcacattaagccagtttgcttcttatctgtttaaccactctctgaggctgctggatcgtgattggctaatagcctaccaatcaattcttgtggggtagttactgaatataccagcgcactacacatacagctctcaatcaagcctttagcttctgctgaattttagctgtgaatgacatgaagtagaatttgaagctttcttaacatttcaatgacacaatacataaaatcgatgcatataaatgatcatttcttgacaatgcagcatgccattaatcaaactaacatttacacaaagtggcactgctggatttggcaaaagctctatttctgaactggtaatttaaaacacacttacaagcacagctctgaacacatgacagaaagatgatctaattttaaacacaagtgaattgaagttaactttcgataacaacctaacaaaaactacaattgtatctaaagaatgaagctttcagacaaattgtaggtatgcttggattctttaaagaaatagaagtccagcttcgtatttccgataacacagacattatcatctcccccttaaaaatctttgacataaataggctaagatagttaaaaaaaagcaactaaacttcaataaatttataaaagggaacatttcatctgatgtcacctttaatgcacaggtagctaaacatagacaacaaccatactctaacaaaacctttacaataacaatgtttagatacttattgtacattttgtgtcatgttgatacagtgctcagctcgttttgaaaattaatatgtttctccatttctcagtgaatattgattgaatattgaatacttgatttctcctcttatttaatttgtatttaataattttctataacacacatttggctgtacttgtttttgaaacattatcgtaagttatttggttaaataagctccagatttggcttcagtactgactaatctaatgtatatgcacaaatataatattgtaaagcttcctatagaaaatttgaattaaaaaatagatttgtgagtggtgaatatgtgtgaggcgtgaatatgtgtgatttcattttttctgaatggtaaatgattttatgcacattgtcatcttgtattaatatgtaatgtataattgcaacagattttgactttaaataataataaatatttcttaattatttaaaaaaaaaaaaaaa

SEQ ID NO: 5711 - protein, 692 aa, Brachydanio rerio
MDEGIPDFPNGPLDIYRKKASFSWKDMMRFLEGDELIAFKQHVFRTLESDPLFARQPGEDVPVEQKRELTFLRCKQLFKYDFITREELMQNPWKMTVLNDCLGMYDWSLCAKYFLNKGMFGATVVNTGSQRHLKFVKDIERMMTFGCFSLTELSHGSNTRALRTTAKYDPNTQEFVINSPDFEAAKFWVGNLGKTATHSVVFAQLYTPDGKCHGLHSFIVQVRDPKTLLAMPGVMVGDMGKKLGQNGLDNGFAVFHNVRIPRENLLNKTGDVAPDGQYVSPFKDPNKRFGASLGALSGGRVGITRMALVNLKLAVTVAVRFSATRRQFGPKEDEEIPVLEYQLQQWRLIPFLAAVYALEHFTKSFSMNFVEFQMGLLMKDKSDRQAELGREIHALSCASKPLGSWTAQRGIQECREACGGHGYLAMNRLGDMRDDNDPNCTYEGDNNVLLQQTSNYLLSWIQHKQEGKGRIESPLETVNFLDDMSSILQSKFTVGSVEECMNSAVPLAAYKWLVCFLLGESQKKLFEEKSSGLGDFEARNNSQVYYCRSLAIAFIEHTVLQRFHDLIQDEQTPAVLRSVLGRLCALYGLWTLTNHMAILYQGGYFSGGQPVDFIQTAILTLCGQLKDDAVALVDVFAPPDFILNSPIGKSDGELYKNLWSTVMQGKNVLERPSWWAEFCSDKPVVGSLRAKL

SEQ ID NO: 5712 - DNA, 3977 bp, Mus musculus
  CDS (187)..(2289)
aggatattcctgataaatagtgtcctccagacgccgggttgactaggaccacgaatcccaagctggatccgggaggaacatcacaagtgcctgatttgagtcccaggaacgtggcagacactgccccgtgtgcagagttatcgttgcttctgagaaacggggacaaagcaggtcggtgacagtaccatgggatccctaccggaagaaaaagacagtgctttgtggtcagacacccccaagggccctcttagtgcctaccgagcaagagcctccttcaactctggggagctgctgctcttttgggacggccaggatgtaatccacttcaagaaaaccatcttctcaactttggagaatgaccctctctttgcccgctcgtacggggccgacctgcccctagagaagctacgagaactgaacttccttcgctgcaagagggtctttgagtatggcttcttcaaagtagaggaactgctaaagaaccccctgaagattctagtgctgattaactgcctgggcatgtacgactggtccctggccaacaaatgcgtcctccacatgttggtttttggaaccacagttttcgtttctggttctgagaagcatttcaagtaccttgagaagatctatagcctggagatttttggctgttttgctctcaccgaactgagtcatgggagtaataccaaggccatgcgaacgacagctcactatgatcctgatactcaggaattcatcttacattccccggatttcgaggctgccaaattttgggtgggcaacctgggcaagacggcaactcatgcggtggtgtttgcccaactgtacatgccagacggccagtgccacgggctgcattccttcctggtgcagatccgtgacacgaagaccctgcttcccatgacgggggtgatggtcggtgacattgggaagaagctggggcagaatggcctggataatggattcgccatgttcaacaaagttcgaattcctcgccagaacctgctggacaggactgggaatatcacctctgagggcacttacaacagcccctttaaggatgtccggcagcgtttgggcgcatcattgggcagcctgtcctcaggacgcatctccatcatcagcatgtctgtggtcaacctgaagctggccgtgtccatagccatccggttctcggccacacggtgtcagtttggacccacggataaggaagagattcctgtccttgaatatccactgcagcaatggcgcatacttccgtacctggcggctgcctatgccttggaccacttctctaagacaatcttcatggacttgatagaggtgcagagtgcccggctcaggggagaccacagcgaccagcaggcagaactcggacgtgagatccatgctctggcatcggctggcaagcctctagcctcatggacagcccagcggggtatccaggagtgccgtgaggcgtgtgggggacatggctacctggccatgaaccggtttggtgacctcagaaacgacaacgacccaaactgtacctatgaaggtgacaacaatgtcctgctgcagcagaccagcaactacctgctcagcctcctggagcctcctctccaagacggagctcacttcacaagccctctcaagaccgtggactttctggaagcctatcctggaatcttgggccagaagttcctgggctccagcaaggctgactggatggactcagcagcccccctggcagcctaccgctggcttgtttgctacttgctccaagagagccatcggagatactgccaagagaaaaagtccagaggcagtgactttgaagcaagaaacaacagccaggtgtacggctgccggcccctggccctggccttcatggaactcaccgtgatgcagcgattccacgaacatatacacagctccggtctgtctccatctctgcggactgtgctcgggcggctcagcacgctctacggcctgtggtgcctgagccagcacatggccctgctctaccgaggtggctacatttctggggaacaaacaggaagagcgatggaggacgccatcctgaccctgtgtgagcagctgaaagacgatgcggtggccttggtagatgtcatcgccccctccgactttgttctgaactccccaattgccaaagctgatggtgagctctataaaaacctgtgggcagctgtcctgcagcagaatggtgtgctagagcgtgccgcctggtggcccgagttctctgccaacaaatctgtagccgacaggctaaagtcccagctgtagacacagttggaggggcggttacagcaggaacagctgatccagaggcctggacccagacacagagctccaagagacacccagatgcctacgctgaaaaccactgacattacagcttctcctcgaccctggtcagcctgttgtacccatcctcaaatggggtatttgcgagggatttgcacagtgtgtctccctgagggccttggaatttaacaaaggacttagttatgctatctcagggctcagataggaaggtaaagtcagggctcacaatgaaagccttctgctgaagtgaactttgggatccgtggaagatttttgagacacactcttctctctgctgctgtctgattctttaaccctgctgtggggtggccatacttctctatacctgccatttactcctctgtaccatgaaccatcagaatgatgtaatttgaagatctttatggggaaaaaaatgttttattaactcctctggtggcaccagaagtttccgctgagaaaaatgctcccacagaagacgtgcatggtggtggggaccacagacacatcccgctgtgtcagtgactgcttggcagtggctttcatccttcagcaaattcacacacggcatgaccctgctacactggccatagccagaccctcgtacttctgaaagacatagatgccaccccttcctgccataggcaggatcccacaccattcgctttctgatgggctgttctgagccccaggcgcttgctcagcctgagagcctctctcttcaccacctgttcttcttggtcatacacacacaccgccctggctcagcatcctcccagagtcctaccccagttgaataggggcctgccagctggagtccctgtaaaacatgagagccatgtgtccacagatgacgccttccacctggatccatggcttttcccaacaacgaggactaggtcttaggtccttttgggtcctcgctgctcttggaatctctaccctcccaccctgccaggcagtggtcacctcagccacctatttatctgaccatacttttgcatgggagcttggttactgtactgtctgattggagactgaccagtatgtcacaagaagtgtccacggccagtagaatgctgcattaagatacgtcacatggtccccagggtcaggcagccctctggtggccaaggtgccagcagatttcaaagtatagacaaatggatctttagctatagcttctgagaggagggagagtcagttttctttaagagccactggtatgttgagcatgctccattgcgtgcccacacacgcaagagcatatgggtggcacagagtggacttgatggcttttttttgtcttgtaatatgtgcacatatatgttttcatatctaccaactgggtatatcttggtctctggggtagggactggctctctggacaaccagacttagatgggtgatatcacatgacttctagaaatgaatggtgtatcctggtccctgctcctgtgtgtgtatactcccctcctcagtcccaagggtgaggcaggtggcatgtgggggcctatgggtagaggctacattattgaaacaaacttgaaaaggtcccataaaaatgaaacatttgtaagcagcaggaaagacttgaataattgcaataaagtgttgaaattgaaaaaaaaaaaaaaaaaaaaaaa

SEQ ID NO: 5713 - protein, 700 aa, Mus musculus
MGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYDPDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAYALDHFSKTIFMDLIEVQSARLRGDHSDQQAELGREIHALASAGKPLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGCRPLALAFMELTVMQRFHEHIHSSGLSPSLRTVLGRLSTLYGLWCLSQHMALLYRGGYISGEQTGRAMEDAILTLCEQLKDDAVALVDVIAPSDFVLNSPIAKADGELYKNLWAAVLQQNGVLERAAWWPEFSANKSVADRLKSQL

SEQ ID NO: 5714 - DNA, 1710 bp, Bacillus cereus
  CDS (1)..(1710)
atggagaaaacgaagttaccatgggatgaattcttttcacttaataaagatataaatcatacttactttacaccagaagatttttcaggtgatgaagatttaatcgcaaaaacgacagaacaattcgttaaacaagaaattgttccacaaatggagaatattgaacaacataactataaagtttctcgtcaattatttgagaaagctggggaacttggattattaggcattgaggtaccagaagattatggcgggttcgagttaggaaaggctgtctcaggtcttgtagcagagaaaatgggttacgctggtgcgtttagcgtttcttttaatatacacgctggtgtcggtacattgccttacatatattatggaacgaaagagcaaaaagaaaaatatttaccgaaaatcgcatcgggagaatggattggggcttatgctttaacagagccaaatgctggttcggatgcattaagtgcaaaaacaagcgccgtattgaatgaagagggaacagcttggaagttaaatggtgagaagcaatggattacaaatgctcatatggcagatgtatacgttgtttttgcgaagacaaataaaggaatgacagcgtttattgtcgaaagaacatgtgaaggtgtatctattggattagaagaaaagaaaatggggattaaaggttcttcaacagcgactcttattttagaagatgttgtcatccctgctgaaaatgttttaggggaagttgggaaagggcatcacgtagcccttaatattcttaactttgctagacttaaacttgcttttggaaatattggaacagcaaaacaagcaattggtttgtcggttcaatatggaaaagagcgaaaacagttccaaacggaattagtagactttacgatgattcaagagaaaattgcaaatatgatcattgctacatatggagccgaaagtgcagcttatcgtacggcaggtgtaatcgatgaagcaattcatgagagcgatgaagatcttatgaagaaaatgtcccaatttgcaattgaatgtgcactgaataaagtaaatgcttctgaaacacttgcttatatcgtagatgaagctgtacaaattcatggtggttacggttatatgcaagagtatgaggtagaacgattatatcgtgatgctagaattagtcgtatttttgaaggaacgaacgaaattaatagattaacagttgccaaaatgttaatgaagcaaatcgaacaattagaagatactgaagtagaaagtgatgtagcaaatgtagaaagaaaccatcgttacattttattagcgaaaaaattgttgaaacaatctttgaaaacgctctctaaaactccaggcctaaaaattgaccaagaacaagaatattcacgtgtaatttcaaatatgttgacggacgtgtacgtcatggaatcagcgtttttacgtacgagaaaagcggtaagtaaaaatggtgaggaaaaagaacgtacgaagcaattaataacggatgttatttgtgaagaaggataccgtaaagtagaagaagcggcgatttctgtactttcagcggctgtcacagaagaacaagatagacatgtgattttagctgaaatccgtcaattattagtgcctttatacacgaacgtatttacgaagaagagagaaattgcgaaagctattataaatcgcgggaaatatattgtgtaa

SEQ ID NO: 5715 - protein, 569 aa, Bacillus cereus
MEKTKLPWDEFFSLNKDINHTYFTPEDFSGDEDLIAKTTEQFVKQEIVPQMENIEQHNYKVSRQLFEKAGELGLLGIEVPEDYGGFELGKAVSGLVAEKMGYAGAFSVSFNIHAGVGTLPYIYYGTKEQKEKYLPKIASGEWIGAYALTEPNAGSDALSAKTSAVLNEEGTAWKLNGEKQWITNAHMADVYVVFAKTNKGMTAFIVERTCEGVSIGLEEKKMGIKGSSTATLILEDVVIPAENVLGEVGKGHHVALNILNFARLKLAFGNIGTAKQAIGLSVQYGKERKQFQTELVDFTMIQEKIANMIIATYGAESAAYRTAGVIDEAIHESDEDLMKKMSQFAIECALNKVNASETLAYIVDEAVQIHGGYGYMQEYEVERLYRDARISRIFEGTNEINRLTVAKMLMKQIEQLEDTEVESDVANVERNHRYILLAKKLLKQSLKTLSKTPGLKIDQEQEYSRVISNMLTDVYVMESAFLRTRKAVSKNGEEKERTKQLITDVICEEGYRKVEEAAISVLSAAVTEEQDRHVILAEIRQLLVPLYTNVFTKKREIAKAIINRGKYIV

SEQ ID NO: 5716 - DNA, 1710 bp, Bacillus anthracis
  CDS (1)..(1710)
atggagaaaacgaagttaccgtgggatgaatttttttcacttaataaagatgtgaagcatgctttctttacgccagaagatttttcaggagatgaagatttaatcgcaaaaacgacagaacaattcgttaaacaagaaattgttccacaaatggagaatattgaacaacataactataaagtttcccgtcaattgtttgagaaagctggagaacttggattattaagtatcgaggtcccagaagaatatggcggattcgaattaggaaaggcagtttcagggcttgtagcagaaaaaatgggatacgctggtgcatttagcgtttcatttaatatacacgctggtgtaggtacattgccttacatatattacggaacgaaagaacaaaaagaaaaatatttgccgaaaattgcgtctggagaatggattggagcttatgctttaactgagccaaatgccggttctgatgcattaagcgcaaaaacgagcgcagtattgaatgaagatggtactgcttggaagttaaatggtgagaagcagtggattacaaatgctcatatggcagatgtatacgttgtttttgcgaagacaaataaaggaatgacagcgtttattgtcgaaagaacatgtgaaggtgtatccattggactagaagaaaagaaaatggggattaaaggttcttcaacggctacgcttattttagaagatgttgttatacctgctgaaaatgttttaggggaagttgggaaagggcatcacgtagctcttaatattcttaacttcgctagactaaagcttgcttttggaaatattggaactgcaaaacaagcaattggattgtcggttcaatatggaaaagagcgaaaacagttccaaacggaattagtagattttacgatgattcaagagaaaattgcaaatatgatcattgctacatatggagcagaaagtgcagcttatcgtacagcaggtgtaattgatgaagcaattcatgagagtgatgaggatcttatgaagaaaatgtctcaatttgctattgaatgtgcactgaataaagtaaatgcttctgaaacattaggtcatatcgtagatgaagctgtacaaattcatggtggttacggttatatgcaagaatacgaggtagaactattatatcgtgatgctagaattagtcgtatttttgaaggaacgaatgaaattaatagattaacagttgccaaaatgttaatgaagcaaatggaacaaattgaagatactgaagtagagattgatgtagcaaatgtcgaacgaaatcatcgttacattttattagcgaaaaaattgttgaaacaatctttgaaaacgctctctaaaactccagggttaaaaattgatcaagagcaagaatattcacgtgtattatctaatatgttaacggatgtgtacgtcatggaatcagcatttttacgtacgagtaaagcaattagtaaaaatggtgaagggaaagaacgtacgaaacaaatgataactgacgttatttgtgaagaaggctatcgtaaagtagaagaagcggcgatttctatactttcagcggctgttacagaagaacaagataggcacgtaattttagctgaaattcgtcaattattagtacctttatacacgaacgtatttacaaaaaagagagaaattgcgaaagctattataaatcgcggaaagtatattgtgtaa

SEQ ID NO: 5717 - protein, 569 aa, Bacillus anthracis
MEKTKLPWDEFFSLNKDVKHAFFTPEDFSGDEDLIAKTTEQFVKQEIVPQMENIEQHNYKVSRQLFEKAGELGLLSIEVPEEYGGFELGKAVSGLVAEKMGYAGAFSVSFNIHAGVGTLPYIYYGTKEQKEKYLPKIASGEWIGAYALTEPNAGSDALSAKTSAVLNEDGTAWKLNGEKQWITNAHMADVYVVFAKTNKGMTAFIVERTCEGVSIGLEEKKMGIKGSSTATLILEDVVIPAENVLGEVGKGHHVALNILNFARLKLAFGNIGTAKQAIGLSVQYGKERKQFQTELVDFTMIQEKIANMIIATYGAESAAYRTAGVIDEAIHESDEDLMKKMSQFAIECALNKVNASETLGHIVDEAVQIHGGYGYMQEYEVELLYRDARISRIFEGTNEINRLTVAKMLMKQMEQIEDTEVEIDVANVERNHRYILLAKKLLKQSLKTLSKTPGLKIDQEQEYSRVLSNMLTDVYVMESAFLRTSKAISKNGEGKERTKQMITDVICEEGYRKVEEAAISILSAAVTEEQDRHVILAEIRQLLVPLYTNVFTKKREIAKAIINRGKYIV

SEQ ID NO: 5718 - DNA, 1152 bp, Streptomyces avermitilis
  CDS (1)..(1152)
atgaacctggagctcagcgaggagcagaccgccgtccggcagctcgccaaggacttcgtggaccgcgaggtcgccccgaacgtcatcgcctgggaccgcgcagaggaggtcgaccgctccctcgtcaagaagctgggcgaggtcggcttcctcgggctgaccgtcgacgaggagtacggcggctccggcggcgaccacctcgcgtactgcctggtgacggaggagctgggccggggtgactcctcggtgcggggcatcgtgtcggtctccctcgggctcgtcgccaagacgatcgcgtactgggggagcgaggagcagaagcggcagtggctgccggggctcacctccggcgcgtacgtcggctgcttcggcctcaccgagcccggcaccggctccgacgcgggcaatctgacgacgagggccgtacgcgacggcgacgactacgtcgtcaacggcaccaagatgttcatcaccaacggcacctgggccgacgtcgtgctcctcttcgcccgctccacggacgcacccggacacaagggcgtctccgccttcctcgtccccaccgacacccccggcctgacccgccgccccatccacggcaagctcggcctgcgcggccaggccaccgccgagctggtcctcgaggacgtccgcgtgcccgcctcggcgatgctggcgcccgagggcaagggcttctccgtggccatgtcggcgctggccaaggggcggatgtcggtcgcggcgggctgtgtcggcatagcccaggccgcgctggacgtggcggtgaagtacgccaccgagcgcgaacagttcgggaagacgatcgcccaccaccagctcgtacaggagctgatcagtgacatcgccgtggacgtggacgccgcccggctgctgacctggcgggtcgccgacctcgtcgaccgggggcagccgttcgccaccgcgtcctcccaggccaagctcttcgcctccgaggccgccgtgcgcgccgcgaacaacgccctccaggtcttcggcggctacggctacatcgacgagtacccggcgggcaagctgctgcgcgacgcccgcgtgatgacgctctacgagggcacgagccagatccagaagctgctgatcgggcgggcgctgacgggggtctcggcgttctga

SEQ ID NO: 5719 - protein, 383 aa, Streptomyces avermitilis
MNLELSEEQTAVRQLAKDFVDREVAPNVIAWDRAEEVDRSLVKKLGEVGFLGLTVDEEYGGSGGDHLAYCLVTEELGRGDSSVRGIVSVSLGLVAKTIAYWGSEEQKRQWLPGLTSGAYVGCFGLTEPGTGSDAGNLTTRAVRDGDDYVVNGTKMFITNGTWADVVLLFARSTDAPGHKGVSAFLVPTDTPGLTRRPIHGKLGLRGQATAELVLEDVRVPASAMLAPEGKGFSVAMSALAKGRMSVAAGCVGIAQAALDVAVKYATEREQFGKTIAHHQLVQELISDIAVDVDAARLLTWRVADLVDRGQPFATASSQAKLFASEAAVRAANNALQVFGGYGYIDEYPAGKLLRDARVMTLYEGTSQIQKLLIGRALTGVSAF

SEQ ID NO: 5720 - DNA, 2022 bp, Streptomyces avermitilis
  CDS (1)..(2022)
atgatcgctacgacgttcgaggccggcccggtcgccacgggacacccggtcgccgaccacctggcacacctgctcttcgaggggaccggccgcgagcggacgcacggcacctggcgcaggctgatctccggccgggagttctcgtaccggcccggcctggcccccgccgagcgcaccgcactctcgtacgaccggctgcggctgctcaacgacaccgtcgacgacccggtgcggctcgccgccgacccgcaccggctggccgcgctgcacgagtggatcgggccggtcgacgggggcctgaccacgttggcgagcatccactacaacctgttcctcggcagcctcgtggaccacgacgacaacgggcgcgacctgtccgccttcaccaccctccagcaggtcggaacgtttctctgcaccgaactggagcacggcaacgacgtggcggccatggagaccgtggcggtcttcgaccgcgcgagcggcggcttccatctgcacacaccgacgccgggcgcgcagaagttcatgcccaacacgagcacgacgggcggccccaagagcgcggtggtcgccgcccggctcgtcgtcgacggccgggacgagggcgtcttcctcttcctgaccccgctcggcgaccggtccggcctcctgccgggcgtacgggtccgcccgctgccggagcgcacgggcaccccggtggaccacgccctcaccgccttcgaccacaagtggctgccgcgcgaggcgcttctggaggccgcccacggacgactcgcccccgacggcaccctgaccagcaccctcggcaacaggcgcaaacgcctcctgcgctccatcaaccgcgtcaccatgggaaagctgtgcatgagcgccggcaccctgggcatggcgcgcgccgcgctgaccatcgcggtccgctacgcccacagccgcctcgtgacgggcccgcgggccggggagcggataccggtcgccgcccaccgcagccaccatggccggctgctcgacgcgctggcgacggcgtacgcgatgaccttcctgcaccgcacggtggtggaccgtttcgcggcacgcaccgaggaggaccgggaggaggtcgagcggctgacggcggtcgccaaggggtggatcacctggcaggcgcgggcgatcaccaccgagtgccgcgaacgctgcggcgcccagggcctgttcccggccaacggcatctccgacctggcgtcgaacatcgagggcggcatcaccgccgagggcgacaacctggtgatctgggtgaaggcggcggcggagatggtcttcggccacgacacgacggcccgcacccgggccggggcccccgccgcacccaacagctccgccgcactctccgcgcccaaccgccccgccgcgcccgccactccctccgcacccggcgcacccgccactcccggcgctcccggcgctcccggcgctcccggcgctcccggcgctcccggcgctcccggcgctcccggcgctcccggcgccacgctcgccgacccggccttcctgcgcggtctgctcgccgaggcggaggcgatctggcaggcacgggcccgcgccgacctgcgtgacggcccggcgggcgatccggtcggccggtggaacggcacgtcgaccgccgccctcgaaatggtctccgcgcacgcccgtctccaggccgccgacgcgctcatcgccgcggccgagcgggcgacggaccccacggcgcgcttcctgctgcgctccctgtgccggctgttcctgctccgccggctccgcgaccacaccggtgacctgctcgccgagggccatctgacggcggaccacgtacgggcgctgccgagggccctcgacagcgtgtacgacgacctggccccgcacctgatgacgctggtcgacgcgttcgacttcccggccgagatgctctccgcgatccccatcgccagcggcggcacgatcgtccgcacgctggagcagtcggcggaggaatggccactggtctcgccggcctccccctga

SEQ ID NO: 5721 - protein, 673 aa, Streptomyces avermitilis
MIATTFEAGPVATGHPVADHLAHLLFEGTGRERTHGTWRRLISGREFSYRPGLAPAERTALSYDRLRLLNDTVDDPVRLAADPHRLAALHEWIGPVDGGLTTLASIHYNLFLGSLVDHDDNGRDLSAFTTLQQVGTFLCTELEHGNDVAAMETVAVFDRASGGFHLHTPTPGAQKFMPNTSTTGGPKSAVVAARLVVDGRDEGVFLFLTPLGDRSGLLPGVRVRPLPERTGTPVDHALTAFDHKWLPREALLEAAHGRLAPDGTLTSTLGNRRKRLLRSINRVTMGKLCMSAGTLGMARAALTIAVRYAHSRLVTGPRAGERIPVAAHRSHHGRLLDALATAYAMTFLHRTVVDRFAARTEEDREEVERLTAVAKGWITWQARAITTECRERCGAQGLFPANGISDLASNIEGGITAEGDNLVIWVKAAAEMVFGHDTTARTRAGAPAAPNSSAALSAPNRPAAPATPSAPGAPATPGAPGAPGAPGAPGAPGAPGAPGAPGATLADPAFLRGLLAEAEAIWQARARADLRDGPAGDPVGRWNGTSTAALEMVSAHARLQAADALIAAAERATDPTARFLLRSLCRLFLLRRLRDHTGDLLAEGHLTADHVRALPRALDSVYDDLAPHLMTLVDAFDFPAEMLSAIPIASGGTIVRTLEQSAEEWPLVSPASP

SEQ ID NO: 5722 - DNA, 1863 bp, Dictyostelium discoideum
  CDS (211)..(1863)
attaaaaaacatttagatgttaatagtcaaacaacaaataataaaaatgaagtattagaaaaagaattatttaattcaattgatgcaaatataaatgttggagaattaaaattattaattgattcagttgaagcaagtaaatataaggatgcagcaagagaattcattagaaatcatccaaaattcaaagagaatttcattggattggatatggctacctatagacaattagtacttgaacaatgtgttgctgttgcaaatagtggattaattcatttgactgatattaagaataaccttcacagatatgctggtgttgtagaaatgttttcattgtataataacaatgtttgtaccaaattgggtgttcattatacattatttggaggtacaatcatgtttttaggtacctcaagacatgagaaatatattgaagatgctaataccctcaagacaatgggttgctttgcaatgacagagattggtcatggttcaaatgttcgtggtattgaaactactgcacattacgataaacaaactaaagagtttatcattcattcaccaacaccaacaagtgaaaagttttggattggtggttcttatcttcatgctacctacactactgttttcgcaaacttaatcattgatggtacaaattatggtgttcatgcattggttgtaccacttcgttgtccaaagagtggtgcaatcatgaaaggtatcaccattaaagattgtggtcataagttaggtttgaatggtattgataatggtcaaattcgtttcgatcaagttcgtatcccaagagagaaccttttaaacaaatatagtgatgttagcgaagacggtgtttacaagagtcaattcaatacaccaataaagaatttcgctgcaacaatggcaccattcattgttggtagaatggcaatcactaaaggttgttcaggtgctgccaaaacctccctctctattgctattgaattctcacatattagaaaacagtttggtccatctgcaaataatgagcttccattgattactctcagttcacaacaacgtcgtcttatggcaccattggcaagaaccatcttgtttgatctttacattcaacgtttaaccaatgaattatgtcaagagaaattaccagcttcaatccatgcccattgctcaggtatcaaagcagtttacagttggttctgtgttgcagcactccaaacttgtcgtgaagcttgtggtggtcaaggttaccgttcagcaaatcgtatagctgaatttaaaaatgattgtgatatcgtttgtacatatgaaggtgataatactgttctcatgcaacaattggccaagtatttattaggtgtaaaacaaaaacaaacaaataccactaccaatcgtatctatttagatggtgaagatgccaaatcgttattattcaatttttcaaatattaatcaattatttgaaactagagaagagattcgtttggccgaattaaaacaaatcattagcaactctaaagaacctgcttatttcgcttttaacaatgcaattccatgggctgtcaaattaggttttgctcacatgactaaaatcgttttccaaaactctatcaatacattaaaacttaaaaacgttaaaccattagctcatttaattatgttggacgctcttgtctccattgaagaagatttaggttggttcgtttcaaatcacttaatctcaccaaatgttgctcaatcaatcccattcttaattcaagatctttgttttgaagttaccaaagtttcaaaacaaatcattgcttcatttgatattcctgaaaattgtaaaccatcgtcaaaagatttaatttctgatcttttttaa

SEQ ID NO: 5723 - protein, 550 aa, Dictyostelium discoideum
MATYRQLVLEQCVAVANSGLIHLTDIKNNLHRYAGVVEMFSLYNNNVCTKLGVHYTLFGGTIMFLGTSRHEKYIEDANTLKTMGCFAMTEIGHGSNVRGIETTAHYDKQTKEFIIHSPTPTSEKFWIGGSYLHATYTTVFANLIIDGTNYGVHALVVPLRCPKSGAIMKGITIKDCGHKLGLNGIDNGQIRFDQVRIPRENLLNKYSDVSEDGVYKSQFNTPIKNFAATMAPFIVGRMAITKGCSGAAKTSLSIAIEFSHIRKQFGPSANNELPLITLSSQQRRLMAPLARTILFDLYIQRLTNELCQEKLPASIHAHCSGIKAVYSWFCVAALQTCREACGGQGYRSANRIAEFKNDCDIVCTYEGDNTVLMQQLAKYLLGVKQKQTNTTTNRIYLDGEDAKSLLFNFSNINQLFETREEIRLAELKQIISNSKEPAYFAFNNAIPWAVKLGFAHMTKIVFQNSINTLKLKNVKPLAHLIMLDALVSIEEDLGWFVSNHLISPNVAQSIPFLIQDLCFEVTKVSKQIIASFDIPENCKPSSKDLISDLF

SEQ ID NO: 5724 - DNA, 1866 bp, Dictyostelium discoideum
  CDS (214)..(1866)
ataaaaaaacatttagaagttaataatagtcaaacaacaaataataaggatgaagttttagaaaaagaattatttaattcaattgatacaaatattaatgttggagaattaaaattattaattgattcagttgaagaaagtaaatataaggatgaaacaagagaattcattagaaatcatccaaaattcaaagagaatttcattggattggatatggctacctatagacaattagtacttgagcaatgtgctgcaattgcaaatcgtggattaattcattttactgatattaagaataaccttcacagatatataggcgctttagaaatgtttgcattgtataataataatattttaacgaaattgagtgttcaatatacattatttggaggtccaattatatttttaggtacctcaagacatgagaaatatattgaagatgctaataccctcaagacaatgggttgctttgcaatgacagagattggtcatggttcaaatgttcgtggtattgaaactactgcacattacgataaacaaactaaagagtttatcattcattcaccaacaccaacaagtgaaaagttttggattggttgcgcttatcttcatgctacctatgctgtagttttcgcaaacttaatcattgatggtacaaactatggtattcatgcatttattgtaccacttcgttgtccaaagagtggtgcaatcatgaaaggtatcaccattaaagattgtggtcataagttaggtttgaatggtattgataatggtcaaattcgtttcgatcaagttcgtatcccaagagagaaccttttaaacaaatatagtgatgttagcgaagatggtgtttacaagagccaattcaatacaccaataaagaatttcgctgcaacaatgtcaccattcatcgttggtagaatggcaatcactaaaggttgttcaggtgctgctaaaacctccctctctattgctattgaattctcacatattagaaaacaatttggcccatcttcaaataaagagcttccattgattactctcagttctcaacaacgtcgtcttatggcaccattggcaagaaccatcttgtttgatctttacattcaacgtttaaccaatgaattatgtcaagagaaattaccagcttcaatccatgctcactgctctggtatcaaagcagtttacagttggttctgtgttgcagcactccaaacttgtcgtgaagcttgtggtggccagggttaccgttcagcaaatcgtatagctgaatttaaaaatgattgtgatatcatttgcacatatgaaggtgataacactgttctcatgcaacaattggccaagtatttattaggtgtaaaacaaaaacaaacaaataccactaccaatcgtatctatttagatggtgaagatgccaaatcgttatttttcaatttttcgaatataaatcaattatttgaaactagagaagagatgcgtttggccgaattaaaacaaatcattgacaactctaaagaatctgcttatttcgcttttaacaatgcaattccatgggctgtcaaattaggttttgctcacatgactaaaatcgttttccaaaactctatcaatacattaaaacttaaaaacgttaaaccattaactcatttaattatgttggatgctctcgtctccattgaagaagatttaggttggttcgtttcaaatcatttaatctcaccaaatgttgctcaatcaatcccattcttaattcaagatctttgttttgaagttactaaagtttcaaaacaaattatcgcttcatttgatattcctgaaaattgtaaaccatcatcaaaggatttaatttctgatcttttttaa

SEQ ID NO: 5725 - protein, 550 aa, Dictyostelium discoideum
MATYRQLVLEQCAAIANRGLIHFTDIKNNLHRYIGALEMFALYNNNILTKLSVQYTLFGGPIIFLGTSRHEKYIEDANTLKTMGCFAMTEIGHGSNVRGIETTAHYDKQTKEFIIHSPTPTSEKFWIGCAYLHATYAVVFANLIIDGTNYGIHAFIVPLRCPKSGAIMKGITIKDCGHKLGLNGIDNGQIRFDQVRIPRENLLNKYSDVSEDGVYKSQFNTPIKNFAATMSPFIVGRMAITKGCSGAAKTSLSIAIEFSHIRKQFGPSSNKELPLITLSSQQRRLMAPLARTILFDLYIQRLTNELCQEKLPASIHAHCSGIKAVYSWFCVAALQTCREACGGQGYRSANRIAEFKNDCDIICTYEGDNTVLMQQLAKYLLGVKQKQTNTTTNRIYLDGEDAKSLFFNFSNINQLFETREEMRLAELKQIIDNSKESAYFAFNNAIPWAVKLGFAHMTKIVFQNSINTLKLKNVKPLTHLIMLDALVSIEEDLGWFVSNHLISPNVAQSIPFLIQDLCFEVTKVSKQIIASFDIPENCKPSSKDLISDLF

SEQ ID NO: 5726 - DNA, 1986 bp, Mus musculus
  CDS (1)..(1986)
atgaatcccgatctgcgcaaggagcgggccgccgccaccttcaatccagagttaatcacgcacatcttggatggtagtccggagaacacccggcgccgtcgagaaatcgagaacttgattctgaacgatccagacttccaacatgaggactataacttcctcactcgaagccagcgttacgaggtggctgttaagaagagtgccaccatggtgaagaagatgagggaatttggcatcgcagaccctgaagaaatcatgtggtttaaaaactctgtgcaccgagggcatcctgagcctttggaccttcacttgggcatgttcctgcccaccttgcttcaccaggccaccgaagagcagcaggagcgtttcttcatgccggcctggaatctggagatcacgggcacttatgcgcagacagagatgggtcatggaactcatcttcgaggcttggaaaccactgccacatatgaccccaagacccaagagttcattctcaacagcccaactgtgacttccatcaagtggtggcctggggggcttgggaagacttccaatcatgcgatagtcctggctcagctcatcactcgaggggagtgctacgggttacatgcctttgttgtccctatccgtgagattgggacccacaagcctctgccaggcatcactgttggggatatcggccccaagtttggttatgaagagatggataatggctacctgaagatggacaattaccgtattcctagagagaacatgttgatgaaatatgcccaggtgaagcctgacggcacgtatgtaaaacctctgagtaacaagctgacatatgggaccatggttttcgtaaggtccttcctcgtgggaagtgcagctcagagtctgtccaaggcatgcaccattgccattcgatacagtgctgtgaggcgccagtctgaaatcaagagaagcgagccagagccccagattttggattttcagacgcagcagtataaactcttcccgctcctggccaccgcctatgccttccactttctcggaagatacataaaggagacctacatgcggattaatgagagcattggccaaggcgacctgagtgagctgcctgagcttcatgccctcacagctgggctgaaggcttttactacctggacagccaatgctggtatcgaagaatgtcggatggcttgcggtgggcacggctattctcacagcagtgggattccaaatatttacgtcacgtttaccccggcctgcaccttcgagggggagaacactgttatgatgctgcagacggccaggttcttgatgaaaatctatgaccaggttcagtcggggaagctggtgggtggtatggtgtcgtacttgaatgacctgccgagccagcgtatccagccgcagcaggtggcagtctggccaactctggtggacattaacagcctggacagcctgacagaagcctacaagctacgtgcagccagattggtagaaattgctgcaaaaaaccttcaggcccaagtgagtcacaggaagagcaaggaagtggcgtggaacttgacttctgtcgaccttgttcgcgcaagtgaggcgcactgccactacgtgaccgttaaggtctttgcagataaactccccaagattcaagacagagccgtgcaagccgtgctgaggaacctgtgtctcttatattctctctatgggatcagccagaaaggaggggattttcttgaggggaacatcatcacaggggctcagatgtcacaggtaaacagtcggatcctggagctgctcacagtgactcgccccaacgctgtggctttggtggatgcctttgactttaaggatgtgacccttggctctgttctcggccgctatgatggcaatgtgtatgaaaacttgtttgagtgggccaagaagtccccactgaacaagacagaggtccacgaatcttactacaagcacttgaagcccctgcagtcgaagctttga

SEQ ID NO: 5727 - protein, 661 aa, Mus musculus
MNPDLRKERAAATFNPELITHILDGSPENTRRRREIENLILNDPDFQHEDYNFLTRSQRYEVAVKKSATMVKKMREFGIADPEEIMWFKNSVHRGHPEPLDLHLGMFLPTLLHQATEEQQERFFMPAWNLEITGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGTMVFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVAWNLTSVDLVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHESYYKHLKPLQSKL

SEQ ID NO: 5728 - DNA, 3977 bp, Mus musculus; identical to SEQ ID NO: 5712
  CDS (187)..(2289)

SEQ ID NO: 5729 - protein, 700 aa, Mus musculus; identical to SEQ ID NO: 5713

SEQ ID NO: 5730 - DNA, 2323 bp, Oryza sativa
  CDS (43)..(2052)
gcacgaggttctaacgtggtgtggacaagaaaggaaggaaagatggagggcggcgtagggggggaggtggaccacctcgccggcgagagggccaccgcgcagttcgacgttgaacacatgaaggttgcctgggctggctcccgccacgccgtcgatgtcgccgaccgcatggcgcgcctcgtcgcttccgaccccgtgttccgcaaggataacaggactatgctccccaggaaggagctgttcaaggacacactcagaaaggcagcccatgcgtggaagcgtatcgtcgagctccgtcttacagaagaggaggcaaatttgctaaggctatacgtggaccagcctggttatgttgatctgcactggggcatgtttgttcctgctataaaaggccaagggactgaagagcagcagaagaagtggctacctctggcctacaggttccaaataattggatgctatgctcagactgaacttggtcatggttccaatgttcagggccttgaaacaaccgccacatttgacccaaagactgatgagtttgttatacacagcccgacactgacctctagcaagtggtggcctggtggcttgggaaaagcttccactcatgcagttgtgtatgctcgtctgataactgaaggaaaggactacggcatacatggtttcattgtgcaactacgaagcctagaggaccactctccccttcccggtgttactcttggtgatatcggcggaaaatttggtagtggtgcatacaacagtatggataatggagttctgcgatttgaccatgtgcgcatcccaagggatcaaatgttgatgaggctttcacaagttacgaaagagggaaaatatgtgcactcagatgtcccaaaacagctgctttatgggacaatggtttttgttcgtcaaacaattgttgcagatgcttctaaggctttatcacgtgctacttgcattgctgtaagatacagcgctattcgaaagcagtttggccctcaaactggtggccctgagactcaggtcctcaattacaagactcagcaaagcagactctttcctttgctggcttcagcttatgcatttaggtttgtgggtgagtggctgaagtggctgtacacggatgtcacacataaactggaagccaaggatttctcaacacttcaagaggcccatgcctgtactgctgggttgaaggctgtgacaacatctgcgacagctgatggaattgaagaatgccgaaaactctgtggtggacatggttacctgaacagcagcgggcttcctgaattgtttgctatctatgttcctgcttgcacttatgaaggagacaatgttgttttgctattgcaggttgcaaggtttctaatgaagactgtatcccagttagcttctggaaaacagcctgttggtacaacggcttacatgggcaacatacagtacttgatgcaatgcaaatgtggtgtaaatacagctgaagattggctaaatcctgctgccatacgagaggtatttgaagctcgggctctcaggatggcggtgaattgtgcccagaacataaacaaggcgccaagccaagaagaagggttttatgagctatcccctgatctgcttgaggtggcggtggcccatatccagttgataattgtaaccaagttcatagagaaattagagcaggacatccctggtgagggagtgaaggagcaactgtgcatcctttgcaatgtgtacgcgctgtatcttgttcacaagcatctgggtgacttcctgtcgacggggagcatcacagcaaggcagggagcgctggcaaacgagcagctgggaaagctgtatgcgcaggtgcggccgaacgcggtggcgctggtggacgcgttcaactacaccgaccactacctggggtcggtgctggggcgctacgacggcaatgtttacccggcgctgtacgaggaggcgtggaaggaccccctcaacgacacggatgtgccggacggttaccaggagcacctccgccctctgctcaagcagcagctcaagctctccaggctatgatcatccatccatcatcctccctttcttgctctatcaatcatatcatactgcatacgatttgagtagtagtaaaataacaccagcatatgcaaggtgctggctggctgctagtattttctttttctttataatttatttatttggggagagctggtattgtcttatttatttgggaagagctggtattgtatgtctggtgatttggtatagctgtaactgtgaacttcaccacatctcccccttctcaagggcatatgcattctactcctta

SEQ ID NO: 5731 - protein, 669 aa, Oryza sativa
MEGGVGGEVDHLAGERATAQFDVEHMKVAWAGSRHAVDVADRMARLVASDPVFRKDNRTMLPRKELFKDTLRKAAHAWKRIVELRLTEEEANLLRLYVDQPGYVDLHWGMFVPAIKGQGTEEQQKKWLPLAYRFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTKEGKYVHSDVPKQLLYGTMVFVRQTIVADASKALSRATCIAVRYSAIRKQFGPQTGGPETQVLNYKTQQSRLFPLLASAYAFRFVGEWLKWLYTDVTHKLEAKDFSTLQEAHACTAGLKAVTTSATADGIEECRKLCGGHGYLNSSGLPELFAIYVPACTYEGDNVVLLLQVARFLMKTVSQLASGKQPVGTTAYMGNIQYLMQCKCGVNTAEDWLNPAAIREVFEARALRMAVNCAQNINKAPSQEEGFYELSPDLLEVAVAHIQLIIVTKFIEKLEQDIPGEGVKEQLCILCNVYALYLVHKHLGDFLSTGSITARQGALANEQLGKLYAQVRPNAVALVDAFNYTDHYLGSVLGRYDGNVYPALYEEAWKDPLNDTDVPDGYQEHLRPLLKQQLKLSRL

SEQ ID NO: 5732 - DNA, 2466 bp, Mus musculus
  CDS (152)..(2197)
ccacgcgtccgccaggacagaggtgagtcaagagtttagtcccaggccagccagagaactgacagaacataccaaaggttcttggtacctcccggtgctcagagcagaccctaaaggaagccaagtccttcctgagacaggcagatccaggatggggaacccaggggatcgagtgtcactgggggagacctggagcagggaagtgcaccctgacatagacagtgaaaggcactccccgtccttcagtgtggagcggctcaccaacatccttgatggaggcatcccaaacactgagctgcggagaagagttgaaagcctcatccaacgtgacccagtgtttaatttgaagcatctttacttcatgacccgagatgagctatatgaggatgcagttcaaaagagattccatcttgagaagctagcctggagcctgggctggtcagaagacggtcctgaacgcatttatgctgacagagtccttgctggatataacaacttaaacttacatggtattgccatgaatgctatcagaagcctgggctcagatgagcagattgctaaatggggccaactcggcaaaaacttccaaatcatcacaacatatgcccagacagagctgggacatgggacatacctgcagggcctggagaccgaagcaacctatgatgcaaccacccaggagtttgtgatacacagccctacaatgacttccatcaagtggtggcctggggacttgggacggacagtcacccatgctgtggtcctagcccatttgatctgcttaggagcccggcatggcatgcatgccttcattgtgcccatccggagcctagaggaccacaccccactgccaggaataacagttggggacataggccccaagatgggcttcgaaaacatagacaatggcttcctgcgactgaaccacgtgagggttcccagagagaacatgctcagtcgctttgcagaggtcttgccagatggcacctaccagaggcttgggacaccacagagcaattatcttggcatgttggtgacacgggtgcagctgctgtataaaggattcctacccaccctccagaaggcttgcaccattgctgtgcgctacgcagtaatccgccaccagtctcgtcttcggcctagtgacccagaggcaaaaatcctggaataccagacacagcagcagaaactcctgcctcagcttgctgtgagctatgccttgcatttcatgaccaccagcctcttacaattcttccacagctcctacagtgatattctgaagagagacttcagcctcctgcctgagctccatgcactgagcactggcatgaaggccatgtcttcagacttctgtgcccagggaacagagatctgccgcagggcctgcgggggtcatggctactcaaagctgagcggcctaccgacactggtcactcaagcgatagcctcttgcacgtatgagggtgagaatacggtgctctacctgcaagtggccaggtttctgatgaagagctacctgcaggctcaagtgtccccaggatccataccacagaagcctctccctcagtccgtcatgtatctcgccacaccaagaccagccaggtgcccagcccagacagcagctgacttccgctgcccagaagtctataccacagcctgggcatatgtgtctgccaggctcataagagatgcaacacagcatacacagaccctcatgagatccggggttgaccagtacgatgcttggaaccagacttctgtcatacaccttcaggctgctaaggctcactgctacttcctcactgtgaggaatttcaaggaagctgtggagaaactagacaacgaaccagagattcagcgtgtgcttcagaacctctgtgacctctatgccttaaacggtattctgactaactcaggggactttctgcatgatggcttcctgtctggggcccaagtggacatggcaagaacagccttcctagacctgcttcccttgatccggaaggacgccatcttgttaacagatgcttttgacttctcggaccattgtttaaactctgcacttggctgttatgacggacacgtctaccaacgcctgtttgagtgggctcagaagtccccagccaatactcaggagaaccctgcctataagaagtatattagaccactgatgcaaagctggaaacccaagctgtgaaaagccaaaggattcaggaccaagcagcaccatggccttcctatggcacatatgcatataaagaatttaaagcacggggtggcgtgcggcttgttcagatcagcgagtaaactggtacatgaaaggatgttcatcatattattctgctactgagtacatctgaaactttcccttgtctgtttgtagtacgtatttggctaaatgctagaattttgctttaaatacagcaaaagctaataaacttgttagtaactaaaaaaaaaaaaaaa

SEQ ID NO: 5733 - protein, 681 aa, Mus musculus
MGNPGDRVSLGETWSREVHPDIDSERHSPSFSVERLTNILDGGIPNTELRRRVESLIQRDPVFNLKHLYFMTRDELYEDAVQKRFHLEKLAWSLGWSEDGPERIYADRVLAGYNNLNLHGIAMNAIRSLGSDEQIAKWGQLGKNFQIITTYAQTELGHGTYLQGLETEATYDATTQEFVIHSPTMTSIKWWPGDLGRTVTHAVVLAHLICLGARHGMHAFIVPIRSLEDHTPLPGITVGDIGPKMGFENIDNGFLRLNHVRVPRENMLSRFAEVLPDGTYQRLGTPQSNYLGMLVTRVQLLYKGFLPTLQKACTIAVRYAVIRHQSRLRPSDPEAKILEYQTQQQKLLPQLAVSYALHFMTTSLLQFFHSSYSDILKRDFSLLPELHALSTGMKAMSSDFCAQGTEICRRACGGHGYSKLSGLPTLVTQAIASCTYEGENTVLYLQVARFLMKSYLQAQVSPGSIPQKPLPQSVMYLATPRPARCPAQTAADFRCPEVYTTAWAYVSARLIRDATQHTQTLMRSGVDQYDAWNQTSVIHLQAAKAHCYFLTVRNFKEAVEKLDNEPEIQRVLQNLCDLYALNGILTNSGDFLHDGFLSGAQVDMARTAFLDLLPLIRKDAILLTDAFDFSDHCLNSALGCYDGHVYQRLFEWAQKSPANTQENPAYKKYIRPLMQSWKPKL

SEQ ID NO: 5734 - DNA, 2254 bp, Glycine max
  CDS (119)..(2116)
atgtttcattcactcttctaaccaaacccgaaaacagagtacaagattttaaacacgcgaacaccgtgtttgaaaatcgaacataagaggagagggcgcaatcgttagggtttccaagatggaaggcatggttgatcacctggctttcgagcggaacaattcgcagttcgatgtcgacgagatgaagatcgtttgggccggttctcgtcacgcttttgaagtatctgacaaaatggctcgcctcgttgccagcgatccggcattcagaaaggatgatagagttgtgcttgataggaaggctttatttaagaacactttgaggaaagcagcttatgcatggaaaaggattattgagctccgtctcagtgaagaggaagctgctatgctcagatcctttgtggaccaacctgcttttacggatctacattggggaatgtttgttcctgctatcaaaggacaaggaactgaggaacagcagaagaagtggttgcctttggctcataagatgcaaataattggttgttatgcccaaactgaacttggccatggatctaatgttcaagggcttgaaacaactgcaacctttgatcccagaacagacgagtttgtaattcatagccccacattgacttcaagcaaatggtggcctggtggattgggtaaagtgtcaacacatgccgtggtttatgcccgactaattactgatggccaagatcatggagtgcatggtttcattgtccagctgcggagcctggatgatcacttacctcttccaggcataactgttggtgatattggaatgaaatttggaaatggagcatataactccatggataatgggatgctaaggtttgaccatgtacggattccaagaaatcaaatgttaatgagggtttcacaggtaacaagggaaggaaaatatgtacaatccagtgttccacgacaattagtctatggtactatggtatatgtaagacaaacaattgtatctgatgcgtcagttgctttgtcgcgagcagtttgcattgctacaagatatagtgctgttcgaagacagtttgggtcaaaagagggaggtcttgagacacaggtgattgattataaaacgcagcaagctaggctcttccctttgttagcttctgcctatgccttcagatttgttggtgaatggttgaaatggctttatatggatgtgatgaaaagattgcaagccagtgatttttcaaccttacctgaggctcatgcgtgcactgcagggttgaagtccttgactacttcagcaactgctgatggaattgaggaatgccgcaaactatgtggtggccatggttacctttgcagcagtggtctccctgagttatttgcagtctacattcctacctgcacatacgaaggagacaacactgtgctgcttttacaggtggctaggcatctcatcaagactatttctcagttgggctccagaaacaagcctgttggtacaacatcttacattggacgagtggaacagcttatgcaatatcgttctgatgttcagaaagtggaggattggctgaagcctaatgcagtgttgggagcatttgaagctagggctgctaagaaggtggttgcttgtgctcaaaatctcagcaagtttaccaatcccgaagaaggtttccaagaactctcagtcgatctagttgaggcagctgttgctcattgccagttaattgttgtttccaaatttattgagaagttgcagcaagatatccctggaaagggagtgaaacagcaattagaacttctttgtagcatttacgctttgtttcttcttcacaagcatttgggtgattttcttgcaactggctgcatcactcccaaacagggttcccttgcaaatgagctgctgaggtccttgtattcacaggttcgtcctaatgcaattgcacttgttgatgcgtttaactacactgatcactaccttggttcggttcttggtcgctatgatggagatgtgtatccaaagctgtacgaggaggcatggaaggatccattgaatgattcagttgtgccagatggcttccaagaatatattcgaccaatgctaaagcaacaacttcgtaatgctagactctaaattacttttttataactgcactgttgatactggagaaagttatgtattgctttcaatttaaaagacagtaataaagttctacgaaagggaaacaaatttgacatcaactttgacaaaattgattatgaatagaattga

SEQ ID NO: 5735 - protein, 665 aa, Glycine max
MEGMVDHLAFERNNSQFDVDEMKIVWAGSRHAFEVSDKMARLVASDPAFRKDDRVVLDRKALFKNTLRKAAYAWKRIIELRLSEEEAAMLRSFVDQPAFTDLHWGMFVPAIKGQGTEEQQKKWLPLAHKMQIIGCYAQTELGHGSNVQGLETTATFDPRTDEFVIHSPTLTSSKWWPGGLGKVSTHAVVYARLITDGQDHGVHGFIVQLRSLDDHLPLPGITVGDIGMKFGNGAYNSMDNGMLRFDHVRIPRNQMLMRVSQVTREGKYVQSSVPRQLVYGTMVYVRQTIVSDASVALSRAVCIATRYSAVRRQFGSKEGGLETQVIDYKTQQARLFPLLASAYAFRFVGEWLKWLYMDVMKRLQASDFSTLPEAHACTAGLKSLTTSATADGIEECRKLCGGHGYLCSSGLPELFAVYIPTCTYEGDNTVLLLQVARHLIKTISQLGSRNKPVGTTSYIGRVEQLMQYRSDVQKVEDWLKPNAVLGAFEARAAKKVVACAQNLSKFTNPEEGFQELSVDLVEAAVAHCQLIVVSKFIEKLQQDIPGKGVKQQLELLCSIYALFLLHKHLGDFLATGCITPKQGSLANELLRSLYSQVRPNAIALVDAFNYTDHYLGSVLGRYDGDVYPKLYEEAWKDPLNDSVVPDGFQEYIRPMLKQQLRNARL

SEQ ID NO: 5736 - DNA, 2263 bp, Glycine max
  CDS (140)..(2134)
agagaaaaatggggtggcaaagggacctactaagttttataacccagagatccatgctgctgcattctgtctgtaacacaatacaatcatcattcatcaaatcactgaaaccaaagccacaagctgcgacatcagaagaatggaagacggtgttgaccacttggctttcgagaggaacaaggcgcagttcgatgttgaggacatgaaaatcatttgggccggttctcgtcaagactttgagctttcggatcgaatttctcgccttgttgccagcgatccggcgttcagaaaggatgatagaacacgcttgataggaagattgtttaaaaacaccttgagaaaagcagcttatgcatggaaaaggatcaacgagctccgtcttaatgaacaggaagcttataagctcagatcttttgtggatcaacctgcatttacggatcttcattggggaatgtttgtgcctgctatccaaggacaaggcactgacgaacagcagcagaagtggttgcctctagcttatgggatgcaaataattggttgctatgcccaaactgaactgggtcatgggtccaatgttcaagggctagaaacaactgcaacgtttgatcccaaaacagacgaatttgttatccatagccccacattgacttccagcaaatggtggcctggtggattgggtaaaatatccacccatgctgttgcttatgcccgtctaattattggtggtgaagaccatggagtgcatggtttcatcgtccagctgcggagcttggatgatcacttgcctcttccaggcataactattggtgatattgggatgaaatttggaaatgcagcttataacaccatggacaatggagttctaagatttgaccatgtacgaattccaaggaatcaaatgttaatgagggtttcacaggttaccagagaaggaagatatgtaagctcaaatgttccaagacaattagtttatggtactatggtaaatgtgagacagaaaatcgtagctgatgcatcagttgctttgtctcgagcagtttgcattgctacaagatatagtgctgttagaagacagtttggatcacataatggaggtctagaaacacaggtgattgattacaaaacacagcaggctaggctcttccctttgctggcttctgcttatgctttcagatttgtgggtgggtggctgaaatggctttatatggatgtgacggaaagattgcaagctaatgatttttcaacattgcctgaggctcatgcatgcactgctggattgaaatccttgactactacagcaactgctgatggaattgaagaatgccgtaaactatgtggtggtcatggttacctttgtagcagtggtctccctgagttatttgctgtttatgttcctgcctgcacgtatgaaggagacaatgttgtgcttctgttacaggtggcaaggcatctcatgaagactgtttctcagctgggctctggaaataagcccgttggtactacagcttatatggctcgagtggaacaactgatgcaatatcactctgatgttgaaaaggctgaggattggttgaagcctaatgtagtgttggaagcatttgaagctagggcttctaggatgtcagttgcttgtgctcaaaatcttagcaagtttgctaaccctgaagagggttttcaagaactagctgctgatttagttgatgccgcggttgctcattgccagttaattgttgtttccaaatttattgagaagttgcagcaagatatacctggaaagggagtgaaaaagcaattagaagttctttgcagcatttatgctttgtttctacttcataaacatctgggtgattttctttccactggctgcattaacccaaaacaaggatcacttgcaagtgagcagctgagaaacttatattcacaggtccgtcctaatgcaattgcgcttgttgatgcatttaactacactgatcactaccttggttcaattcttggacgttacgatggaaatgtgtatccgaagatgaacgaggaggcatggaaggatcctttgaatgattcagttgttcctgatggctttaaagagtatattcaaccgatgcttaagcagcaactacgtaatgctaggctgtagttaattttgtggcaatgatgcttttggcatctaagaaatttacccagactattctgatttacaactcttaataaagttgtgtttgccagctagtaattaccatcgcaattaggtgtatctggaactgga

SEQ ID NO: 5737 - protein, 664 aa, Glycine max
MEDGVDHLAFERNKAQFDVEDMKIIWAGSRQDFELSDRISRLVASDPAFRKDDRTRLIGRLFKNTLRKAAYAWKRINELRLNEQEAYKLRSFVDQPAFTDLHWGMFVPAIQGQGTDEQQQKWLPLAYGMQIIGCYAQTELGHGSNVQGLETTATFDPKTDEFVIHSPTLTSSKWWPGGLGKISTHAVAYARLIIGGEDHGVHGFIVQLRSLDDHLPLPGITIGDIGMKFGNAAYNTMDNGVLRFDHVRIPRNQMLMRVSQVTREGRYVSSNVPRQLVYGTMVNVRQKIVADASVALSRAVCIATRYSAVRRQFGSHNGGLETQVIDYKTQQARLFPLLASAYAFRFVGGWLKWLYMDVTERLQANDFSTLPEAHACTAGLKSLTTTATADGIEECRKLCGGHGYLCSSGLPELFAVYVPACTYEGDNVVLLLQVARHLMKTVSQLGSGNKPVGTTAYMARVEQLMQYHSDVEKAEDWLKPNVVLEAFEARASRMSVACAQNLSKFANPEEGFQELAADLVDAAVAHCQLIVVSKFIEKLQQDIPGKGVKKQLEVLCSIYALFLLHKHLGDFLSTGCINPKQGSLASEQLRNLYSQVRPNAIALVDAFNYTDHYLGSILGRYDGNVYPKMNEEAWKDPLNDSVVPDGFKEYIQPMLKQQLRNARL

SEQ ID NO: 5738 - DNA, 2549 bp, Drosophila melanogaster
  CDS (337)..(2346)
atggcgtgagaataatggttgtgctacagactatttcaacacaaaagcgaacttattacatgtgtattttcgcggttaaagttcacgtcgttcgagagctggcatcgatgattagattcggaatagctggatcagatcagcagtccataatctcaatctcctccactggatttcctccaccagcacttgagtgaccgactgactgaccactgagcgcaattcgcctttccagcaacaatcagtcagtacgcgatattcaacgaagacggacgctttgcggtggctcgttaatccataacctgtttacgtgacttgaatactgtgccgcatagcaaaatgccagccaaaccagtgaatcccgatctccagaaggaacgcagcacggccaccttcaatccccgggagttctccgttctgtgggccggcggcgaggagcgattcaaggagaagaaggccctggagaaattgtttttggaggatccagcccttcaggacgacttgcccatttcctatttgtcacacaaggagctctatgagcacagcttgcgcaaagcctgcatcataggagagaagatccgcaagctacgtgctgatggcgaggatggagtggatacttacaatgctctgcttggtggatccttgggatcggctattctaaaggagggcaatccgcttgcgctgcactacgtgatgttcgtgcccaccatcatgggccagggaacgatggatcagcaggtggaatggctgagcaaggcctgggactgtgaaatcattggcacctatgcccaaacggaactgggacacggaaccttcctgcgcggtctggagaccagggctgactacgatgccagcacccaggagtttgttataaacactccatcactcagtgcatacaagtggtggccctgtggattgggacacactgctaaccatgcggttgtggtggcacaactctacaccaagggcgagttccgtggtctggctccttttattgtccaattgagggattccgatactcaccgtcccatgcccggcatcgacattggagatattggtaccaagctgggcatgaagggtgtcaacaatggctatttgggactgaagaacgtacgggtgcctttaaacaacatgctgatgaagaaccagcaagtgctgcccgatggcacatatgtggcgccgaagaatagcgtgcttacctacggaactatgatgtttgtgcgttgtgctcttatccgtgataccgctcagagcctggcaaaggcatccactattgccactaggtattcagctgttcgccgacagagtcccattgatcccaatcaaccggagccccaaatcatggaccataccacgcagcagttgaagttgttcccccagatagctaaagccatcgttttcaaaacgacgggtgatggcatctggaatatgtacaacgtgatatctggcgagattgagcagggtaacttggatcgcctgcccgaaatgcatgcattgtcctgctgccttaaggccatctgtagtgccgatgccgccgccggcgtggaaacgtgtcgtctgtcatgtggcggacatggctacatggactgctccaacttccccacgatatacggcatgaccacggccgtttgcacctatgagggcgagaacacagtgatgctgctgcagactgctcgctatttggtgaaggtttatgggcaggccttgaatggagagaagctggtgccaacggtttcgtacatcagtgatgcaataaaccaaaccaagtttgttaactttgacggatcattgaggtctattgtcaaggctttccaattcgttgccgccaacaaaacccgaattgcctatgagcagattgaactgcgccgcaagcaaggttatggtaccgaggtggcagctaatctatgtggcaccttcctaacagcagctgcagatcttcatggacgcgccttcctagcgcagactgcctatacggagcttttggccttgtcgcgcgaggtgtccccagaactagctgaagtcctaaaggtggtgctggagctgtatctggtagacgcctgcctcaaccgcattggcgacttcttgcggttcattgatctcactgatcaagatgtcacgaaactggaggttcgcctggagaactgcttaaaacgattccggccgaatgccgtcagcttggtggacagctttgatcttcacgatcgcgtgctagattccgcattgggtgcctatgatggaaatgtttacgaacacatcttcgagtctacgaagaagaacccgttgaacaaggagccagtcaacggagcattccacaagtacttgaagccattcatgaaggctcacctctagattcatatcctattgctctggaagattttcacaagtgttattattgtaaatatacatttgtttccattgtttttgtattatacaactgtctgcttagcaaatggtctttaagacaattatgatgtcagggcttgtgcagttgaaactaggctgtaaaattatacacaaataaaatattcaactataaaaaaaaaaaaaaaaaa

SEQ ID NO: 5739 - protein, 669 aa, Drosophila melanogaster
MPAKPVNPDLQKERSTATFNPREFSVLWAGGEERFKEKKALEKLFLEDPALQDDLPISYLSHKELYEHSLRKACIIGEKIRKLRADGEDGVDTYNALLGGSLGSAILKEGNPLALHYVMFVPTIMGQGTMDQQVEWLSKAWDCEIIGTYAQTELGHGTFLRGLETRADYDASTQEFVINTPSLSAYKWWPCGLGHTANHAVVVAQLYTKGEFRGLAPFIVQLRDSDTHRPMPGIDIGDIGTKLGMKGVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIAKAIVFKTTGDGIWNMYNVISGEIEQGNLDRLPEMHALSCCLKAICSADAAAGVETCRLSCGGHGYMDCSNFPTIYGMTTAVCTYEGENTVMLLQTARYLVKVYGQALNGEKLVPTVSYISDAINQTKFVNFDGSLRSIVKAFQFVAANKTRIAYEQIELRRKQGYGTEVAANLCGTFLTAAADLHGRAFLAQTAYTELLALSREVSPELAEVLKVVLELYLVDACLNRIGDFLRFIDLTDQDVTKLEVRLENCLKRFRPNAVSLVDSFDLHDRVLDSALGAYDGNVYEHIFESTKKNPLNKEPVNGAFHKYLKPFMKAHL

SEQ ID NO: 5740 - DNA, 2371 bp, Homo sapiens
  CDS (79)..(1953)
cgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacaccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtcaaaaaaaaaaaaaaaa

SEQ ID NO: 5741 - protein, 624 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRAERRCSCPGRRDRSS

SEQ ID NO: 5742 - DNA, 2844 bp, Mus musculus
  CDS (209)..(2107)
gctctttgggcttgggccctctggcttctgtttgtcctggaaccctggcttttcctagcaggctgtgacaggctaccctgggatcttggtctgtgtgctgcttttggcaggagtctttgtcccagctccagccccatgcacttggatgctggccacttggccaggccagccctggccccatgggatcctgtggaagagttgagcagagatgacaggatggagtggactgtttatagaagtccctctgtatagattggcatccaaagtgtgctgtcatctgcggggaccacagggatttcttcagagagcctgccagggagtgtgttgtctgccaagggactccagagcagctggaatcatggaagaaaaaaggaagagcttcatcagccaaatccttatcctgggagaagtgctctgcatggtggatgtgtccatgtctataaagtgtggaatcctttttttgttatttggtggtgcaatcagcaatcttggaagtcctgaacatgttaccaagtggttttggccactcaaggagcagaagtatactgggatgtttgcaatgactgagaggggccatgggagcaacgtgagagggatccagactgaggccacctttgacctcgacaatcaggagtttgtgattgacatgccgtgtgagaacgcccacaagatgtacatcggcaatgccatgcatgggaactacgctgctgtcttcgcccaactcatcattgagggaaagtctcaagggccccactgttttattgtccctatcagggatgaaaatggaaacttgtacccaggagtgacagctattgacatgatgcacaaagagggtatgaatggtgtggataacggaattttgatatttgacaaggttcggattcccagagagaacctgctggataagtttggttctgtgactccagatggacaataccattcacctattcaaagcaagaacgcaagattcaatgcgatcctggcaacactgactccttcaagactagcagtgactttccaagctttgggcgccatgaagcttggactgatgatagccatccgctacagccacagccgaaggcaatttgggcccaaggacaaggaagaagtgaagatcattgagcaccaaatgcaggcactcaggctgatgtctcacctggccacagccctggccgtgaccttcacaagcaggcatgcagacgacatcctggatgaagacatcttccagggaagggcgctcaccaacagtcgctcgctacaggcactgatggctggactgaaagcctacagtacatgggagactgttagctgcctacaggactgtcgtgaatgcaccggaggcatgggttacatgatggaaaccagaatctcagacctgaaatgtgacacagatgtgtttgtaacctttgaaggtgacaatgtggtcatgcttcaggttgtggcccgggaactgctggcccagtacagcaagcagcataagaaaaacctgctcttgggtgtgatccagaactggacagcaactgccggggacaagctgagaaccagtttcctggcgtttaacactgacacggtaggatgtcttgcctttctgctgaaagcagtgaattttcgagaaagggttcttcagcggagtttggtgtccagaatttactataaggtggtgaccaagaagggggacttcttcagtgcctggaactcctgtatgcaccatgtcacctcattgtctctggcacacattcacagagttgcactagagcagttcacgacggcagtgaggcaatgtcccaacagggaggaccaggctttgctaatgaagttttgtctgctgtatggaacgaagctggtgttccaggagcgaggctggtacttagaacataaatacctgacccccaaggccagcatgctgatcagggctcagttgctgaatttgtgcgagtccgtgaaggatgacgccctgaaggtgatctctgccttcaacattccacacatcaccatccgtgcaccaaaaacaggaatccccaaccccggggctgccgaggccgcctacccggcacccatgcaaccgctcgtgcgggatgcggcgcgcgctcaactggccaagctgtgagccaggcgagaaatttagtgtcccatcttccaagtatttggccagagctggagcagaggccaaagtggcaggtgcagggcagccaccttggggattttggtctggcagaggaggtccagctaaggctggcgaggagcagggcaagttgtccgggagagggagccatagatggataccccactatcacagtgacttagcctggtttgtagcctcgcctggcctttaccttgacttctcccagccatggccctggatcccccagacaatcgtcttcgcccaccgcatggtgccaccaaagatctctactgtcagtggtgactcatattcccagagacttcgaaaagctctggcgctgggttaaaaaaaaaaaaatcaaaacataaaaatcaaacacccttaggcaaaaggggtggaggaaagctccaccctctccaagctcgggcaaaagttcagcgagggatgattcgtgaatcaggcttgctccagctttgcgaggaaatgcactggcgagagcggagagcttgagcctgcagtcgccctagtctcaccaggtaggtgatctccggaccgcacgaccatgcgcgacaaacgctcctccgcgctaaactgttaccaacccttcagaaaagcatagatgtgcaaagattaataaataatagaaagatgctcccgcggcttggagaggtagggctggctggcctggggaataattggaataaagtgattttggaatttgg

SEQ ID NO: 5743 - protein, 632 aa, Mus musculus
MTGWSGLFIEVPLYRLASKVCCHLRGPQGFLQRACQGVCCLPRDSRAAGIMEEKRKSFISQILILGEVLCMVDVSMSIKCGILFLLFGGAISNLGSPEHVTKWFWPLKEQKYTGMFAMTERGHGSNVRGIQTEATFDLDNQEFVIDMPCENAHKMYIGNAMHGNYAAVFAQLIIEGKSQGPHCFIVPIRDENGNLYPGVTAIDMMHKEGMNGVDNGILIFDKVRIPRENLLDKFGSVTPDGQYHSPIQSKNARFNAILATLTPSRLAVTFQALGAMKLGLMIAIRYSHSRRQFGPKDKEEVKIIEHQMQALRLMSHLATALAVTFTSRHADDILDEDIFQGRALTNSRSLQALMAGLKAYSTWETVSCLQDCRECTGGMGYMMETRISDLKCDTDVFVTFEGDNVVMLQVVARELLAQYSKQHKKNLLLGVIQNWTATAGDKLRTSFLAFNTDTVGCLAFLLKAVNFRERVLQRSLVSRIYYKVVTKKGDFFSAWNSCMHHVTSLSLAHIHRVALEQFTTAVRQCPNREDQALLMKFCLLYGTKLVFQERGWYLEHKYLTPKASMLIRAQLLNLCESVKDDALKVISAFNIPHITIRAPKTGIPNPGAAEAAYPAPMQPLVRDAARAQLAKL

SEQ ID NO: 5744 - DNA, 2028 bp, Arabidopsis thaliana
  CDS (1)..(2028)
atgtcggataatcgtgcactccgacgagctcatgttctcgccaatcacatactccaatcaaatcctccatcttcgaacccgtccctgtcgcgcgagttatgtttgcagtactctccaccggagctcaacgagagctatggattcgatgtcaaggagatgagaaaattacttgacggacacaacgtggtggatcgggactggatttatggactcatgatgcagagcaatctgtttaatcggaaggagagaggaggtaagattttcgtgtcgccggattacaatcagacgatggagcagcagcgtgagatcacaatgaaacggatctggtacttgcttgagaatggggttttcaaaggatggttgacggagacaggtcctgaggccgagctcaggaaattagctctgcttgaggtttgcgggatttatgatcactccgtctccatcaaagttggtgtgcatttcttcctgtggggtaatgctgtaaagttttttggaacaaagcgtcaccatgaaaagtggctgaagaacaccgaagattatgttgtcaagggctgttttgctatgactgagctaggccatggaagtaatgtacggggaattgaaacagtgacaacttatgacccaaaaactgaagagtttgtgataaatactccttgtgaatctgctcagaagtattggattggtggggcagctaatcatgcaacccacacaattgtgttttcacagcttcatatcaacggaaccaaccagggggtccatgcctttatcgcccaaatcagggatcaagatggcagcatatgtccaaatatccgcattgctgactgtggacacaaaattggtctaaatggtgttgacaatggccggatctggtttgataatcttcgaattccaagagagaatttgttgaatgcagttgctgatgtttcgtctgatgggaagtatgttagctcaattaaagatcctgatcagagatttggagcattcatggcccctttgacttctggccgagtcacaattgcatcaagtgcaatttattctgcaaaggtcggattatctattgctataaggtactcattatcgagaagagccttctctgttacagctaatggtcctgaagtcctcctccttgattacccaagccatcaaaggcgactgctaccactcctagcaaagacatatgctatgagttttgctgcaaatgaattgaagatgatttacgtgaagagaacaccggagaccaacaaagccatccacgttgtttcaagtgggttcaaagctgttctcacctggcacaatatgcacacacttcaggaatgtcgagaagctgtcggagggcaaggtgtgaaaacagaaaatctagttggtcagttgaaaggtgaatttgatgtgcagactacatttgagggtgacaataatgtattgatgcagcaggtgagcaaggcgcttttcgctgaatatgtatcgtgtaagaagagaaacaaacctttcaagggactgggattggagcacatgaacagtccacgtcctgtattaccgactcaactcacatcatcaaccctcagatgcagccaattccagacaaatgtgttctgcttaagagagcgagatcttctggagcaatttacttctgaagttgcacagcttcaagggagaggagaaagtcgagaattctctttcctcctgagtcatcaacttgctgaagacttaggtaaagctttcacagagaaagcaatacttcaaaccattttggatgctgaggcaaaactacctactggctcagtaaaggatgtgttgggtcttgtaagatcaatgtacgcattgatcagcttggaagaagatccatcgttgctgcgatatggttacctatctcaggataatgttggagatgtgaggagagaagtttcaaagctctgtggagagcttagaccacacgcgcttgcactcgtcacttcattcggcattccagactccttcttgagtccaattgcattcaactgggtcgaagccaatgcttggtcttcagtttag

SEQ ID NO: 5745 - protein, 675 aa, Arabidopsis thaliana
MSDNRALRRAHVLANHILQSNPPSSNPSLSRELCLQYSPPELNESYGFDVKEMRKLLDGHNVVDRDWIYGLMMQSNLFNRKERGGKIFVSPDYNQTMEQQREITMKRIWYLLENGVFKGWLTETGPEAELRKLALLEVCGIYDHSVSIKVGVHFFLWGNAVKFFGTKRHHEKWLKNTEDYVVKGCFAMTELGHGSNVRGIETVTTYDPKTEEFVINTPCESAQKYWIGGAANHATHTIVFSQLHINGTNQGVHAFIAQIRDQDGSICPNIRIADCGHKIGLNGVDNGRIWFDNLRIPRENLLNAVADVSSDGKYVSSIKDPDQRFGAFMAPLTSGRVTIASSAIYSAKVGLSIAIRYSLSRRAFSVTANGPEVLLLDYPSHQRRLLPLLAKTYAMSFAANELKMIYVKRTPETNKAIHVVSSGFKAVLTWHNMHTLQECREAVGGQGVKTENLVGQLKGEFDVQTTFEGDNNVLMQQVSKALFAEYVSCKKRNKPFKGLGLEHMNSPRPVLPTQLTSSTLRCSQFQTNVFCLRERDLLEQFTSEVAQLQGRGESREFSFLLSHQLAEDLGKAFTEKAILQTILDAEAKLPTGSVKDVLGLVRSMYALISLEEDPSLLRYGYLSQDNVGDVRREVSKLCGELRPHALALVTSFGIPDSFLSPIAFNWVEANAWSSV

SEQ ID NO: 5746 - DNA, 2085 bp, Petroselinum crispum
  CDS (1)..(2085)
atggagtcatcttcatcatctcctctccattccaatccaacggctgagaatgacgatcaaaccaccgcccgacgcatccaacggctctccttacacctcaatcctacactcaccgacaacacgacgatcgagatggtcacgtgcgcggcgcgtgcgaagcttaacgtgaacacgacgcaactaactttattcatgagaggaaagcacagagacttacaggagaaagtgtacgagttttttaggtcaaggcctgatttacaaacgccgattgaaatatcgacggagaagcatagagagttgtgtatgaaacagcttttagcgttggttagagaagctggaataaagccgtttaagtatgttgttgatgatccgtttgtgtattttgctattggtgaagctgctggtagtgttgatgtttctttcggaattaaactcggtgtacagtacagtctttggggaggttctgtgctcaatttgggaacaaagaaacatagagacaagtactttgacgccattgacaatgtcgagtatcctgggtgttttgctatgacagagcttcatcatggatcaaatgttcagggcctccaaactgttgccacatttgatccgctaacagatgaatttgttatcgacacgcccaacgatggagccattaaatggtggattggcaatgctgcagtgcatggaaagtttgctacagtttttgccaagctgatgttgccaactcatgatgcaagaggttattctgatatgggtgtgcacgcctttattgtccccatacgagatatggaaactcatgaaacacttccaggagttgagatacaagactgtggccacaaagttggcctgaatggagtcgataatggagcactgaggtttcgttcagtgagaattccccgagataatcttcttaaccgatttggagatgttgcacgagatggtacatatacaagcagccttcctaccattaacaaacgctttgcagccacactaggtgagcttgttggtggaagggttggtcttgcctattcttcagttggcatcctgaaggtcgctgtcacaatagctactagatattccctatttcgtcagcagtttggccctcccaagcaggctgaaatcagtattttagattaccagtctcatcagcataagcttatgccaatgttggcttcaacttatgcatttcattttgccacactgcttttggtagaaaaatactctgagatgaagaagacccatgacgaagaattggtggcagacgttcatgcactctcagcagggctcaaggcttatgttactgggtatacatcaaaatcattaagtatctgtagagaagcttgcggtggtcatggctatgcagctgtgaatcgctttggtagcctgagaaatgatcatgacatttttcagacttttgaaggggataacactgttcttctacaacaggtagcagctgatcttttgaagcagtacaaggaaaaatttaaaggcggaacacttaccgtcacatggaactacttgagagagtcaatgaatgcatacctctcacaaccaaatccattaacctccaggtgggaaggtgaagatcatcttcgtgatcctaaattccagttagatgctttcaggtaccgaacatctcgattgctgcaaagtgctgctgtgcggcttcagaagcattcaaagaaccttggtggttttggtgcatggaacagatgtttgaatcatctacttactcttgcagagtctcacattgaatctgtcatactcgaaacatttattaaagctgtaaaaaactgtcctgatgcaagttctcgagctgctttgaaacttgtttgtgatctttacgctatggatcggatttggaatgacattggcacttaccgcaatgtggactacatggcaccaaataaagcaaaggcaattcacaagttgacggaatacttgagctttcaggttaggaatatcaccagagaactagtcgatgccttcgatatgccagatcatgtcataagggctcctatcggcaaacagacacctgtagaagcttattcagagtacagacaacatgtaggcttccaaatgtga

SEQ ID NO: 5747 - protein, 694 aa, Petroselinum crispum
MESSSSSPLHSNPTAENDDQTTARRIQRLSLHLNPTLTDNTTIEMVTCAARAKLNVNTTQLTLFMRGKHRDLQEKVYEFFRSRPDLQTPIEISTEKHRELCMKQLLALVREAGIKPFKYVVDDPFVYFAIGEAAGSVDVSFGIKLGVQYSLWGGSVLNLGTKKHRDKYFDAIDNVEYPGCFAMTELHHGSNVQGLQTVATFDPLTDEFVIDTPNDGAIKWWIGNAAVHGKFATVFAKLMLPTHDARGYSDMGVHAFIVPIRDMETHETLPGVEIQDCGHKVGLNGVDNGALRFRSVRIPRDNLLNRFGDVARDGTYTSSLPTINKRFAATLGELVGGRVGLAYSSVGILKVAVTIATRYSLFRQQFGPPKQAEISILDYQSHQHKLMPMLASTYAFHFATLLLVEKYSEMKKTHDEELVADVHALSAGLKAYVTGYTSKSLSICREACGGHGYAAVNRFGSLRNDHDIFQTFEGDNTVLLQQVAADLLKQYKEKFKGGTLTVTWNYLRESMNAYLSQPNPLTSRWEGEDHLRDPKFQLDAFRYRTSRLLQSAAVRLQKHSKNLGGFGAWNRCLNHLLTLAESHIESVILETFIKAVKNCPDASSRAALKLVCDLYAMDRIWNDIGTYRNVDYMAPNKAKAIHKLTEYLSFQVRNITRELVDAFDMPDHVIRAPIGKQTPVEAYSEYRQHVGFQM

SEQ ID NO: 5748 - DNA, 2464 bp, Drosophila melanogaster
  CDS (80)..(2161)
gttataagcagctccactgatccgataacattgccatttcctttcttcttcaagaaatcaaatcaaacaaaatcacacaatgggcagcgaggacacaagctttattcccgatcttcccagcggtggaccattggccgtttacaggaagagggccaacttcgactggaagcgattgcgactgatattcgagaaggagcagggattgcgaattaagtacaaagtgtggcgtcgcctggagaatgaccccctttttgcccacccatcccgcacactgcccatggacgagcagaagcgcctgtgcgccatgcaggtgaatcgcatgaagcacttggacctggtgcccaaggagatcgagagcctgagcttctcggccaaaacaaagtatctgatgtacatcaacgaggcgctcgcctgctactcgcccagtttgtcggtgaagatagccctaggcgtgggcctgtttaacaatgccattcgtgccatgggaaccgagaagcaccagaaatatattgaggcagcctggaatcgggaggttatcacctgcctggccatcacggagctatcgcatggcagcaacacgaagagcatccggacaacggccacctatgatccgaccacccaggagtttgtgatcaatacgccggacttcgaggcggccaagtgttgggtgggaaatctgggtaaaacggccacggtggccatgacttttgccaatctctacacagctgatggccagaatcatgggctccacggcttcctgattcccattcgcgatcccaagacactgctctcatatcctggagttctggtcggcgatattggggagaagtgtgggctgaatggcattgacaatggatttgtggtcttcaccaactaccgaattccccgggacaacctgctcaatcgcaccagtgacgtcactccggagggggtctacgaaagtgtgttcaccgaaccaggaaaagtccttggggctgcactcgagagcttctccgccggacgcattggcataatgcaggaatcggccaatactctgtgcagtgccgccgtaatcgcagttcgttactccgcagtgaggaagcaatttggcccggagcgtcatggcgaggaaatggccattctggagtatcaactgcatcaatatcgcatctttccctatctggcggctgcctgcgttcaaaaaattgccactgaagagctgacaagcacctatatggagatcatagcgcgttcccaggcggattccaatggatttgatgttctgacccagaatgctgcggagatccacgcgttgatctcgtcgtcgaagcctttgatcacctgggcagcacgggatgccatccaggaagcgcgagaggcctgcggaggacatggctatctgcaagcagctaagcttggccagatgcgcaccgaccacgacccactgtgcacctatgagggcgataacaacgtcctaggacaacaggcctccaactggctgcttcgccagtggagcgccaaggaactggagacacccattggcagtgtgaagttcctggagcgccgaagcgagttgctggctctcaactacgcgtccttggcgcagaaaactccaatagccagctggcagttctcccttaggtgctacgagtggctgctgtgtcacctgatggccaagaccacagctcacatcgagggtcagctggcggcgggcagcagtaagttcgaggcgagaaacaactcccaggtggccggagctcgggaactgtccctggcctacgcggagtactatgctctgacgcgctatgtggatcacgttagtacactgacagtggaggcgccatatgcatccgtactccgcctgctgttcgacgtgtatgccatgtggctgctggagaagcacatgaccaccttctatgtgggtggctttgcggctgggcgggatttctcggctgcagtgcgtcaactgctgctggacagctgcctgaaactgaaagacgtggccgtgagcgtagcggatgccatttcgccgcccgatttcgcactgaattcggtcatcgcccgggcggatggacttctctacgagaacttgcagaacgaatttatgaccaatgagggggcattccagcgaccctcctggtggcgtgacgtaatcattccgcaggcccagtccaagctttgaggaggattaccaccgaggattagaacctagttaccaagtgcctgacttcgatactgaagcgttcgcttggcgcgtagaaaaccaagttaaattggaattggtgttgcctctcgataatcaggtataatggccaactacattgatcccagtgaaaggttttttttaatcatgtaccaactataacacacattcgagtactttaagatgaaatctgttactagattacgattaaacgagttgatatgaaagtatatatgtatatataagcgagttaaataaatattgaatcattttgcgttacaa

SEQ ID NO: 5749 - protein, 693 aa, Drosophila melanogaster
MGSEDTSFIPDLPSGGPLAVYRKRANFDWKRLRLIFEKEQGLRIKYKVWRRLENDPLFAHPSRTLPMDEQKRLCAMQVNRMKHLDLVPKEIESLSFSAKTKYLMYINEALACYSPSLSVKIALGVGLFNNAIRAMGTEKHQKYIEAAWNREVITCLAITELSHGSNTKSIRTTATYDPTTQEFVINTPDFEAAKCWVGNLGKTATVAMTFANLYTADGQNHGLHGFLIPIRDPKTLLSYPGVLVGDIGEKCGLNGIDNGFVVFTNYRIPRDNLLNRTSDVTPEGVYESVFTEPGKVLGAALESFSAGRIGIMQESANTLCSAAVIAVRYSAVRKQFGPERHGEEMAILEYQLHQYRIFPYLAAACVQKIATEELTSTYMEIIARSQADSNGFDVLTQNAAEIHALISSSKPLITWAARDAIQEAREACGGHGYLQAAKLGQMRTDHDPLCTYEGDNNVLGQQASNWLLRQWSAKELETPIGSVKFLERRSELLALNYASLAQKTPIASWQFSLRCYEWLLCHLMAKTTAHIEGQLAAGSSKFEARNNSQVAGARELSLAYAEYYALTRYVDHVSTLTVEAPYASVLRLLFDVYAMWLLEKHMTTFYVGGFAAGRDFSAAVRQLLLDSCLKLKDVAVSVADAISPPDFALNSVIARADGLLYENLQNEFMTNEGAFQRPSWWRDVIIPQAQSKL

SEQ ID NO: 5750 - DNA, 2216 bp, Drosophila melanogaster
  CDS (56)..(2167)
atttcgcgcctagcattcgaagcagccagaccagtcgctagaatcgaactccaacatggttgcattgagcacaaacggccgccgggaggagaaggctgcagccaacatctacgatgacaaacggatctttcccgacttccgtagcggacctttggaagagtaccgtgagcgggctagcttctgctacaagcgcatgaacgtggtgctcgagggcgaggatcacatacggctgaagcacaaggtgtggcaatggatggaacagcaccccgactaccagcgggagccaggatccgatttggaacgcacccgcgaaatggccaacaagcggcagcatcttctgtgggagcaacagttctacggcgtcaacgagtatcttggaaccccacatcttctgcttgctttcggacaggccatctttagctacgatttcagcacttcggtcaagttcggcctttcaactggcatgttccccagcacgctggtctccaacggatctggccgcctgggcaagtacgtggccaagatcgcggacaaccgcattttgggcgcctacgctctcactgagatttctcacggcaccaacgcgctcggcatgcgcacccgtgccacctacgatgtgaaaaggcaggagtttatcatccacacgccagacttcgaggcggccaagtgttgggtcggtaatctaggcaagacttgcacgcacgcaatcgtctacgcccagctgtacgtgccggatgacaagcaccagggcctgcaggccttccttgttcccattcgggacgagcgtacattgcttccattccccggcgtaaccgtcggcgatatgggcgaaaagatcggtctcaatggcattgataacggatttgtgatgttcaaccagtatcgtatccctaaggcaaatctgctgtccaagaccggtgacatcgatgcgcagggaaactacaccagtaaaattaaggacgagcgtaagcgccttggcgcctccttgggtgccctctccgtgggtcgcgtcaatatcactgctatcacgtatgtggccttgagcaaggctgtgacaattgccactcgctatgcggccagcagacgccagtttggccctaccaacagcccggcggagtggcccgtgatcgagtatcagtcacagcaataccgactaattccccacttggccaccacaatcgccttgcgggtggccacactctggataggcaaagagaacgtggatttgaccatgaagggcttcactggcgaggacacgtcgcaagcgggcatggagatccatgcgatctcatcggcactcaaaccagttgccacttgggctgccagggatggcatccaggaatgccgcgaggcctgtggcggtcatggctatcttaaatcttctggcttgggcgaacttcgcaacgacaacgatgccaactgcacctatgagggcgagaacaacacgctcatccagcaagcgtccaattggttgatcagtctgcaacgcaacaatgccgacttcgtggcagtttccccattggagacagtctccttcctgaaggatatggacacaattctgcaaagcaagggtcaggagcgaactcctgccgaagttttggatccgctcaatctacttaatgccctcaactggcttaccgtctggcaactggatacgacggtgaaacgagttgaggaacagcagcgcgaaggaaaggatgcctttgagacgaggaacaacatccaggtctttgccgcccagaagctctccattatctacggcgagcgcaccatctactacgtgttttataagtttgtaattggtctgcccgactctgctgagaagaaggtactgcagcaggtgctctccttctatggcgcccacttggtcacaaagtactccgctgctttctaccgcggtggttacttccgcgaaaactctaaccaactggagctgtacgaacagggcattctggctctgcttcccctgctgaagaacgaagccattgctctggtggatgccattgctcccacagactttattctaaactctcctctgggcatgagcgatggaaacgtctaccagcatctgcagcgcacgcttgtctccactccaggtgtctacgagcgtcctcattggtggcgtgatgttacctacaaggattaccttaagcgcgccaaattgtagactcactgtaaaatcccaaataagaagactttactcgttgagtttttgt

SEQ ID NO: 5751 - protein, 703 aa, Drosophila melanogaster
MVALSTNGRREEKAAANIYDDKRIFPDFRSGPLEEYRERASFCYKRMNVVLEGEDHIRLKHKVWQWMEQHPDYQREPGSDLERTREMANKRQHLLWEQQFYGVNEYLGTPHLLLAFGQAIFSYDFSTSVKFGLSTGMFPSTLVSNGSGRLGKYVAKIADNRILGAYALTEISHGTNALGMRTRATYDVKRQEFIIHTPDFEAAKCWVGNLGKTCTHAIVYAQLYVPDDKHQGLQAFLVPIRDERTLLPFPGVTVGDMGEKIGLNGIDNGFVMFNQYRIPKANLLSKTGDIDAQGNYTSKIKDERKRLGASLGALSVGRVNITAITYVALSKAVTIATRYAASRRQFGPTNSPAEWPVIEYQSQQYRLIPHLATTIALRVATLWIGKENVDLTMKGFTGEDTSQAGMEIHAISSALKPVATWAARDGIQECREACGGHGYLKSSGLGELRNDNDANCTYEGENNTLIQQASNWLISLQRNNADFVAVSPLETVSFLKDMDTILQSKGQERTPAEVLDPLNLLNALNWLTVWQLDTTVKRVEEQQREGKDAFETRNNIQVFAAQKLSIIYGERTIYYVFYKFVIGLPDSAEKKVLQQVLSFYGAHLVTKYSAAFYRGGYFRENSNQLELYEQGILALLPLLKNEAIALVDAIAPTDFILNSPLGMSDGNVYQHLQRTLVSTPGVYERPHWWRDVTYKDYLKRAKL

SEQ ID NO: 5752 - DNA, 2137 bp, Drosophila melanogaster
  CDS (104)..(2137)
ctttcgctcagtagtcgcgtggagctcacagctgttgattggatctagtggtggatcatagtttagttgttaacaattccgtatttttattttgcacacaacaatgtcgcatattaaaaacctaataccgagcacagtgaatccagatcttcaaaaggaacgtgctgcagctgaattccatgtggaggaattctccgcctggtggcacggtggtcaagacaaactgaagaagaagcgcgaaatcgagaaagcgatcttcagcgatcttgaggatggctatggcctcaaccatgagtacatgtcccacgaggaggtctacaattccacggtgaagaaggtggctgaggcagctgttaagctcaaggctctgcagaacaagcttaatcctggaggaactgacatctggcctggaggactattcaatgcacagagctttggactttttccggctaatcatccgattgccacccacatcaccatgttcgtggatgtgatcaaaggtcagggcactgccgaacaggtggagaagtggggcaaggcggcggagaactgcaacattatcggcacctacgcccaaacggagctggcccatggcaccaatgtccgtggcttggccactcgggctgactttgatcccaaaacggatgagtttgtgctaaatacaccgaacttggaggcctacaaatggtggcccggcggcttgggacacacggccaatcatgcaatggtagtagcccaactatatatcgccgatgttcatcatggcgtgcaaatgtttattgtgccgttaagagattccgaaactcacatgccactgccgggtgttgatatcggtgagattggcaagaagctcggcatggcatccgtgaaccagggcttcctgggactgaaccacgttcgaattccgcgcaccaacatgctgatgaagttcgccaaggtggagcgggatggcaccttcaaggccagcccggcatcgaggattaactacctgaccatggtgtacacgcgctgcttgatcgttagccagaactccacgttgctcctggcggcggcaaccatagccacgagatactcggcagtgcggcgtcagagtcccattgagcccaatcaacccgagccccagatcatagatcatgtgacccagcgcctgaagctcttccctgagatcgctacgggaatcgcctaccatctggccaccgagtacatgtgggaaatgtatgcccagacggtgcaggaagccaacaacggcaagttcgagcgactgcccgacatgcacatcctgtcctgcgcgctcaaggtcctttgcaccactgacggctgtgctggcattgaaaaacttcgtctgtccactggaggacatggttacctcatcgccgccaacttgagcaacatctatggcaatgctgtggctgcgtacacctacgaaggcgagaacacggtgctgcttctgcaaattggacgagctttagttaaggcatgggcttcgttcgtggacaagaaaccattatcggcatcctacagctactttgccagctccatgcagctgaaggagttccccaaatgggacgactcctggcagtgcatcatcaaggctttgcaatacacggctgcacacaagacccgcattgctttcgagaatctagcgaatcgcatggccagcggtcagtctcaaggtgtggcggccaataacacgggaatcgaactgactcgtgcagctgagctgcatggccggcagtttgtgtgccaaacattcctggagcagatcactggtgccaaggcccagaagcgatcccccgcactgaacaagatattggagaacgtgctggaactatttctggtccaaacggtgcttaataaccttaatgacattttaagattcattaaactaagcgatgcggatctgcgatcgctgcaaaaacgcttggaggattcactggcgcagttccgacccaatgcggtggccatatgcgatggattcgagttccacgaccgtgtgctaaactccgtgctgggcagctacgatggcaatgtgtatcccaggctcttcgattcggccaaacgcagcaccatgaaccagaagcccgtccaaacatcatttgagacctacctgaagcccctgatgaaggctaagctgtaa

SEQ ID NO: 5753 - protein, 677 aa, Drosophila melanogaster
MSHIKNLIPSTVNPDLQKERAAAEFHVEEFSAWWHGGQDKLKKKREIEKAIFSDLEDGYGLNHEYMSHEEVYNSTVKKVAEAAVKLKALQNKLNPGGTDIWPGGLFNAQSFGLFPANHPIATHITMFVDVIKGQGTAEQVEKWGKAAENCNIIGTYAQTELAHGTNVRGLATRADFDPKTDEFVLNTPNLEAYKWWPGGLGHTANHAMVVAQLYIADVHHGVQMFIVPLRDSETHMPLPGVDIGEIGKKLGMASVNQGFLGLNHVRIPRTNMLMKFAKVERDGTFKASPASRINYLTMVYTRCLIVSQNSTLLLAAATIATRYSAVRRQSPIEPNQPEPQIIDHVTQRLKLFPEIATGIAYHLATEYMWEMYAQTVQEANNGKFERLPDMHILSCALKVLCTTDGCAGIEKLRLSTGGHGYLIAANLSNIYGNAVAAYTYEGENTVLLLQIGRALVKAWASFVDKKPLSASYSYFASSMQLKEFPKWDDSWQCIIKALQYTAAHKTRIAFENLANRMASGQSQGVAANNTGIELTRAAELHGRQFVCQTFLEQITGAKAQKRSPALNKILENVLELFLVQTVLNNLNDILRFIKLSDADLRSLQKRLEDSLAQFRPNAVAICDGFEFHDRVLNSVLGSYDGNVYPRLFDSAKRSTMNQKPVQTSFETYLKPLMKAKL

SEQ ID NO: 5754 - DNA, 2352 bp, Drosophila melanogaster
  CDS (319)..(2352)
ttaacatctgtgggggcaaacctattttttttttgttggtattcaaatcttatcttattaattgtgcttaccaccctgatgtcagcgtaataaggtagtaaagtggagtatgcatccgattaaattttgacctgggatccagcgattacccagataacggttgcgccataacaaagcattcaatcaaaaacactcgtatcgaaagagcaaagactacaagtttcacttatatttatgaagagccatcggctgttttaaagtcagtaagcggtcggtgctcttggcgcgcagttcgcaggttttctaaatctagttgttatggcctcttccacttcggttatccctaccaccgtaaatcccgatctgcagaaggaacgagatgcagccagctttaacagcgaagaattcgccgcttggtgggcggggggcgaggaagtgctaaagttcaaccgcggcgttcgtgaatatatggagaaggatgtggatttgtcggagatgctgcagctgcaaaacaaaacccacgaagagatcatcgagttttccacgcgtggagcaatcgaaggcgccaagaagctacgccgcctgcaggaggagcgcaatcctggcggagatgtctactggccgaatttgtatgacgctcaagtgatgtggggtctcgttcccggtggcaatccttttggtgtgatgtacgtgatgctggtgaaagctctgcaggctcagtgcactccggagcagtatgaagaattcggcaagcgggtggaactcttcgagatttgcggcacctatgcccaaacggaactgggtcatggaacctacctgcgcgggctggaaacgcgtgctgattttgatcgaaagactgatcaatttgtactcaacacccccaatatttcctcctacaagtggtggcccggaggcttgggccacagctccaatcactgcctggttatggctcagctgtacatcgacggcgactgcaagggtccgcacatgttctttattcaggtgcgtgatgaagacacccacgaaccactgcccggcgtccacatcggtgatattggcaagaaaatgggcttcattggcgtaaacaatggtttccttggattaaagaacgtacggattcctcgtacgagaatgctgatgcgacatgctcaggtgaaggctgatggatcctatgttagtagtcccaccaatgtgcttacctactttgccatggtccgcacgcgttgtgtaattgccaaaaacaatgccgtgatgttggcttctgctgccaccattgcaaccagatactcggctgtgcgccgtcagagcccaattaatcccaacgaacgagagcctcagatcatggatcatgttacacaacaaatgaaactcttcccagagattgccacaagcgtggcataccgaaaggccggtgattacttgtggaatctgtacgatgtgaccatcgaggatatagaaaacggaaaatacgaacgtctgccggagttgcattctctgtcctgcgctttgaaagttacctgctccatggactccgcttctggtgtagagaaattgcgactggcctgtggtggtcatggattcctcacctcatccaacatgagcagtatatacgttagtgccaccgcagcttgcacgtatgagggtgagaacaccgtactgcttctgcagatcggtcgctttttaatgaagacgtggcgagccgcgttgactggagctccgttgccgcccaccgttcgctatttggccgaggtgcaaaagaatccggagtttggcacctggactggaagttgggagaacatggttaaggccatgcagtatgcagctgccaatagaacacagttggcattcaggagcctttccaaacgtatgtcaaggggcgaaactgaagcgaacgcagctaatcacacgggcattgagttcacccaggcggcagagctccacggacgtgcttttgttttcagtgctttctatgaagcagtcaccggtcctcaatctaagacgcgctcagctaacttcaatcgagtcctggagaacctgttggagctgtacctagtcaaggagacacttaatcaaatgggtcacctgctgagattcattaacttgaccgatacggatctctccgggctgcaggatcgcttggaaacagtgctcaccaaactgcgaccagatgctgtggccattgtggatggctttgacttcagcgatctgcagctgaactccactctgggctcttacgatggcaatgcctacgagcgtatcttcgatgcggccctcaagaatccgatgaaccaaaaagcagtgcctaagtacttccatgagatcctgaggccgttcatgaagtcaaacatctag

SEQ ID NO: 5755 - protein, 677 aa, Drosophila melanogaster
MASSTSVIPTTVNPDLQKERDAASFNSEEFAAWWAGGEEVLKFNRGVREYMEKDVDLSEMLQLQNKTHEEIIEFSTRGAIEGAKKLRRLQEERNPGGDVYWPNLYDAQVMWGLVPGGNPFGVMYVMLVKALQAQCTPEQYEEFGKRVELFEICGTYAQTELGHGTYLRGLETRADFDRKTDQFVLNTPNISSYKWWPGGLGHSSNHCLVMAQLYIDGDCKGPHMFFIQVRDEDTHEPLPGVHIGDIGKKMGFIGVNNGFLGLKNVRIPRTRMLMRHAQVKADGSYVSSPTNVLTYFAMVRTRCVIAKNNAVMLASAATIATRYSAVRRQSPINPNEREPQIMDHVTQQMKLFPEIATSVAYRKAGDYLWNLYDVTIEDIENGKYERLPELHSLSCALKVTCSMDSASGVEKLRLACGGHGFLTSSNMSSIYVSATAACTYEGENTVLLLQIGRFLMKTWRAALTGAPLPPTVRYLAEVQKNPEFGTWTGSWENMVKAMQYAAANRTQLAFRSLSKRMSRGETEANAANHTGIEFTQAAELHGRAFVFSAFYEAVTGPQSKTRSANFNRVLENLLELYLVKETLNQMGHLLRFINLTDTDLSGLQDRLETVLTKLRPDAVAIVDGFDFSDLQLNSTLGSYDGNAYERIFDAALKNPMNQKAVPKYFHEILRPFMKSNI

SEQ ID NO: 5756 - DNA, 2142 bp, Drosophila melanogaster
  CDS (1)..(963)
atgtctgtgaatgcggatctgcagagagagcgggcggcggccaccttggacagcgaggactttgcccgctggtgggcgggtggctctgggcagctggaggagcgccgcgccctggaaaggcgtttctatgaggatcccgacttcgcggagccagtgcatccgagctgtctgtcatacaaggagcgctacgaacagaccgtggcccgatccacacgcttcctggccaaactgcgccaatggcagcgggagaagcagccacaacttcagcttagtgtgaatatgctgagggactttcggctgctactctccggatccctgggcacgggcctcttccagcagagcttcccccttcgggtgcatttctccatgttcatgaccaccttgctgagccagggaaccgaggagcagcaggcccagtggctcaatcgatcctggcacatggacggcgtcctgggcacctatgcgcaaacggagctgggtcacggcacctttgtccggggcctggaaacccgagccgactacgatcccatcacgcaggaattcatcctgaacaccccaacgcaaagttcatacaagtggtggcccggcggacttggtaataccgccaatgtggccattgtgctggcccagctatatgtgaagggcaagcattatggcttgcaatcatttgtggtgaggatcagggacgagaggacacacgaaccgttgactggagtcgatgtgggcgatataggacctcgcctgggtggcaatggcgttaacaacggctttctgggactccgcgacgtgcggataccgcgcaatcaaatgctgatgaagaacgcccaagtcctgaccgacggcaccttcgtccagggtagacctccgctgctgctctacggcacaatggtctatgtgcgggtaattaccgtgaaggatgtgctctttggactgctccaggctgccaccattgccaccaggtgattatatagtttctggggattatgtttatcatagctgttattaagcccataaaacacattcagctcacccagggttctttagataataattatcattatctttaggtattccgtggtgcgtcgccagagccggattaacagcgatcagccggaggtctctgttttggatcacatcacacagcaggcaaagattctaccgcaaattgctcgaggagtgtcctatcgcctggtatccgattggctgtggcgcttctacgaggacgtactccgccaactggaggatgaaagcacgaaaggacgcaactccctgccggagctgcacgccctgagctgctgcctcaaggcggtggccaccgacgaggccagcgagggagttgatctgctgcgcaagagttgcggtggccacggattcctttcctcggcgaatttcgatagcatctatggtctgaccgccgccacatacacctacgagggagagtacacagtactcctgctccagacagctcgtttcctcgtccggcagtatgcggatagcttaaaacgcaaggtgctgccctccagtgtctcctatttgagggatacagcccgtttgatttggggcaagaatctggttgcgaattgtgtgcgagcgctggagatttcagccatggagcaggtgcgtgatgcttggcagacccagaagatgcaccaatccggcaaggtgagtcccgagatggccagcaatctggctggaaggcagctcacctcggctgccatagcccatgctcacgcattcttcacacgcaatgcactggagcaagtggaagcacttcgaaagaagggcgatcttagcccgaatgtctcactcatcttgggccaactggttgagcttttcgtcatcgatacattcctgcgacagtcgggatgcgtgctgcgttggaacaacggcatcactggcacccaactgcgcttcgtggagcgtcgctttgaggagctgctggccaagctgcgacccaatgcggtggctctggtggatggattcgattttcacgatcgtgtcctgggctccacgctggggtgtcacgatggccgggtgtacgagcgtctcatggaggaggcacgccgaaatccgatcaaccaggagccggtcaactcgtccttccacaaccacttgttgcccatgatgcggggaaagctgtga

SEQ ID NO: 5757 - protein, 320 aa, Drosophila melanogaster
MSVNADLQRERAAATLDSEDFARWWAGGSGQLEERRALERRFYEDPDFAEPVHPSCLSYKERYEQTVARSTRFLAKLRQWQREKQPQLQLSVNMLRDFRLLLSGSLGTGLFQQSFPLRVHFSMFMTTLLSQGTEEQQAQWLNRSWHMDGVLGTYAQTELGHGTFVRGLETRADYDPITQEFILNTPTQSSYKWWPGGLGNTANVAIVLAQLYVKGKHYGLQSFVVRIRDERTHEPLTGVDVGDIGPRLGGNGVNNGFLGLRDVRIPRNQMLMKNAQVLTDGTFVQGRPPLLLYGTMVYVRVITVKDVLFGLLQAATIATR

SEQ ID NO: 5758 - DNA, 2378 bp, Pichia pastoris
  CDS (100)..(2259)
gagtaagagtgctacacatgcattgcctccagtgtctatataagtacctagagctgagtccaccttttttaaccagtctaacaactgaaaaatcacaacatgttcaaaattgaatcgatcaaaagtcagtcgccgcaggtggccattgacaaggagagaaaagctaccaagtttgatatcaacaagatgtttgaatttttggagagtggcaaggatgaagctgctctcacaaagtctctgatgcaacaaatcgaaagagacaccatcttgaaaactaatgccagttattacgacttgacgaaagaccagcacagagagctcacagctcagaagatcgccagattggcatcttatattgaaaaggatgccccattctttgagaacttccaaaagagactgaatctcattgctattgttgatccacaactaggtacgagagttggggtccatcttggattgtttctgagtgcaattagaggcaacggtacggaggaacagttcaagtattgggctttcgaacgtggtgccgcctacttgaaggatgtgtatggctgtttcggtatgactgaattagcccacgggtcaaatgtggcgggtctggaaaccacagctacatttgatcaaaagactaaagagtttgaaatcaacacccctcatttgggtgccacaaaatggtggattggaggagctgcccattctgcaaatcactgtgtggtgtatgccaggttaattgtcagtggtaaggattacggagtgaaaacttttgttgtccccatcagagacagaaatcataacttacattccggtgtggctattggtgacattggcgctaagatgggcagagacggtattgacaacggctggatccaattaaccaacgtccgaatcccgatgaactacatgcggtccaagtttactaaagtgactcagagacaggagatcgtagaggttccacctttggagcagctagcgtacggagctttgctgggtggaagagttacaatggttaccgattcttttagaatggcacagcgtttcatcaccattgctctaagatattccgttggaagacgacagtttggcgccaaaaattcctcagaggaactcaaattgattgactacccattgcaccagcgtcgtcttcttccttacttggccctgacctatgctctgtcaataagttcttttgatttgtcccaaacttatgactccgttttgagtaatctagatgccgccggaaagtcccaagatttttctaagttgggccaagcgattgccggacttaagaaccttttctgtgcttctgcttcgctgaaatctactgcgacctggtatgttgcccagctgattgacgagtgtagacaggcatgtggtggacatggatattcctcgtattccgggtttggtaaagcatataatgattgggttgttcaatgtacctgggagggagataacaacatccttgcaagtaatgccggtagattattgtgcaatctattatcaagttgcaagaaaaaggaaaagaagataaagggtgacttgtcatacttgaatggaatcagcaatatcgacaaggaagctatctgctggaacaaacaaagtatgaccaacttgtccaacagcaatatcgacaaggagctattctgcttcaacaaacaagtatgcactgtcaagttgattaatgctatccagggtaccattatccgtctaggtgtacgtgtgccgaatatcggaagcaaaaagtccacatgggatgacatagcagctcaacgagtagtcctttccaaattgaatgctgttttatatatgctgcaacatttggttttgaaaattaaacaacttggagacgaggaagctcacaaacaataccttgttcaaattgcagctttgtttgcaacctcacagatagaaatgaattttgcatcttatttcttacaattcaaggccatcgattcgttggaacctgttgctgatgttgtgtctgaactgtgcttatcagtgcgggaccaagtcattggattgactgactctttccaattttcggactactttatcaactctgcattgggatcacattctggagacatttacaatacctactttgacactgttaacaatctgaacaatccgcaagtcagggacggaaaggcggcatactccgaggcacttgaagccatgctacgtagggacccactagaagtgcgggaatgctttgagaagagtgacaaagtattgaagaagttggctcctaagatttagggtgtattgattactagtttaatgctatcacaaagtatcttgacacttggatgtcgatggctgaagaagtatttaatttattatttttcgcgtgctcatcttgagagaaaaaaaagata

SEQ ID NO: 5759 - protein, 719 aa, Pichia pastoris
MFKIESIKSQSPQVAIDKERKATKFDINKMFEFLESGKDEAALTKSLMQQIERDTILKTNASYYDLTKDQHRELTAQKIARLASYIEKDAPFFENFQKRLNLIAIVDPQLGTRVGVHLGLFLSAIRGNGTEEQFKYWAFERGAAYLKDVYGCFGMTELAHGSNVAGLETTATFDQKTKEFEINTPHLGATKWWIGGAAHSANHCVVYARLIVSGKDYGVKTFVVPIRDRNHNLHSGVAIGDIGAKMGRDGIDNGWIQLTNVRIPMNYMRSKFTKVTQRQEIVEVPPLEQLAYGALLGGRVTMVTDSFRMAQRFITIALRYSVGRRQFGAKNSSEELKLIDYPLHQRRLLPYLALTYALSISSFDLSQTYDSVLSNLDAAGKSQDFSKLGQAIAGLKNLFCASASLKSTATWYVAQLIDECRQACGGHGYSSYSGFGKAYNDWVVQCTWEGDNNILASNAGRLLCNLLSSCKKKEKKIKGDLSYLNGISNIDKEAICWNKQSMTNLSNSNIDKELFCFNKQVCTVKLINAIQGTIIRLGVRVPNIGSKKSTWDDIAAQRVVLSKLNAVLYMLQHLVLKIKQLGDEEAHKQYLVQIAALFATSQIEMNFASYFLQFKAIDSLEPVADVVSELCLSVRDQVIGLTDSFQFSDYFINSALGSHSGDIYNTYFDTVNNLNNPQVRDGKAAYSEALEAMLRRDPLEVRECFEKSDKVLKKLAPKI

SEQ ID NO: 5760 - DNA, 2210 bp, Cavia porcellus
  CDS (40)..(2025)
ctgccgcttccctcggcgtcgcccacccgagccgacgccatgaaccccgacctgcgtagggagcgggccgctgccacgttcaacccggagctgatcacgcaccttctggacggcagccctgagaagacccggcgccgccgagagatcgaaaacaagattcttagtgacccagacttccagcatgagaatcacaacttcctcacgcgcagtgagcgttatgaggcggctatcaagaagagcgctgtcatggtgaagaagatgagggaatttggcattgcggaccctgatgaaatcatgtggtttaaaagactacttttgggcaattttgtggaacctgtgggcctcaattactccatgtttattcccactttgctgaatcagggcaccactgctcagcaagagaaatggctgcacccatccactggacttcagataattggcacctatgcccagacggaaatgggccacggaactcatcttcgaggcttggaaaccactgccacatatgatcccaaaacccaagaattcattatcaacagtcctacggttacctccattaagtggtggcctggtgggcttgggaaaacgtcaaatcatgcaatagttcttgcccagctcattactcaggggaagtgctatgggttacatgccttcattgtacctattcgtgaaatagggacccacaagcccttgccaggtattactgtgggagacattggtcctaaatttggctatgaagagatggataatggctacctgaagatggacaactatcgtattcccagagaaaacatgctcatgaaatatgcccaggtgaagcctgatggcacatatgtgaaacctgtgagtaacaagctgacttacgggaccatggtgtttgtgaggtccttccttgtgggagcagcagctcagtctctctccaaggcatgcaccattgccatccgatacagcgccgtgaggcaccagtctgaaatcaagccaggtgaaccagaaccacaggttttggattttcaaacacagcagtataagctctttccaatcctggctaccgcctacgccttccaatttgtaggcagttatatgaaggatacctaccaccggattaatgagagcattggccagggggacctgagtgaactgcctgagctgcatgccctcactgccggtcttaaggctttcaccacctggactgcaaatgctggtattgaagagtgtcgactggcttgcggtgggcacggctactctcactgcagtggtattccaaacatttatgtcactttcacaccagcttgtacttttgaaggagaaaacactgtcatgatgctacagacagccaggttcctgatgaaagtctatgaccaagtgcaatcagggaagctggtgcatggcctggtgtcctacttgaatgacctgcccagtcagcgcatccaaccacagcaagtggcggtctggccaaccgtggtggacatcaacaaccctgacagcctgacagaaatatacaagcttcgtgcagccaggttaatagacattgctgctaaaagccttcagggtgaaatgagtcacagaaagagcaaggaagtagcatggaacctcacttctgttggcctggttcgagcaactgatgcacattgccactatgtagtagttaagctctttgccgataaactcctaaaaattcaagataaaaccatccaagccgtcttaaggaatttgtttctcttgtattctttgtatggaattagtcagaaggcaggagattttctacagggaaacattatgacagggtcgcagattactcaagtaaaccagcgtgtattggagttgcttgctgtaatccgccctaatgctgttgctttggtggatgcatttgattataaggatataacacttggctctgttcttggccgttatgatgggaatgtatatgaaaacttgtttgaatgggccaagaaatccccactgaacaaaacagaggtccacgaatcttaccacaagtacctgaagcccctgcagtccaagctctgaagtgccataaggccaagtctaacctgcaaggagtagccgtatgtggctcctgctgcctgatgtgcaaacctgcacggatgctagcagattcatatagcgcagagcaaatgataaattcaccttgttctcttttattaaaaaaaaaaaaaaggcagatttcataaaaaaaaaaaaaaaaactcgag

SEQ ID NO: 5761 - protein, 661 aa, Cavia porcellus
MNPDLRRERAAATFNPELITHLLDGSPEKTRRRREIENKILSDPDFQHENHNFLTRSERYEAAIKKSAVMVKKMREFGIADPDEIMWFKRLLLGNFVEPVGLNYSMFIPTLLNQGTTAQQEKWLHPSTGLQIIGTYAQTEMGHGTHLRGLETTATYDPKTQEFIINSPTVTSIKWWPGGLGKTSNHAIVLAQLITQGKCYGLHAFIVPIREIGTHKPLPGITVGDIGPKFGYEEMDNGYLKMDNYRIPRENMLMKYAQVKPDGTYVKPVSNKLTYGTMVFVRSFLVGAAAQSLSKACTIAIRYSAVRHQSEIKPGEPEPQVLDFQTQQYKLFPILATAYAFQFVGSYMKDTYHRINESIGQGDLSELPELHALTAGLKAFTTWTANAGIEECRLACGGHGYSHCSGIPNIYVTFTPACTFEGENTVMMLQTARFLMKVYDQVQSGKLVHGLVSYLNDLPSQRIQPQQVAVWPTVVDINNPDSLTEIYKLRAARLIDIAAKSLQGEMSHRKSKEVAWNLTSVGLVRATDAHCHYVVVKLFADKLLKIQDKTIQAVLRNLFLLYSLYGISQKAGDFLQGNIMTGSQITQVNQRVLELLAVIRPNAVALVDAFDYKDITLGSVLGRYDGNVYENLFEWAKKSPLNKTEVHESYHKYLKPLQSKL

SEQ ID NO: 5762 - DNA, 3445 bp, Homo sapiens
  CDS (272)..(2254)
ctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaaaaaaaaaaaaaaaaaaaaaaaaaa

SEQ ID NO: 5763 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 5764 - DNA, 3778 bp, Mus musculus
  CDS (81)..(2066): k means g or t/u, r means g or a
gcccgggcaggtgttgtcatcgctttggtgcctgtcacttctgtcgccacctcctctgcccccagcactggttctccgtcatgaatcccgatctgcgcaaggagcgggccgccgccaccttcaatccagagttaatcacgcacgtcttggatggtagtccggagaacacccggcgccgtcgagaaatcgagaacttgattctgaacgatccagacttccaacatgaggactataacttcctcactcgaagccagcgttacgaggtggctgttaagaagagtgccaccatggtgaagaagatgagggaatttggcatcgcagaccctgaagaaatcatgtggtttaaaaaactacatatggtcaattttgtggaacctgttggcctcaattactccatgtttatccctaccttgctgaatcagggcaccactgctcagcaggagaaatggatgcacccgtcccaagaactccagataattggcacctacgcccagacggagatgggccacggaactcatcttcgaggcttggaaaccactgccacatatgaccccaagacccaagagttcattctcaacagcccaactgtgacttccattaagtggtggcctgggggrcttgggaagacttccaatcatgcgatagtcctggctcagctcatcactcgaggggagtgctacgggttacatgcctttgttgtccctatccgtgagattgggacccacaagcctctgccaggcatcactgttggggatatcggccccaagtttggttatgaagagatggataatggctacctgaagatggacaattaccgtattcctagagagaacatgttgatgaaatatgcccaggtgaagcctgacggcacgtatgtaaagcctctgagtaacaagctgacatatgggrccatggktttcgtaaggtccttcctcgtgggaagtgcagctcagagtctgtccaaggcatgcaccattgccattcgatacagtgctgtgaggcgccagtctgaaatcaagagaagcgagccagagccccagattttggattttcagacgcagcagtataaactcttcccgctcctggccaccgcctatgccttccactttctcggaagatacataaaggagacctacatgcggattaatgagagcattggccaaggcgacctgagtgagctgcctgagcttcatgccctcacagctgggctgaaggcttttactacctggacagccaatgctggtatcgaagaatgtcggatggcttgcggtgggcacggctattctcacagcagtgggattccaaatatttacgtcacgtttaccccggcctgcaccttcgagggggagaacactgttatgatgctgcagacggccaggttcttgatgaaaatctatgaccaggttcagtcggggaagctggtgggtggtatggtgtcgtacttgaatgacctgccgagccagcgtatccagccgcagcaggtggcagtctggccaactctggtggacattaacagcctggacagcctgacagaagcctacaagctacgtgcagccagattggtagaaattgctgcaaaaaaccttcaggcccaagtgagtcacaggaagagcaaggaagtggcgtggaacttgacttctgtcgaccttgttcgcgcaagtgaggcgcactgccactacgtgaccgttaaggtctttgcagataaactccccaagattcaagacagagccgtgcaagccgtgctgaggaacctgtgtctcttatattctctctatgggatcagccagaaaggaggggattttcttgaggggaacatcatcacaggggctcagatgtcacaggtaaacagtcggatcctggagctgctcacagtgactcgccccaacgctgtggctttggtggatgcctttgactttaaggatgtgacccttggctctgttctcggccgctatgatggcaatgtgtatgaaaacttgtttgagtgggccaaraagtccccmctgaacaagacagaggtccaccaatcttactacaagcacttgaagcccctgcagtcgaagctttgaagtttccccagggacaagtctgagctccacagagcggccgaatctctccttgattcactaatccttgtgaaatcgtcttcagacttgtgtagctatagagcaaatgatgggctggcctttccctctctataagtaaagagaaatgagcagacttagagatgaaatgagaatccagtgttgtaggtgcagtagtagcccaggccgacgtaggacctcgggaagccactgccgcgctgtggcctggctgacgttatttgttctgctgctaatctctgtaggccttgactctggggggaattaacagattttaactactaaatacttagtaattttcacattttcactgctaatcactggatatatgttttttaaacaaaggtgttctatagagctggactttccaggcttgcttgcctatgcactttctgatctaccactaagagcaggagtttgggggccagaaactaattagaaacccagattgtgagtgtgtggcccttacatatgcccctgctgcctgctgtgtgggtgtgtcattcctaccaactgtcacactaacatatcaacaagaggagtccttaaacacccacccaccaagaaagcagcgctccgggactaagctcccactctggtcttcctggcaatggcatgcacccgcccatgacccacttcctgacacagctaagttgcttgtctttacctccaggctttcggccgttgcctggacttcaatcatggtggctgaccttccctttcttgccttgcttctcctcaaagagataatagagacaatgaccagtctttcctcatagactcaagtatggggagagccctcagctatggtattccgtagtaatttaggtgactttgttaagtaaattcctgggacaatccagatttgaagactatcgtcttgttgttgtcataaactattaaaatgcttggtcgctaacaaagtatttgacataaaaataaataaataaatcattcaggccaccttttacaccaggaatcacaggaaagccctgggccccagccatctgctgagtgttagttgagaagatggatcctaagccagctgaagaatgagtgcaggctgtgggggaggttcttgctggagtagctggctttgttggtaagctgtagcagccttacagggtggcgaagcagcccccctttggatgcagagcagcctctacaatcattctgaccttaaaggtagagtatggaccttttgtggtatgtgtgtgtatgcttttttttatgtagtgatttttttttttcttcttgagacagggcccagagttggccttgacctctgatcctcagcctcccagatgctggggttacaggtttgcgctgacatgcctggctagtcggaactctttgttcttaaaagcacagtagagagatcattgtgacctattaagtctgtgtctgtggcattggcatcgtgagaacagttctttcagagcagttctgagaacacagtattaatggagtggaattgactattcaagtcaaagccatcagatttgctgacacaagtcttaacctttctcctggaatcaaggtctgataatccctgaagattgacagtaagcagcatgtcacctgtggggtttctatttgacagtaagtcatattctggaaaaatagcaaataaatttaaatgactaaaaaaaaaaaaaaaaaaaaaaaaaaaaaaaaaa

SEQ ID NO: 5765 - protein, 661 aa, Mus musculus
  misc_feature (277)..(277): Xaa can be Ala or Thr
  misc_feature (279)..(279): Xaa can be Gly or Val
MNPDLRKERAAATFNPELITHVLDGSPENTRRRREIENLILNDPDFQHEDYNFLTRSQRYEVAVKKSATMVKKMREFGIADPEEIMWFKKLHMVNFVEPVGLNYSMFIPTLLNQGTTAQQEKWMHPSQELQIIGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGXMXFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVAWNLTSVDLVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHQSYYKHLKPLQSKL

SEQ ID NO: 5766 - DNA, 2039 bp, Phascolarctos cinereus
  CDS (52)..(2037)
ggggggggacttctgatcgtcgtcaccttctgccccatcgccgcctttaccatgaacccagacttgcgcagggagcgggacgctgccagcttcgatgcggaaaaactcacttacatcctggatgggggctccgagaggacccggcgccgccgggagatcgagaacctgattctgaatgatccggactttaagcatgaagacttgaatttccttacccggagcgagcgctatgagatagctgtcagaaagagtgccacaatggtgaagaagatgcgagattttggcattgctgatcctgaagagatcatgtggtttaaaaactttgtgcatcgtgggcgtcctgagcctttggaccttcacttgggtatgtttctgcccacattacttcaccaggcaacccaggagcagcaggaacgcttcttcataccagcctggaacctggagattattggcacttatgcccagacagaaatgggccatggaactcaccttcgaggcctagaaaccacagcaacttatgaccctaaaacacaggagtttattcttaacagccctactgttacttccattaagtggtggcctggtggacttgggaaaacctcaaatcatgccatagttctggctcagctctacactaagggagagtgctatggattgcatgccttcattgtacctattcgagaaatgggaacccacaaaccttttccaggcattatcgtgggagacatcgggcccaagtttggctatgatgaaatggataatggttatctaaagatggacaactatcgaattcctcgggaaaatatgctgatgaagtacgcccaggtcaaacctgatggcacatatgtgaagcctttaagtaacaaactgacttatggaaccatggtgtttgtcagatcctttcttgtgggagaggcagctcgatcattgtctaaagcttgcactattgctatccgctacagtttaataaggcaccagtctgaaatccagccaggtgatcctgaaccccagatcttggattttcagacccagcaatataaactttttcctctcttggccactgcctatgcctttcaatttgtgggagcctacatgaaggaaacctatcatcgcattaatgtggacatcagccaagggaacctgaatgaactacctgagcttcatgcactgacagctgggcttaaggctttcacctcttggacaactaattctggcattgaagcctgccggatggcttgtggtgggcatggatactcccactgcagtggcctcccaaacatttatgtcacttttacccccacctgcacctttgaaggcgaaaacactgtgatgatgctccagacagctcggtttttgatgaaaagctatgatcaggttcactcaggaaagttggtgggtggcatggtgtcctacttgaatgacctgcctagtcagcgcatccagccacagcaggtggcagcttggccagcgatggtggatatcaacaacccagacagcctcacagaagcctataaacatcgagcagcccgattagtagaagctgcagcaaggaaccttcaagccgaaatgaagcacagaaaaagcaaagagatagcatggaacttcacctcggtggaccttgttcgagcaagtgaggctcattgtcactatgtggtagtaaagctcttttctggaaatctctctaaaattgatgacaaacccattcaggcagtcctgacgaatttgtgtctcttatatgccctgtatggaatcagtcagaattctggggactttctacaggggggcatcttgacagagtcccaacttacccaagtgaaccagcgggtgaaggagctcctgacactgatccgccccgaatctgctgctttagtggatgcatttgattttcaagatgtttcacttggctctgtgcttggccgctatgatggcaatatttatgaaaatatgtttgaatgggccaagaaatctccactgaataaatcagaggtccatgaatcttatcacaaacacctgaagccactgcagtctaagctgtgaag

SEQ ID NO: 5767 - protein, 661 aa, Phascolarctos cinereus
MNPDLRRERDAASFDAEKLTYILDGGSERTRRRREIENLILNDPDFKHEDLNFLTRSERYEIAVRKSATMVKKMRDFGIADPEEIMWFKNFVHRGRPEPLDLHLGMFLPTLLHQATQEQQERFFIPAWNLEIIGTYAQTEMGHGTHLRGLETTATYDPKTQEFILNSPTVTSIKWWPGGLGKTSNHAIVLAQLYTKGECYGLHAFIVPIREMGTHKPFPGIIVGDIGPKFGYDEMDNGYLKMDNYRIPRENMLMKYAQVKPDGTYVKPLSNKLTYGTMVFVRSFLVGEAARSLSKACTIAIRYSLIRHQSEIQPGDPEPQILDFQTQQYKLFPLLATAYAFQFVGAYMKETYHRINVDISQGNLNELPELHALTAGLKAFTSWTTNSGIEACRMACGGHGYSHCSGLPNIYVTFTPTCTFEGENTVMMLQTARFLMKSYDQVHSGKLVGGMVSYLNDLPSQRIQPQQVAAWPAMVDINNPDSLTEAYKHRAARLVEAAARNLQAEMKHRKSKEIAWNFTSVDLVRASEAHCHYVVVKLFSGNLSKIDDKPIQAVLTNLCLLYALYGISQNSGDFLQGGILTESQLTQVNQRVKELLTLIRPESAALVDAFDFQDVSLGSVLGRYDGNIYENMFEWAKKSPLNKSEVHESYHKHLKPLQSKL

SEQ ID NO: 5768 - DNA, 2225 bp, Homo sapiens
  CDS (93)..(2138)
ggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcgctgagcacgggcatgaaggccatgatgtcagaattctgcacccagggagctgagatgtgccgcagggcctgtggcggacatggctactcaaagctgagtggcctgccatcactggtcaccaaattgtcggcctcctgcacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcccttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattag

SEQ ID NO: 5769 - protein, 681 aa, Homo sapiens
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 5770 - DNA, 2139 bp, Oryctolagus cuniculus
  CDS (77)..(2122)
gcacgcaggctcagagctgaccttccgaacagccaggccagaagcgtctctgttcagataccagacgcaggacaggatgggtatcccagtgcaccgggtgtcactgggggacgcctggagcagccgaatgcaccccgacatggagagcgagaggtgtgcgcagtccttcagcgtggaacggctcaccaacatcctggacggaggtgcccagcacaccgcgctccggaggaaagttgagagcatcatccacggcaacccccagtttagcagtaaggacaactacttcatgagccagaatgagctctacgaagctgccacgaggaagagataccacctgcagaagatagcacagcgcatgggctggacggaagagggtcgggaattagaatacgctcacagagctctttctgcagacctgaacctaaatttacaaggcatcttcctgaaagccctcaggagcctgggctcagaggagcagattgccaaatgggagccactcggcaaaacgttccagatcatctcaacatatgcccagacagaactggggcacgggacgtaccttcaaggcctggagaccgaagccacctacgatgcggccacccaggagtttgtgattcatagcccgacagtcactgccaccaaatggtggcctggggacttggggcgctcggccacccacgccctgatcctggcccagctcatctgctcgggagcccggcgcggcatgcatgcctttattgtgcctgtccggagcctccaggaccacactccactgccaggaatcaccattggggatattggacccaagatgggtcttcaacatattgacaatggcttcctgaaaatggaccatgtgcgggtccccagggagaacatgctgagtcgttttgcacaggtcttaccagatggcgcctacatcaagcttgggacagcacagagcaattatcttggcatgttggtgacacgggtacacctgctcttgggtgcgatcctatccccactgcagaaggcttgcgtcattgccacgcgctactcggtcatccgccaccagtgccggctccggcccagtgatccagaggtcaaaatcctagagcaccagacacagcagcagaagctctttcctcagctggccatgtgttacgccttccacttcctggccaccggcctcttggaattctttcaacaggcatataagaacattctggaccgagatttcacactcctgcctgagcttcacgcgctaagcacagggacaaaggccatgatgtcggacttctgcacccagggagccgagcagtgccgcagggcctgcggtgggcacggctactccaagctcagtggcctgccgtcactggtcaccagtgtgacggcctcctgtacctacgagggtgagaacacggtgctctacttgcaggtagccaggtttctggtgaagagctgcctgcaggctcaggggtttccaggctccacatcacagcgctccctccctcgatctgtgtcgtatctcgctctgcctgacctggccaggtgcccagcacagacagcagccgacttcttctgcccagcgctctacacagcggcctgggcacatgtggcagccaggctcacaaaggactcggtgcatcatttgcaggccctgaggcaatctggggccgatgagcatgaggcctggaaccagacaacgatcatacacctccaggctgctaaggcacactgctactacatctctgtgaagagtttcaaggaggctctggagaagctggagaacgagccagccatccagcaggtgctcaaacgcctctgtgacctccacgccctgcatggcatcctgactaactcaggtgactttctccatgacggcttcctgtctggggcccaagtagacatggccagaacagcctacatggacctgctccccctgatcaggaaggatgccatcctgttaaccgatgcttttgacttcaccgatcagtgtttaaactcagcacttggttgctatgatggaaatgtctacgaacgtctgttcgagtgggcacagcggtcaccaaccaatacccaggagaaccctgcgtataagaaatatatacagccgctattgcaaagttggagatccaacctatgaaatgaccaatactattc

SEQ ID NO: 5771 - protein, 681 aa, Oryctolagus cuniculus
MGIPVHRVSLGDAWSSRMHPDMESERCAQSFSVERLTNILDGGAQHTALRRKVESIIHGNPQFSSKDNYFMSQNELYEAATRKRYHLQKIAQRMGWTEEGRELEYAHRALSADLNLNLQGIFLKALRSLGSEEQIAKWEPLGKTFQIISTYAQTELGHGTYLQGLETEATYDAATQEFVIHSPTVTATKWWPGDLGRSATHALILAQLICSGARRGMHAFIVPVRSLQDHTPLPGITIGDIGPKMGLQHIDNGFLKMDHVRVPRENMLSRFAQVLPDGAYIKLGTAQSNYLGMLVTRVHLLLGAILSPLQKACVIATRYSVIRHQCRLRPSDPEVKILEHQTQQQKLFPQLAMCYAFHFLATGLLEFFQQAYKNILDRDFTLLPELHALSTGTKAMMSDFCTQGAEQCRRACGGHGYSKLSGLPSLVTSVTASCTYEGENTVLYLQVARFLVKSCLQAQGFPGSTSQRSLPRSVSYLALPDLARCPAQTAADFFCPALYTAAWAHVAARLTKDSVHHLQALRQSGADEHEAWNQTTIIHLQAAKAHCYYISVKSFKEALEKLENEPAIQQVLKRLCDLHALHGILTNSGDFLHDGFLSGAQVDMARTAYMDLLPLIRKDAILLTDAFDFTDQCLNSALGCYDGNVYERLFEWAQRSPTNTQENPAYKKYIQPLLQSWRSNL

SEQ ID NO: 5772 - DNA, 2509 bp, Rattus norvegicus
  CDS (198)..(2243)
ccatagcgaagacttcatgaagactgtcccaggcatgctgtgacacaaactacagaaggtgggaaaagatctttgtggtcaaaccatccggaccttggctaccgagacagaacaatactgaccgcattcactcatacacagttctcggcacctcccagtgctcagagcagaccctcaaggagatgagcagatccaggatggggagcccaatgcaccgagtgtccctgggggaccactggagctggcaagtgcacccggacatagacagcgaaaggcactcaccgtccttcagtgtggagcgacttaccaacatccttgatggaggcctcccaaacaccgtgctgcgaagaaaagtcgaaagcatcatacaaagtgacccagtgtttaatttgaagaagctttacttcatgacccgagaggagctatatgaggatgcgattcaaaagagattccatctcgagaagctagcctggagcctgggctggtcagaagatggtcctgaacgcatttatgctaacagagtccttgatggaaacgtcaacttaagcttacatggtgttgccatgaatgctatccgaagcctgggctcagatgaacagattgctaaatggggccaactctgcaaaaacttccaaatcatcacaacatacgcccagacagagctgggacacgggacatacctacagggcctggagactgaagccacctatgatgaagccaggcaggagcttgtgatacacagccctacgatgacttccaccaagtggtggcctggggacttgggatggtcggtcacccatgctgtggtcctagcccagttgacctgcttaggagtccggcacggcatgcacgccttcattgtgcccattcggagcctagaggatcacaccccactgccaggaatcacagttggggacataggccccaagatgggtttggaacacatagacaatggcttcctgcaactgaaccacgtgcgggttcccagagaaaacatgctcagtcgctttgcagaggtcttgccagatggtacctaccagaggcttgggacgccacagagcaattatcttggcatgttggtgacccgggtgcagctgctgtgtaaaggaatcctaccctccctccagaaggcttgcatcattgccacgcgctactcagtaatccgccatcagtctcgacttcggcccagtgacccagaggcaaaaatcctggaataccagacgcagcagcagaaactccttcctcagcttgctgtgagctatgccttccacttcacggccaccagcctctcagaattcttccacagctcctacagtgctattctgaagagagacttcagcctcctgcctgagctccatgcattgagcactggtatgaaggccacgtttgcagacttctgtgcccagggcgccgagatctgtcgcagagcttgcgggggccatggctactcaaagctgagcggcctgccgacactggttgctcgagcaacagcctcttgcacatatgagggtgagaatacggtgctctacctgcaagtggccaggtttctgatgaagagctatctgcaggctcaagcgtccccaggcgccacaccacagaagcctctccctcagtccgtcatgtatattgccacacaaaggccagccaggtgctcagcccagactgcagctgacttccgctgcccagatgtctataccacagcctgggcatatgtgtctaccaggctcataagagatgcagcacaccgtacacagaccctcatgaagtccggggttgaccagcatgatgcctggaatcaaactactgtcatccaccttcaggctgctaaggctcactgctacttcatcactgtgaagaatttcaaggaagctgtggagaaactagacaaggaaccagagattcagcgtgtgctccaacgcctctgtgacctctatgccttacacggtgttctgactaactcaggggactttctgcatgatggcttcctgtctggggcccaggtggacatggccagagaagccttcctagacctgcttcccttgatccggaaggatgccatcttgttaaccgatgcttttgacttctcggaccattgtttaaactcggcacttggctgttatgatggacacgtctacgaacgcctgtttgagtgggctcagaagtacccagccaatactcaggagaaccctgcctataagaagtatatccgaccactgatgctcggctggagacacaagatgtgaaaagtcaaaggatttgggaccgagaagcaccacggccttactatggcacatatacatagagaatttaaagcacggggggggggggggggggggtgctgctcggttaaatcaggtagtaaattggtacatgaatggatggtcatcctattagtctactattgagcatgtttgaaactttcccttgtccatctatagcatgtatttggctaaatgctaaaatttttgttttacatacaggaaaagctaataaacttgtcagttacaaa

SEQ ID NO: 5773 - protein, 681 aa, Rattus norvegicus
MGSPMHRVSLGDHWSWQVHPDIDSERHSPSFSVERLTNILDGGLPNTVLRRKVESIIQSDPVFNLKKLYFMTREELYEDAIQKRFHLEKLAWSLGWSEDGPERIYANRVLDGNVNLSLHGVAMNAIRSLGSDEQIAKWGQLCKNFQIITTYAQTELGHGTYLQGLETEATYDEARQELVIHSPTMTSTKWWPGDLGWSVTHAVVLAQLTCLGVRHGMHAFIVPIRSLEDHTPLPGITVGDIGPKMGLEHIDNGFLQLNHVRVPRENMLSRFAEVLPDGTYQRLGTPQSNYLGMLVTRVQLLCKGILPSLQKACIIATRYSVIRHQSRLRPSDPEAKILEYQTQQQKLLPQLAVSYAFHFTATSLSEFFHSSYSAILKRDFSLLPELHALSTGMKATFADFCAQGAEICRRACGGHGYSKLSGLPTLVARATASCTYEGENTVLYLQVARFLMKSYLQAQASPGATPQKPLPQSVMYIATQRPARCSAQTAADFRCPDVYTTAWAYVSTRLIRDAAHRTQTLMKSGVDQHDAWNQTTVIHLQAAKAHCYFITVKNFKEAVEKLDKEPEIQRVLQRLCDLYALHGVLTNSGDFLHDGFLSGAQVDMAREAFLDLLPLIRKDAILLTDAFDFSDHCLNSALGCYDGHVYERLFEWAQKYPANTQENPAYKKYIRPLMLGWRHKM

SEQ ID NO: 5774 - DNA, 2415 bp, Homo sapiens
  CDS (71)..(2173)
cggatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggacgtggcgctgttcacggaaggggagggcaatgtccgctttaagaaaaccatcttctcagctcttgagaatgaccctcttttcgctcgttcccctggagccgacctgtccttggagaagtatcgcgagctgaacttccttcgatgcaagcggatcttcgagtatgacttcctcagtgtcgaagcaatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctagataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacggcttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgaagcgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacattcagccaagtctaatgaaacgaagggaactaatcagacgtggacctcaacttctgattccagaacacgccggagattgctgctgctttctgagcccgcacctgtgcgcctaaactgctgattggcctcaacttgcccaggcggacgggagggaggcacccggccggctggacctaatctgggatcgcggtgatttgcaccgtggaaaagaaattgcagattgatcatg

SEQ ID NO: 5775 - protein, 700 aa, Homo sapiens
MASTVEGGDTALLPEFPRGPLDAYRARASFSWKDVALFTEGEGNVRFKKTIFSALENDPLFARSPGADLSLEKYRELNFLRCKRIFEYDFLSVEAMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYGLDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLKRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 5776 - DNA, 2600 bp, Rattus norvegicus
  CDS (41)..(2143)
cgggaccgaccgcaagctggatccggacggtgacagtaccatgggatcctcatcggaaagaagagacagtgttttatggtcagacatccccaagggcccccttagtgcctaccgagcaagagcctccttcaattccaaggagctgatgctcttctgggacggccaggatgtactcgacttcaagaaaaccatcttctcaactttggagaatgaccctctcttcgcccgcccattcggggctgatctgcctctggagaaggaacgagaactgaacttccttcgctgcaagagggtctttgagtatggcttcttcaacgcagaggacatgctaaagaaccccctgaagattctagtattgatgaactgcctgggcatgtacgactggtccctggccaacaaatgtgtcctccacatgttggtttttggatctacaattatcggttctggttctgagcaccatttcaagtaccttgagaagatatataacctggagatttttggctgtttcgctctcaccgaactgagtcatgggagtaataccaaggccatgagaacaacagctcactatgatcctgctactcaggaattcatcttacattctccagatttcgaggctgccaaattttgggtgggcaacctgggcaagaccgcaactcatgcggtggtgtttgcccagctgtacacgccagatggccagtgccgagggctgcattccttcctggtgcagattcgggacccgaagaccctgcttcccatgccaggggtgatggtcggtgacatggggaagaagttgggacagaatggcctggataatggattcgccatgttccacaaagttcgaattcctcgccagaacctgctggaccggaccgggaatgtcacctctgagggacattaccacaccccctttaaggatgtccggcagcgtttgggggcatcattgggcagcctgtcctcgggacgcatctccatcattagcatttctgtggtcaacctgaagctggctgtgatcatagctatccgattctcagccacgcggcgtcagtttggacccacagataaggaagagatccctgtcctcgagtatccactgcagcaatggcgcctacttccatacctggcagctgcctatgccttggaccacttctccaagacaatcttcttggacctgatagagctacagcgtgccggcaaagtggggaccacagtgacaggcaggcagagctcgggacgggagatccacgcactagcatcagcgggcaagcccctagcctcatggacagcccagcggggaattcaggagtgccgtgaggttgttgggggacacggctatctagccatgaaccggtttggcgaactcagaaatgacaacgatccaaactgtacctatgaaggcgacaacaatgtcctgctgcagcagaccagcaactacctgctcagcctcctggagcatcctctccaagacggagctcacttcacaagccctctcaagacagtgaacttcctggaagcctaccctggaatcttgggccagaagttcatggcctccagcaaggctgactggttggactcagaagcccccctggcagcctaccgttggcttgtttgctacctgctccgagagagtcatcagagatactgtcaagagaaaaagtccagaggcagtgactttgaagcaaggaacaacagccaggtgtatggctgccggcccctggccctggccttcatggagctcactgtgatgcagcgcttccacgagcatacacacagctctagcgtgcctccatctctgcggactgtgcttggacggctcagcatgctctacggcctgtggtgcctgagccaacacacggccctgctctaccgaggtggctacatctctggggagcaaacaggaaaagcgatggaggatgccatcctgatgctgtgtgtgcagctgaaagacgatgcggtggccttggtggacgcgattgccccttctgactttgtcctgggctccccaattggcagagctgatggcgagctctataaaaacctgtgggcagctgtcctgcagcagagcggtgtgctggagcgtgcggcctggtggcctgagttcactgccaacaaatctgtggccaacaggctgaagtcccagctgtagacacagttggaggggtgtctgagcaggagcagccgatccagaggcctggacccagacaatcagacacccacgctggaagacacactaaatcctctccttgactctcgtcagcctgcgcgtacccatccccaatggggtatttgcaaggagtttgcacagtgtgtctccccgagggccttggaatttaacaaaggattttgtaatgctatctcgggggcccagataggaatgtaaaggtctgctcaggtaaactttgggatccgtggaagattttcaagatgctctcttctctctgctgctatctgcytcttttaacctggcgtggggtaaccatacgtctgtttaccggccacttgccactctgtacccatggactgtcagaatgtaatttgaagattttttatatgaaaaaaaatgttttattaagtcttcggtggcaccagaagtttccactgag

SEQ ID NO: 5777 - protein, 700 aa, Rattus norvegicus
MGSSSERRDSVLWSDIPKGPLSAYRARASFNSKELMLFWDGQDVLDFKKTIFSTLENDPLFARPFGADLPLEKERELNFLRCKRVFEYGFFNAEDMLKNPLKILVLMNCLGMYDWSLANKCVLHMLVFGSTIIGSGSEHHFKYLEKIYNLEIFGCFALTELSHGSNTKAMRTTAHYDPATQEFILHSPDFEAAKFWVGNLGKTATHAVVFAQLYTPDGQCRGLHSFLVQIRDPKTLLPMPGVMVGDMGKKLGQNGLDNGFAMFHKVRIPRQNLLDRTGNVTSEGHYHTPFKDVRQRLGASLGSLSSGRISIISISVVNLKLAVIIAIRFSATRRQFGPTDKEEIPVLEYPLQQWRLLPYLAAAYALDHFSKTIFLDLIELQRAGKVGTTVTGRQSSGREIHALASAGKPLASWTAQRGIQECREVVGGHGYLAMNRFGELRNDNDPNCTYEGDNNVLLQQTSNYLLSLLEHPLQDGAHFTSPLKTVNFLEAYPGILGQKFMASSKADWLDSEAPLAAYRWLVCYLLRESHQRYCQEKKSRGSDFEARNNSQVYGCRPLALAFMELTVMQRFHEHTHSSSVPPSLRTVLGRLSMLYGLWCLSQHTALLYRGGYISGEQTGKAMEDAILMLCVQLKDDAVALVDAIAPSDFVLGSPIGRADGELYKNLWAAVLQQSGVLERAAWWPEFTANKSVANRLKSQL

SEQ ID NO: 5778 - DNA, 2178 bp, Candida tropicalis
cttaatactactttatcacgatggctatgctcagtcaaccaaacgacggtcacgaccacccggaaaagaaggacccagacacaactccaaagcaagttgctggtgtcatttcctcccaggacccaccacacccagccaaggacgttgctgaagaaagagcacgcaccgactgggacttgaaagaaatgcatgagttcttggaaggtgacgaagcaaagtctgaacaaatcttgcgcttgtaccaatccattgaacgtgacccaatcttgcaaactagaccagaacagtttgactacacccagaagcaagaaagagaattggttgctaacagaatcaaccagatgaccaagttcttggaaaccgaaccttacggtaagttcagaagaagattgcagttgatgactgtcattgacccttccttgggtatcagaatgttggtcaacattgggttgttcttgaactgtgttagaggtaacggtacccaaaagcaattcgacttttggtccaacaagaaggaggccggtattgtcaagcagctttatggttgtttcggtatgaccgaattgggtcatggttccaacgttgctggttgtgaaaccactgccacttttgacgaaaagaccgacgagttcatcattgacaccccacacattggtgccaccaagtggtggatcggtggtgctgctcactcggctacccacactgtgtgttacgccagattgattgtcaaggacgttgactatggtgtcaagacttttattgtgccattgagagactccagacactccttgttgccaggtattgctattggtgacattggtgccaagatgggaagacaaggtgttgacaatggttggattcagttcactgaagttagagtcccaagattcttcatgttgcaaagatggtgtaaggttgaccgtcaaggtaacgttactttgccaccattggagcaattgtcttacatctctcttttggaaggtagagttggtatggctactgattcttacagaattggtgctagatataccactattgctttgagatatgctgttggtagaagacagttttccaagaaggcaggtgaaccagagaccaagttgattgactacactttgcaccaaagaagattgttgccatacttggctttgacctacgctgctgctgttggtaccgacagattggagcgtcaacacgaagagttgttggccaacttggacattgccttggccaagaaggacaagttgttgttgaaaaacaccattacgggcaccaaatccatgtttgttgactctggttccttaaagtccactttgacttggttggctgctgacttgatcaacgaaaccagacaagcttgtggtggtcacggttactcctcttacaacggtttcggtaagacttatgatgactgggttgtccaatgtacttgggaaggtgacaacaacgttttggctatgtctgctggtaagactatcatcaagactgttcaacaagttttgaacggtaaggaattgaaggactctactttggaattcctcaacgctgccccagagttgtccaaggccaagaaggctgttatcagaatcagggaccacgttgacgacgtggaccgtgtcttgaaggccattgctggtttgatttccaagttctccaaggacttgatcccaatctcataccaatcctgggactccattggtgctcaaagagtcatcttgtctaagttgagatgtcactactacttgttggagacattcaacgaaagattgaatgacaaaatcaaggccaagtccccagccagaccacacttggaaaatatcatcaagttgtactacgtcaccaacatcttgggtccattcattgacgaattcttgagatttggtgttatttccccacaggttgccaagtacatcacttatgaatatccacaaaagttgtgtgccaatattagaccatatgttattggtttgactgactctttccaacaaccagacaacttcatcaactcgttgattggtaagtacgacggtaacatctacaccaactacttggaatccgtcaaggacgtcaacgacccatccaactacaaggcaccatactctgaagccttggaagccatgttgaaccgttctgcactcgagaacagagaaagatccgagagaggtaaagccgccgtag

SEQ ID NO: 5779 - protein, 718 aa, Candida tropicalis
MAMLSQPNDGHDHPEKKDPDTTPKQVAGVISSQDPPHPAKDVAEERARTDWDLKEMHEFLEGDEAKSEQILRLYQSIERDPILQTRPEQFDYTQKQERELVANRINQMTKFLETEPYGKFRRRLQLMTVIDPSLGIRMLVNIGLFLNCVRGNGTQKQFDFWSNKKEAGIVKQLYGCFGMTELGHGSNVAGCETTATFDEKTDEFIIDTPHIGATKWWIGGAAHSATHTVCYARLIVKDVDYGVKTFIVPLRDSRHSLLPGIAIGDIGAKMGRQGVDNGWIQFTEVRVPRFFMLQRWCKVDRQGNVTLPPLEQLSYISLLEGRVGMATDSYRIGARYTTIALRYAVGRRQFSKKAGEPETKLIDYTLHQRRLLPYLALTYAAAVGTDRLERQHEELLANLDIALAKKDKLLLKNTITGTKSMFVDSGSLKSTLTWLAADLINETRQACGGHGYSSYNGFGKTYDDWVVQCTWEGDNNVLAMSAGKTIIKTVQQVLNGKELKDSTLEFLNAAPELSKAKKAVIRIRDHVDDVDRVLKAIAGLISKFSKDLIPISYQSWDSIGAQRVILSKLRCHYYLLETFNERLNDKIKAKSPARPHLENIIKLYYVTNILGPFIDEFLRFGVISPQVAKYITYEYPQKLCANIRPYVIGLTDSFQQPDNFINSLIGKYDGNIYTNYLESVKDVNDPSNYKAPYSEALEAMLNRSALENRERSERGKAA

SEQ ID NO: 5780 - DNA, 3670 bp, Xenopus laevis
  CDS (10)..(1995)
gacaagagaatgaacccagacttaagcagggagagggccgccgcctccttcaatcccgagaccatcacctacatcctggatggcagccccgagaggacccacaggaggagagaaattgagggcctggttctcaatgaccccagcttccagcatgaagaccccaactttctgtcacgcagtgagcggtacgaagtggccatcaagaagagtgccctgatggttcagaagatgagggaacatggcatctccgacccagaggagatctactggttcaaaagaacctgccttggctctcaaaccgaccccctgggcttacacttcagtatgttcagcaacatgttagccaatcaattgacggatttgcagaagcagaagtggttgccccttgccagtcatctgcaggtcattggcacctatgcccagacagagctgggacatggaacccacctccgagggctggagaccacagctacctatgatccatccacccaggagttcattctcaacagcccaactgtttcttctatcaaatggtggcctggaggattgggaaagacctcaaatcatgctgtagtgctggcacaactttacacacaaggagaatgtaaagggcttcaagcttttatagtgcctatccgccacatgggcacccatgaacctcttccaggtgtggtggttggagacataggacctaagtttggatatgatgaaacagataatgggttccttaagtttgacaaagttcgaattcctcgagagaatatgctgatgaagtatgccaaggtggagccagatgggacttacgtgaagccactcagtgacaaactgacctatggcactatggtgtttattcgttcgatgattgtgggagactctgcacgcagcctttcccgggcctgtaccattgctattcggtatagtgcagtgaggcaccagtcagagatcagagctggagagccagaaccccaaatcctagactttcagactcagcaattcaagttattcccactgctggctacagcatatgccttccagtttgtgggatcctacatgagccacacttaccacagaatcagcgctgaaatccaagctggtaacctgaatgaactgcctgagctgcatgccctttctgcgggcttgaaagccttcacatcatgggcagccaatgcaggtattgaggagtgcaggatggcatgtggtgggcatggatactcccgttccagtgggataccagatatctatgtgacctttactccttcatgcacatatgagggtgaaaacacagtgatgatgctgcagactgcaaggtttttggtaaaaagctacatagctgttcttgctgggaaacaacttgatggaacggtgtcatacctcaatgatgtttcccagcaccgtgtacagccccaccctgttgctggccgatcctttctcaaggacatcaatgacattcaaaatctggtggaggcctacaaacagcgagctgcatggttagttgtggctgctgccaagaatgtgaacgctgacacaaaacgtggaaagcgcaaggaagatgcatggaataagaattctgtagatcttgtccgagcttcagaggcacactgtcattatgtggtcgtgagactctttgcagaaaagttgtctgaggttctcgatgtggctgctcatcgtattctgagctctctctgcctgttctacgccctacatgggatcagcaagaacactggagacttccttcaggctggacttctgaccgcccttcaggttgatcaagtgcagcaaagagtaaaggatctgctagcagtaatccgtcctaatgcactggctttggtggatgcctttgattactcagacacacaactgggatctgttctgggtagatatgatggcaacgtctatgagaatatgtttgagtgggcaaagaaatcaccactcaacaaaacacaggtgcatgaatcctttcacaagtacttgaaacctttacagtccaaactgtgatccgcccaccaatgccgcttaacctgaaactggaaacacaaaaagcagttttctttgtttgataaccaaccctcgaagtaatgaaattgttcacctaatttccatcaaatgttgttgattagcaaggggccaaagcaaggcgtaagcaatggaatcccacattaactgagattttaccaaacctttggcacggcttgttgttgctctaggttggagacaaccatatagttggtagagccataccgacccttttagcctttataagaacaacattgtttgtatagtggttaataaacaaaagtaggagcaatgatccatctaaccagcagaagcgcctctctattaatgttaaaaagaggtggaagtccaatttataataaacctttcagaatgatgtagcaatgatattctaaaggccagatttgtcgatgtgtgagattggagctcgctacgggaaagtttgctggctttctgttcattcctatgggaatgaattgtatttattgaatggtgaaactctcactttcacccactgataaatatgatttcaaaaattccatgggtttgaatagaaggtgggtgaatttttctgtggtgggctctggtctcacattttgataaatctacctctaaactttcgtctgggtctagaatttgagctgtttactgtttgagtgccaggctcactgaatttagcaacaggatagtataagtaaaatggggggagaagtgctaaagaagagaaagataagcaatacacagttataatagcatttgacccacatccacctgcttttagggttaccaggcacacttccatagaaaccaaatggaatttttaagttattcttcgaagagatgcaaaatagaaaagaatataaaagagacttaactgcacagtatattgggatacatttgtcaatactagttatgggcgaataaatttgcccgtcgagaatttctgcgtttcactggcagcgaataaattcacgaaaattctacagcgtcaaaaaattttggacgcacgtcagaatagttgtttgcatcaaaatcgccgagcgtcaacaatattcagacacccattggggtaaatttatcaaagagtgaagttcagccactagagtggggttccgcagctctcgattcatttctgtgggattttgagaggcgtatttatcaatgggcgaaagtgaaagttcgccctttgataaatgcgcctgtaagggtcccatggaggtgggtggagagtggcggaatttcactctagtggcggaacttcactattaacttcactctttgataaaataccccattgactttaccgcaggtgtcaattttcaagtttcactaatttttcaccatttcgcgggaagttcccaaatattccgtgaagcggaacggcaaaaattctcccatcactagtcaatacacttaatgttattctaaaggagagcttgtactttaaggatcgcttttgaccacagaaagtaagggaatatttatctaatggacctggaagtgttcactgtaatgtttcaatgttgttatttgatgcatagctgagactgcctcatcattaatataaagagagagaagtatgaaatgtaattaatctgttaatttttatgtaaagatattaataaagttgtgttctttcttaaaaaaaaaaaaaaaa

SEQ ID NO: 5781 - protein, 661 aa, Xenopus laevis
MNPDLSRERAAASFNPETITYILDGSPERTHRRREIEGLVLNDPSFQHEDPNFLSRSERYEVAIKKSALMVQKMREHGISDPEEIYWFKRTCLGSQTDPLGLHFSMFSNMLANQLTDLQKQKWLPLASHLQVIGTYAQTELGHGTHLRGLETTATYDPSTQEFILNSPTVSSIKWWPGGLGKTSNHAVVLAQLYTQGECKGLQAFIVPIRHMGTHEPLPGVVVGDIGPKFGYDETDNGFLKFDKVRIPRENMLMKYAKVEPDGTYVKPLSDKLTYGTMVFIRSMIVGDSARSLSRACTIAIRYSAVRHQSEIRAGEPEPQILDFQTQQFKLFPLLATAYAFQFVGSYMSHTYHRISAEIQAGNLNELPELHALSAGLKAFTSWAANAGIEECRMACGGHGYSRSSGIPDIYVTFTPSCTYEGENTVMMLQTARFLVKSYIAVLAGKQLDGTVSYLNDVSQHRVQPHPVAGRSFLKDINDIQNLVEAYKQRAAWLVVAAAKNVNADTKRGKRKEDAWNKNSVDLVRASEAHCHYVVVRLFAEKLSEVLDVAAHRILSSLCLFYALHGISKNTGDFLQAGLLTALQVDQVQQRVKDLLAVIRPNALALVDAFDYSDTQLGSVLGRYDGNVYENMFEWAKKSPLNKTQVHESFHKYLKPLQSKL

SEQ ID NO: 5782 - DNA, 2476 bp, Xenopus laevis
  CDS (69)..(2081)
gtgattgttgtcctgagattcggtgcaggggcagtcagtgtcagtcagtgctcggtctatcacgcacaatgatctggtggcggacaagctcggcggatactgatgtgaatccggacctggccagtgagagagccttcccgtccttctgtgtggagactctcactaacctgctggatggctctgtggacaaaacacgcttgaggagatatgtggttagcaccatcttgaaagatccagttttcagtagagagggtcactattttaagacgcgtcaagagcgatatgaaggggccgtgcgcaacattcttcatctgaagcagaagataaaggaactgggatggttggaagatggaccagaaggtgaatttatttacagggccatgggaggagaagttgccctgaacatccacggtgtctttgtaaaatctatttcggcgctggggacggatgaacagattgccaaatggcttcccttagcaaataattgcaacatcctgggcacatatgcacaaactgaacttggacatggaacatatctacggggactggaaaccacagcaacctttgacatttccaaccagcaattcatcatcaacacacctcggataacagccacaaaatggtggcctggagacctgggtaagacgtgcacacatgccatggttctggcccaattgattatcaaacagaagaattatgggatgcacctcttcattgtacaggttcgaagtctgaaggatcattcaccaatgccaggaataacagttggggacattgggccaaaaatgtcttttgaacatatagataatggatttctcatgatgaggaatatccgtgttccgaaggagaacatgctgagcagattttctgaggtcctgccggatggaacgtacgtgaaacgaggctctgataagattaactatttcaccatggtcgctgtgagggtgtcgatgttgcgccaagaggttctggaggcgctgatgaaggcctgtaccatttccataagatacgcagctgttcgccggcagtcagagctgaagcctggggatagagagccaaaaatcctagagtaccaaacccagcaacagaagctgcttccccttctagcaacttgctacgctattcattataccgtctgtcacgtcaacaaagtatatgatgaagtgtgtggagcaattcaagcagggaattttgactcccttcctgagctccatgcactggtttcaggaatgaaagcatatgccacagagacatgctctaatggaatcgaagtgtgcagaaaggcttgcgggggtcatggctactccctttttagtggcctcccctccctctacactaaggtgactgcttcctgtacctacgagggagaaaacactgtgctgcatctgcaagctgcaaggtttttgatcaaatgttatgctgctgcccagtctggtcagtctcttcctcaaagtgtggcttatctgtcttctccgatctcaggagtgtgccaagctactagccacacagatttcctcaaccctgaggtctatataaaggcctatcagcacagggcccacaggctcattgcctctgctgcctttaagatgcgcaacctggttcagtttggaatggaacaatatgatgcgtggaacagcacatccgtggagcttgtaaaggcctcaatagctcattcacattacattattgtgaagttgtttgctgatgtaacgggctccttatcaagttctcctgaaatcaagaaattacttaaaagcctttgtgaccttcatgcactacatggaatattcaccagctctggagatttccttcaggatgggcatctgtctggccatcagctggagatggtcaccgaggcataccttagcctcctgacgctcataaggagagatgctgttttgctggttgatgccttcgattacgcggatcagcagcttctgtcagctcttggcagctatgatggcaatgtgtatcacaatctccttgagtgtgctcagaaaaacccagataataagaaggtgaatgctgtctttgaaaattacctgaagccacatttacaaagcaatatatcaaaactataaagagaacctcatcccgatgttcttttttgcctaacccataaagcactgggatatgtgagtgttgccttaattatgatgaacaccaaatgtttcctgaagccttaacttacatcctgccaatttatatttgcacttaaactattctactataaactgttcgatgcctggcctccttctggggcataattcatagaaatgcaggttgggggaaggtagatgccaaaataacaacccccagcgttccctccatccaacttcagcctttgtaatgtgattttacaaaaatgttggttttaattattttgctgtcttcatagaatgagtgtaaagaatacaacttataattatataaaatgcaaataaatctgccttatgatggaaaaaaaaaaaaaaaa

SEQ ID NO: 5783 - protein, 670 aa, Xenopus laevis
MIWWRTSSADTDVNPDLASERAFPSFCVETLTNLLDGSVDKTRLRRYVVSTILKDPVFSREGHYFKTRQERYEGAVRNILHLKQKIKELGWLEDGPEGEFIYRAMGGEVALNIHGVFVKSISALGTDEQIAKWLPLANNCNILGTYAQTELGHGTYLRGLETTATFDISNQQFIINTPRITATKWWPGDLGKTCTHAMVLAQLIIKQKNYGMHLFIVQVRSLKDHSPMPGITVGDIGPKMSFEHIDNGFLMMRNIRVPKENMLSRFSEVLPDGTYVKRGSDKINYFTMVAVRVSMLRQEVLEALMKACTISIRYAAVRRQSELKPGDREPKILEYQTQQQKLLPLLATCYAIHYTVCHVNKVYDEVCGAIQAGNFDSLPELHALVSGMKAYATETCSNGIEVCRKACGGHGYSLFSGLPSLYTKVTASCTYEGENTVLHLQAARFLIKCYAAAQSGQSLPQSVAYLSSPISGVCQATSHTDFLNPEVYIKAYQHRAHRLIASAAFKMRNLVQFGMEQYDAWNSTSVELVKASIAHSHYIIVKLFADVTGSLSSSPEIKKLLKSLCDLHALHGIFTSSGDFLQDGHLSGHQLEMVTEAYLSLLTLIRRDAVLLVDAFDYADQQLLSALGSYDGNVYHNLLECAQKNPDNKKVNAVFENYLKPHLQSNISKL

SEQ ID NO: 5784 - DNA, 1953 bp, Mycobacterium paratuberculosis
  CDS (1)..(1953)
atggcgccagaaacgacaagcacagccgaacatctgcgcaacgcactggacgggcgttggcgtgacgtcagaaaccggatgcgggagacgctgagcgaggacctgttccgtccccactacacccccaacaccgtgatcgcccgcaccaaggtggccgagcagatgcggattatggcggcgttcggcgcggccgccgacggcttccgcaaagaacacggcggcaccggcgatgtcggcgcggcgatcaccatgatcgagatgctggcgatgtcggacctgtcgttgatggtgaaggccggggtgcagtggggcctgttcggcggggccgtggagaacctgggcaccgagcgccatcacgagacctacgtgcccaagatcatcagcctggagttgcgcggttgtttcgcgatgaccgagaccgggcacggcagcgacgttcagtcgctggagacgaccgccacctacgacccggcgaccgacgagttcgtgatcgactcccccaccccgtcggcccgcaaggactacatcggcggggccgccgaaaccgccacggtggcagcggtattcgcgcaactgatcaccaccgaagacggcaagccggtcaatcacggtgtgcactgcctcttggtgccgatccgtgacgccgacggcaacgacctgcccggggtgaccacctcggactgcgaatacaagggcggcctgcccggggtggacaacgggcgcatcgtgttcgaccacgtccgtgtgccccgggtcaacctgctgaacaagtacggcgacgtggccccggacggcacctacagctcgccgatcgagaatcccaaccgccggttcttcaccatgctgggcacgctggttcgcggccggatcacggtcggcggcagcgccggtgcggcgggccgggtggcgctggacatcgccacccgatatgcgttgcagcgcaagcaattcaccaccccggacggcgactccgaggtgctgatcatggactacctggtgcaccagcggcggttgttcccgttgatcgccaagtcatacgcgctgcagttcgcgcagaacgaactggtcagcaagtgccacgacatccagagcgccgacgatcccgatgccgacgagcagcgcgaactggaagcgcgcgcggccgggctgaaggccgccaacacctggcatgcgacgcgggcgatccaggagtcccgcgaggcctgcggcggcgcgggctatatggccgagaaccggctgatcgcgctgcgcggcgacaccgacgtgttcaccaccttcgagggcgacaaccacgtgctgacccagctggtggccaaggagctgctgaccgcctacgccgacgacatcaagagcatgagtccggtcgaatgggttcgcttcgccgccaacgccgttggcgatcgcgtcatcaaacgcaccgcggccgagacgatcatccagaccatcgtcgacgcccggcaggacagcgaggaagagggcagcctgttcaaccgcggcacccagatcaagatgttcgaagaccgcgaggagtatctgctggcctcggtggcgcggcggctgcaggcgaaatcgaaagagatgtccgaattcgacgcgttcaactcggtgcaggaccatgtgttgcacgcggccagcgcgcacatcgaccgggtggtgctggaagcgttcgtcgccggcatcgacggctgccccgacgagcaggcccgcgagctgttgggcatcctgtgcgacctgtacgcgctgtcggtgatcgaggacgacaaggcctggtacatcgagcaccgctacctgtccaccgagcgcgccaaggcggtcacccggggcatcaatgaccgctgccgggcgctgcggccgcacgcccaaaccctggtcgacggtttcgggatccccgagcggctgcgctacgccgagatgctgcacccggagaacctgtcggaggccctcacgagctga

SEQ ID NO: 5785 - protein, 650 aa, Mycobacterium paratuberculosis
MAPETTSTAEHLRNALDGRWRDVRNRMRETLSEDLFRPHYTPNTVIARTKVAEQMRIMAAFGAAADGFRKEHGGTGDVGAAITMIEMLAMSDLSLMVKAGVQWGLFGGAVENLGTERHHETYVPKIISLELRGCFAMTETGHGSDVQSLETTATYDPATDEFVIDSPTPSARKDYIGGAAETATVAAVFAQLITTEDGKPVNHGVHCLLVPIRDADGNDLPGVTTSDCEYKGGLPGVDNGRIVFDHVRVPRVNLLNKYGDVAPDGTYSSPIENPNRRFFTMLGTLVRGRITVGGSAGAAGRVALDIATRYALQRKQFTTPDGDSEVLIMDYLVHQRRLFPLIAKSYALQFAQNELVSKCHDIQSADDPDADEQRELEARAAGLKAANTWHATRAIQESREACGGAGYMAENRLIALRGDTDVFTTFEGDNHVLTQLVAKELLTAYADDIKSMSPVEWVRFAANAVGDRVIKRTAAETIIQTIVDARQDSEEEGSLFNRGTQIKMFEDREEYLLASVARRLQAKSKEMSEFDAFNSVQDHVLHAASAHIDRVVLEAFVAGIDGCPDEQARELLGILCDLYALSVIEDDKAWYIEHRYLSTERAKAVTRGINDRCRALRPHAQTLVDGFGIPERLRYAEMLHPENLSEALTS

SEQ ID NO: 5786 - DNA, 2166 bp, Ashbya gossypii
  CDS (1)..(2166)
atgacaaaggcatcagtggtggaccagtccgcgccggcgtacgcgcccaagcggctgctggcagaggcgcgcgcggcgtcgaaggtgaacatcgagcaggtcttcgcgtttctggaaggctcgccggagaaggcggcgctgacgaacgagctactggcggagtttgcagccgaccctgcgatcacgcagggcccggagtactacgacctcacaaaggccgagcagcgggagcagacggtgaagaagatcgcgcggctggcgctgtacttggagaatgacattaagctggcacgcaagcagcaccacaaggacgtggtgcgggacctgcagtcgccggacgcgccgatggtgactatgagcgacatggaacgcttcgagaagcgctcaacgctggtggcgctgatcgacccgcagctggcaacgcggctgggcgtgaacctgagcttgttcggtaatgccgtgcggggtaacggcacggacgaacagatcaagtattggctgcaggagcgcgggctcatcttcgtgaagggcatctatggctgcttcgcgatgacagagctaggccatgggtccaacgtggcgaacctgcagacacgcgctacgtacgaccctgcgagcgactcgtttgtgattcagacgcccgaccttgtcgcgacgaagtggtggatcggcggtgctgcgcacagcgcgacgcactcgaccgtgtacgcccgtctgatcgtggagggcaaggactacggcgtgaaggtcttcgtggtgcctctgcgcaaccccaagaccatggagttgctggccgggatttccatcggcgacatcggctccaagatgggccgcgacggtatcgacaacggctggatccagtttaacaatgtgcgtattccccgtgagtacatgctgagccggtttacgaaggtgatccccggcaacccgccaaaggttgagatggagcctctgttggactccatctccggctacgccgcgttgctgtccggacgtgtgagcatggtattggactcctaccgctttggcgcacgcttctccaccatcgccacgcggtatgcctttggcagacagcagtttggtgacccaaccaatgagacccagctaatagagtacccattgcaccagttccgtgttctccctcagcttgccataatatacatgatggcgccgggcgcgatgaagttgatggacacatacaacagctgtttgggtgagttgtacggtgctggcgatgacaagaagaagttgactactgttagcgccagaatgaaggacttgtttgtggagtctgccagtttgaaggccacctgcacttggttgacttcgacgttgatcgacgagttgagacagacctgcggtggccacgggtactccagctacaacggtttcggaaaggcatacaacgactgggtcgttcagtgcacttgggaaggcgacaacaacgttctgtgtttgacctctggtaagtcgctgctcaagaagttcgctggtattgttcgtggcaagaaggtgactatctgtgacacctccatggactacctccgcatggactacatccagaaggtggttatgggcggcaccaaaaaggtgagcaacttatccacacttccagactactaccagatctggtcggttatcttggtgaagtacttgaagcgctgcgccgagactgtccgtgacaacaacgacccagaatctgtgtccaagctgctcgtgagtatcgccaagttccacgcattctactctatgctccaggagttccaccgcaagttggcctctgaccagagccacgtgggcgacgccgcaaccaaggaggtcttgtggaaggtctacaagctctcctcgctctacttcatcgacaagttcagcggcgagttccagcagttgaaggtcatgtccccagaccagatgacgaacgtgcaggagcagatgttggctatcctgcctgagatcaagacacacgccatccgtctaactgacgcctttcaccttcctgacgccgtgatcaactcatctatcggcaactacgacggcgacatttaccacaactacttcaacgatgtcacccgtgttgccgccaaggacaaggctccaggtgtgcccccatacgcggacaatgcttgtcaacttagtgggctcgtgacgaccagttcgacaatttga

SEQ ID NO: 5787 - protein, 721 aa, Ashbya gossypii
MTKASVVDQSAPAYAPKRLLAEARAASKVNIEQVFAFLEGSPEKAALTNELLAEFAADPAITQGPEYYDLTKAEQREQTVKKIARLALYLENDIKLARKQHHKDVVRDLQSPDAPMVTMSDMERFEKRSTLVALIDPQLATRLGVNLSLFGNAVRGNGTDEQIKYWLQERGLIFVKGIYGCFAMTELGHGSNVANLQTRATYDPASDSFVIQTPDLVATKWWIGGAAHSATHSTVYARLIVEGKDYGVKVFVVPLRNPKTMELLAGISIGDIGSKMGRDGIDNGWIQFNNVRIPREYMLSRFTKVIPGNPPKVEMEPLLDSISGYAALLSGRVSMVLDSYRFGARFSTIATRYAFGRQQFGDPTNETQLIEYPLHQFRVLPQLAIIYMMAPGAMKLMDTYNSCLGELYGAGDDKKKLTTVSARMKDLFVESASLKATCTWLTSTLIDELRQTCGGHGYSSYNGFGKAYNDWVVQCTWEGDNNVLCLTSGKSLLKKFAGIVRGKKVTICDTSMDYLRMDYIQKVVMGGTKKVSNLSTLPDYYQIWSVILVKYLKRCAETVRDNNDPESVSKLLVSIAKFHAFYSMLQEFHRKLASDQSHVGDAATKEVLWKVYKLSSLYFIDKFSGEFQQLKVMSPDQMTNVQEQMLAILPEIKTHAIRLTDAFHLPDAVINSSIGNYDGDIYHNYFNDVTRVAAKDKAPGVPPYADNACQLSGLVTTSSTI

SEQ ID NO: 5788 - DNA, 2025 bp, Caenorhabditis elegans; identical to SEQ ID NO: 5678
  CDS (337)..(2025)

SEQ ID NO: 5789 - protein, 562 aa, Caenorhabditis elegans
MALHGVMFIPALNAQASDEQQAKWLIRALRREIIGTYAQTEMGHGTNLQNLETTATYDIGTQEFVLHTPKITALKWWPGNLGKSSNYAVVVAHMYIKGKNFGPHTFMVPLRDEKTHKPLPGITIGDIGPKMAYNIVDNGFLGFNNYRIPRTNLLMRHTKVEADGTYIKPPHAKINYSAMVHVRSYMLTGQAIMLSYALNIATRYSAVRRQGQIDKNEPEVKVLEYQTQQHRLFPFIARAYAFQFAGAETVKLYERVLKEMKSGNVSLMADLHALTSGLKSVVTHQTGEGIEQARMACGGHGYSMASYISEIYGVAIGGCTYEGENMVMLLQLARYLVKSAALVKSGKASQLGPLVAYLGARSEPTSLIDRVPNGGITEYIKTFQHIAKRQTLKAANKFFGLMENGEKREIAWNKSSVELNRASRLHTRLFIVEAFARRVNEIGDITIKEALSDLLHLHVNYELLDVATYALEDGFMSSTQLDYVRDQLYFYLQKIRPNAVSLLDSWEFSDRELRSVLGRRDGHVYENLFKWAKESPLNKTDVLPSVDTYLKPMMEKARQSKL

SEQ ID NO: 5790 - DNA, 25 bp, artificial sequence
  Primer
atgacgagacgtactactattaatc

SEQ ID NO: 5791 - DNA, 28 bp, artificial sequence
  Primer
tcacttgtttattttcgataaaatttcc

SEQ ID NO: 5792 - DNA, 1716 bp, Saccharomyces cerevisiae; identical to SEQ ID NO: 230
  CDS (1)..(1716)

SEQ ID NO: 5793 - protein, 571 aa, Saccharomyces cerevisiae; identical to SEQ ID NO: 231

SEQ ID NO: 5794 - DNA, 2817 bp, Neurospora crassa; identical to SEQ ID NO: 1285
  CDS (1)..(2817)

SEQ ID NO: 5795 - protein, 938 aa, Neurospora crassa; identical to SEQ ID NO: 239

SEQ ID NO: 5796 - DNA, 2658 bp, Mus musculus; identical to SEQ ID NO: 1287
  CDS (1)..(2658)

SEQ ID NO: 5797 - protein, 885 aa, Mus musculus; identical to SEQ ID NO: 245

SEQ ID NO: 5798 - DNA, 2583 bp, Xenopus laevis; identical to SEQ ID NO: 246
  CDS (1)..(2583)

SEQ ID NO: 5799 - protein, 860 aa, Xenopus laevis; identical to SEQ ID NO: 247

SEQ ID NO: 5800 - DNA, 2568 bp, Homo sapiens; identical to SEQ ID NO: 1291
  CDS (1)..(2568)

SEQ ID NO: 5801 - protein, 855 aa, Homo sapiens; identical to SEQ ID NO: 241

SEQ ID NO: 5802 - DNA, 2625 bp, Homo sapiens; identical to SEQ ID NO: 242
  CDS (1)..(2625)

SEQ ID NO: 5803 - protein, 874 aa, Homo sapiens; identical to SEQ ID NO: 243

SEQ ID NO: 5804 - DNA, 2076 bp, Caenorhabditis elegans; identical to SEQ ID NO: 1295
  CDS (1)..(2076)

SEQ ID NO: 5805 - protein, 691 aa, Caenorhabditis elegans; identical to SEQ ID NO: 235

SEQ ID NO: 5806 - DNA, 1782 bp, Schizosaccharomyces pombe; identical to SEQ ID NO: 1297
  CDS (1)..(1782)

SEQ ID NO: 5807 - protein, 593 aa, Schizosaccharomyces pombe; identical to SEQ ID NO: 237

SEQ ID NO: 5808 - DNA, 26 bp, artificial sequence
  Primer
atgaatgatcctcgtgaaattttagc

SEQ ID NO: 5809 - DNA, 25 bp, artificial sequence
  Primer
ttatattatctcaagatcgctggca

SEQ ID NO: 5810 - protein, 33 aa, artificial sequence; identical to SEQ ID NO: 4356
  MISC_FEATURE (1)..(33): consensus for the disclosure of xaa see table XV

SEQ ID NO: 5811 - protein, 36 aa, artificial sequence; identical to SEQ ID NO: 4357
  MISC_FEATURE (1)..(36): consensus for the disclosure of xaa see table XV

SEQ ID NO: 5812 - protein, 39 aa, artificial sequence; identical to SEQ ID NO: 4358
  MISC_FEATURE (1)..(39): consensus for the disclosure of xaa see table XV

SEQ ID NO: 5813 - protein, 323 aa, artificial sequence
  MISC_FEATURE (1)..(323): consensus Xaa in all positions is any amino acid.
ALXXAXXXIEXXFGKGXXMXXGXXXXXXXXXXXXXXGSXXLDXALGXGGXPXGRXXEIYGPESSGKTTXXLXXXAXXQXXGGXXAFXDAEHALDPXYAXXLGVXXXXLXXSQPDXGEQALEIXXXLXRSXAXDXXVXDSVAALXPXAEIEGXMGDXXXGLQARXMSQAXRKXXXXXXXXXXXXIFINQXRXKXGVMXGXXXXPETTXGGXALKFYXSVRLDXRXXXXXKXXXXXXXXXXGXXXXXKVVKNKXAPPFXXXXXXIXXXXXXXXXXGXGIXXXGXXXDXXXXXXXXXKXGXWXXYXXXXXXXXXXGQGXXXXXXXL

SEQ ID NO: 5814 - protein, 19 aa, artificial sequence
  MISC_FEATURE (1)..(19): consensus for the disclosure of xaa see table XV
  for the disclosure of the amendment in position 4 see table XVI
XXXXEXXXGXXXXXXXXXX

SEQ ID NO: 5815 - protein, 607 aa, artificial sequence
  MISC_FEATURE (1)..(607): consensus Xaa in all positions is any amino acid
  for the disclosure of the amendment in position 223 see table XVI
FXXXXXXXXXXXXXXXXXXXXXXXXXXXXXGXXAXTEXXHGXXXXXXXTXAXXDXXXXEFXXXXPXXXXXKXWXGXXXXXXXXXXXXXAXLXXXXXXXXXXXXXXGXXXFXVXXRXXXXXXXXXGXXXGDXGXKXGXXXXXXXDNGXXXXXXXRXPRXXXLXXXXXVXXXGXXXXXXXXXXXXXXXXXXXXXXXXXXXXXRXXXXXXXXXXXXXXXXXIAXRYXXXRXQXXXXXXXXXXXXXXEXXXXXXXXXQXXLXPXLAXXXXXXXXXXXXXXXXXXXXXXXXXXXXXXXXXXXXXXXXXXXXXXXXXXXXXXKXXXXXXXXXXXXXXRXXCGGHGYXXXXXXXXXXXXXXXXXXXXXXXXXXXXXXXXXXXTXEGXNXVXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXD

SEQ ID NO: 5816 - protein, 60 aa, artificial sequence; identical to SEQ ID NO: 1957
  MISC_FEATURE (1)..(60): consensus xaa in position 2 till 12 is any amino acid, xaa in position 13 is any or no amino acid, Xaa in all other positions is any amino acid,
  for the disclosure of the amendment in position 16 see table XVI

SEQ ID NO: 5817 - protein, 569 aa, artificial sequence
  MISC_FEATURE (1)..(569): consensus Xaa in all positions is any amino acid
DXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXGXKXXXLXXXXXXXXXXXXXXXXXXXXXVXXXXXXXXXXXXXXXXXXXXXXXXXXXXXXXLXDXXXXXXXXLFXXXXXXXXWXXXXGXVXXXLNXXXXXXXXXXXXXXXXXXXLXXXXXXXXXLXXGXXXXLGXCXXXXXKXGXXCXXXXNXXXXXXCXXHXXXXXXXXXXXRXXXXXXXXXXXXXXXXXXXXXXXXXXXXXXXXXXXXXXXXXXXXXXXXXXXXXXXXXXXXXT

SEQ ID NO: 5818 - DNA, 1350 bp, Escherichia coli K12; identical to SEQ ID NO: 4558
  CDS (1)..(1350)

SEQ ID NO: 5819 - protein, 449 aa, Escherichia coli K12; identical to SEQ ID NO: 4559

SEQ ID NO: 5820 - DNA, 7367 bp, Gallus gallus (chicken); identical to SEQ ID NO: 4560
  CDS (154)..(7128)

SEQ ID NO: 5821 - protein, 2324 aa, Gallus gallus (chicken); identical to SEQ ID NO: 4561

SEQ ID NO: 5822 - DNA, 7038 bp, Rattus norvegicus (Norway rat); identical to SEQ ID NO: 4562
  CDS (1)..(7038)

SEQ ID NO: 5823 - protein, 2345 aa, Rattus norvegicus (Norway rat); identical to SEQ ID NO: 4563

SEQ ID NO: 5824 - DNA, 6270 bp, Cyclotella cryptica; identical to SEQ ID NO: 4564
  CDS (1)..(6270)

SEQ ID NO: 5825 - protein, 2089 aa, Cyclotella cryptica; identical to SEQ ID NO: 4565

SEQ ID NO: 5826 - DNA, 7360 bp, Triticum aestivum (common wheat); identical to SEQ ID NO: 4566
  CDS (159)..(6932)

SEQ ID NO: 5827 - protein, 2257 aa, Triticum aestivum (common wheat); identical to SEQ ID NO: 4567

SEQ ID NO: 5828 - DNA, 1476 bp, Methanobacterium thermoautotrophicum; identical to SEQ ID NO: 4568
  CDS (1)..(1476)

SEQ ID NO: 5829 - protein, 491 aa, Methanobacterium thermoautotrophicum; identical to SEQ ID NO: 4569

SEQ ID NO: 5830 - DNA, 1353 bp, Bacillus subtilis; identical to SEQ ID NO: 4570
  CDS (1)..(1353)

SEQ ID NO: 5831 - protein, 450 aa, Bacillus subtilis; identical to SEQ ID NO: 4571

SEQ ID NO: 5832 - DNA, 1419 bp, Aquifex aeolicus; identical to SEQ ID NO: 4572
  CDS (1)..(1419)

SEQ ID NO: 5833 - protein, 472 aa, Aquifex aeolicus; identical to SEQ ID NO: 4573

SEQ ID NO: 5834 - DNA, 1377 bp, Pseudomonas aeruginosa; identical to SEQ ID NO: 4574
  CDS (1)..(1377)

SEQ ID NO: 5835 - protein, 458 aa, Pseudomonas aeruginosa; identical to SEQ ID NO: 4575

SEQ ID NO: 5836 - DNA, 3453 bp, Bacillus halodurans; identical to SEQ ID NO: 4576
  CDS (1)..(3453)

SEQ ID NO: 5837 - protein, 1150 aa, Bacillus halodurans; identical to SEQ ID NO: 4577

SEQ ID NO: 5838 - DNA, 1347 bp, Agrobacterium tumefaciens; identical to SEQ ID NO: 4578
  CDS (1)..(1347)

SEQ ID NO: 5839 - protein, 448 aa, Agrobacterium tumefaciens; identical to SEQ ID NO: 4579

SEQ ID NO: 5840 - DNA, 1731 bp, Agrobacterium tumefaciens; identical to SEQ ID NO: 4580
  CDS (1)..(1731)

SEQ ID NO: 5841 - protein, 576 aa, Agrobacterium tumefaciens; identical to SEQ ID NO: 4581

SEQ ID NO: 5842 - DNA, 1350 bp, Yersinia pestis; identical to SEQ ID NO: 4582
  CDS (1)..(1350)

SEQ ID NO: 5843 - protein, 449 aa, Yersinia pestis; identical to SEQ ID NO: 4583

SEQ ID NO: 5844 - DNA, 1365 bp, Listeria monocytogenes; identical to SEQ ID NO: 4584
  CDS (1)..(1365)

SEQ ID NO: 5845 - protein, 454 aa, Listeria monocytogenes; identical to SEQ ID NO: 4585

SEQ ID NO: 5846 - DNA, 3525 bp, Agrobacterium tumefaciens; identical to SEQ ID NO: 4586
  CDS (1)..(3525)

SEQ ID NO: 5847 - protein, 1174 aa, Agrobacterium tumefaciens; identical to SEQ ID NO: 4587

SEQ ID NO: 5848 - DNA, 1992 bp, Agrobacterium tumefaciens; identical to SEQ ID NO: 4588
  CDS (1)..(1992)

SEQ ID NO: 5849 - protein, 663 aa, Agrobacterium tumefaciens; identical to SEQ ID NO: 4589

SEQ ID NO: 5850 - DNA, 2037 bp, Brucella melitensis; identical to SEQ ID NO: 4590
  CDS (1)..(2037)

SEQ ID NO: 5851 - protein, 678 aa, Brucella melitensis; identical to SEQ ID NO: 4591

SEQ ID NO: 5852 - DNA, 1344 bp, Nostoc sp. PCC 7120; identical to SEQ ID NO: 4592
  CDS (1)..(1344)

SEQ ID NO: 5853 - protein, 447 aa, Nostoc sp. PCC 7120; identical to SEQ ID NO: 4593

SEQ ID NO: 5854 - DNA, 1350 bp, Salmonella enterica subsp. enterica serovar Typhi; identical to SEQ ID NO: 4594
  CDS (1)..(1350)

SEQ ID NO: 5855 - protein, 449 aa, Salmonella enterica subsp. enterica serovar Typhi; identical to SEQ ID NO: 4595

SEQ ID NO: 5856 - DNA, 1350 bp, Pseudomonas aeruginosa; identical to SEQ ID NO: 4596
  CDS (1)..(1350)

SEQ ID NO: 5857 - protein, 449 aa, Pseudomonas aeruginosa; identical to SEQ ID NO: 4597

SEQ ID NO: 5858 - DNA, 1965 bp, Mycobacterium tuberculosis; identical to SEQ ID NO: 4598
  CDS (1)..(1965)

SEQ ID NO: 5859 - protein, 654 aa, Mycobacterium tuberculosis; identical to SEQ ID NO: 4599

SEQ ID NO: 5860 - DNA, 1338 bp, Deinococcus radiodurans; identical to SEQ ID NO: 4600
  CDS (1)..(1338)

SEQ ID NO: 5861 - protein, 445 aa, Deinococcus radiodurans; identical to SEQ ID NO: 4601

SEQ ID NO: 5862 - DNA, 1446 bp, Campylobacter jejuni; identical to SEQ ID NO: 4602
  CDS (1)..(1446)

SEQ ID NO: 5863 - protein, 481 aa, Campylobacter jejuni; identical to SEQ ID NO: 4603

SEQ ID NO: 5864 - DNA, 3288 bp, Pseudomonas aeruginosa; identical to SEQ ID NO: 4604
  CDS (1)..(3288)

SEQ ID NO: 5865 - protein, 1095 aa, Pseudomonas aeruginosa; identical to SEQ ID NO: 4605

SEQ ID NO: 5866 - DNA, 1368 bp, Lactococcus lactis subsp. lactis; identical to SEQ ID NO: 4606
  CDS (1)..(1368)

SEQ ID NO: 5867 - protein, 455 aa, Lactococcus lactis subsp. lactis; identical to SEQ ID NO: 4607

SEQ ID NO: 5868 - DNA, 2010 bp, Caulobacter crescentus; identical to SEQ ID NO: 4608
  CDS (1)..(2010)

SEQ ID NO: 5869 - protein, 669 aa, Caulobacter crescentus; identical to SEQ ID NO: 4609

SEQ ID NO: 5870 - DNA, 1344 bp, Clostridium acetobutylicum; identical to SEQ ID NO: 4610
  CDS (1)..(1344)

SEQ ID NO: 5871 - protein, 447 aa, Clostridium acetobutylicum; identical to SEQ ID NO: 4611

SEQ ID NO: 5872 - DNA, 1335 bp, Aquifex aeolicus; identical to SEQ ID NO: 4612
  CDS (1)..(1335)

SEQ ID NO: 5873 - protein, 444 aa, Aquifex aeolicus; identical to SEQ ID NO: 4613

SEQ ID NO: 5874 - DNA, 2004 bp, Mycobacterium tuberculosis; identical to SEQ ID NO: 4614
  CDS (1)..(2004)

SEQ ID NO: 5875 - protein, 667 aa, Mycobacterium tuberculosis; identical to SEQ ID NO: 4615

SEQ ID NO: 5876 - DNA, 1998 bp, Rickettsia prowazekii; identical to SEQ ID NO: 4616
  CDS (1)..(1998)

SEQ ID NO: 5877 - protein, 665 aa, Rickettsia prowazekii; identical to SEQ ID NO: 4617

SEQ ID NO: 5878 - DNA, 3276 bp, Deinococcus radiodurans; identical to SEQ ID NO: 4618
  CDS (1)..(3276)

SEQ ID NO: 5879 - protein, 1091 aa, Deinococcus radiodurans; identical to SEQ ID NO: 4619

SEQ ID NO: 5880 - DNA, 1368 bp, Streptococcus pneumoniae; identical to SEQ ID NO: 4620
  CDS (1)..(1368)

SEQ ID NO: 5881 - protein, 455 aa, Streptococcus pneumoniae; identical to SEQ ID NO: 4621

SEQ ID NO: 5882 - DNA, 1506 bp, Methanococcus jannaschii; identical to SEQ ID NO: 4622
  CDS (1)..(1506)

SEQ ID NO: 5883 - protein, 501 aa, Methanococcus jannaschii; identical to SEQ ID NO: 4623

SEQ ID NO: 5884 - DNA, 1521 bp, Archaeoglobus fulgidus; identical to SEQ ID NO: 4624
  CDS (1)..(1521)

SEQ ID NO: 5885 - protein, 506 aa, Archaeoglobus fulgidus; identical to SEQ ID NO: 4625

SEQ ID NO: 5886 - DNA, 3384 bp, Mycobacterium tuberculosis; identical to SEQ ID NO: 4626
  CDS (1)..(3384)

SEQ ID NO: 5887 - protein, 1127 aa, Mycobacterium tuberculosis; identical to SEQ ID NO: 4627

SEQ ID NO: 5888 - DNA, 1374 bp, Chlamydia muridarum, Chlamydia trachomatis MoPn; identical to SEQ ID NO: 4628
  CDS (1)..(1374)

SEQ ID NO: 5889 - protein, 457 aa, Chlamydia muridarum, Chlamydia trachomatis MoPn; identical to SEQ ID NO: 4629

SEQ ID NO: 5890 - DNA, 1359 bp, Bacillus halodurans; identical to SEQ ID NO: 4630
  CDS (1)..(1359)

SEQ ID NO: 5891 - protein, 452 aa, Bacillus halodurans; identical to SEQ ID NO: 4631

SEQ ID NO: 5892 - DNA, 6774 bp, Arabidopsis thaliana (mouse-ear cress); identical to SEQ ID NO: 4632
  CDS (1)..(6774)

SEQ ID NO: 5893 - protein, 2257 aa, Arabidopsis thaliana (mouse-ear cress); identical to SEQ ID NO: 4633

SEQ ID NO: 5894 - DNA, 3237 bp, Caulobacter crescentus; identical to SEQ ID NO: 4634
  CDS (1)..(3237)

SEQ ID NO: 5895 - protein, 1078 aa, Caulobacter crescentus; identical to SEQ ID NO: 4635

SEQ ID NO: 5896 - DNA, 3435 bp, Clostridium acetobutylicum; identical to SEQ ID NO: 4636
  CDS (1)..(3435)

SEQ ID NO: 5897 - protein, 1144 aa, Clostridium acetobutylicum; identical to SEQ ID NO: 4637

SEQ ID NO: 5898 - DNA, 1335 bp, Bacillus subtilis; identical to SEQ ID NO: 4638
  CDS (1)..(1335)

SEQ ID NO: 5899 - protein, 444 aa, Bacillus subtilis; identical to SEQ ID NO: 4639

SEQ ID NO: 5900 - DNA, 1365 bp, Chlamydophila pneumoniae, Chlamydia pneumoniae; identical to SEQ ID NO: 4640
  CDS (1)..(1365)

SEQ ID NO: 5901 - protein, 454 aa, Chlamydophila pneumoniae, Chlamydia pneumoniae; identical to SEQ ID NO: 4641

SEQ ID NO: 5902 - DNA, 1410 bp, Xylella fastidiosa; identical to SEQ ID NO: 4642
  CDS (1)..(1410)

SEQ ID NO: 5903 - protein, 469 aa, Xylella fastidiosa; identical to SEQ ID NO: 4643

SEQ ID NO: 5904 - DNA, 7080 bp, Arabidopsis thaliana (mouse-ear cress); identical to SEQ ID NO: 4644
  CDS (1)..(7080)

SEQ ID NO: 5905 - protein, 2359 aa, Arabidopsis thaliana (mouse-ear cress); identical to SEQ ID NO: 4645

SEQ ID NO: 5906 - DNA, 3414 bp, Lactococcus lactis subsp. lactis; identical to SEQ ID NO: 4646
  CDS (1)..(3414)

SEQ ID NO: 5907 - protein, 1137 aa, Lactococcus lactis subsp. lactis; identical to SEQ ID NO: 4647

SEQ ID NO: 5908 - DNA, 1533 bp, Sulfolobus solfataricus; identical to SEQ ID NO: 4648
  CDS (1)..(1533)

SEQ ID NO: 5909 - protein, 510 aa, Sulfolobus solfataricus; identical to SEQ ID NO: 4649

SEQ ID NO: 5910 - DNA, 1347 bp, Haemophilus influenzae; identical to SEQ ID NO: 4650
  CDS (1)..(1347)

SEQ ID NO: 5911 - protein, 448 aa, Haemophilus influenzae; identical to SEQ ID NO: 4651

SEQ ID NO: 5912 - DNA, 3462 bp, Bacillus subtilis; identical to SEQ ID NO: 4652
  CDS (16)..(3462)

SEQ ID NO: 5913 - protein, 1148 aa, Bacillus subtilis; identical to SEQ ID NO: 4653

SEQ ID NO: 5914 - DNA, 1803 bp, Mycobacterium tuberculosis; identical to SEQ ID NO: 4654
  CDS (1)..(1803)

SEQ ID NO: 5915 - protein, 600 aa, Mycobacterium tuberculosis; identical to SEQ ID NO: 4655

SEQ ID NO: 5916 - DNA, 1344 bp, Vibrio cholerae; identical to SEQ ID NO: 4656
  CDS (1)..(1344)

SEQ ID NO: 5917 - protein, 447 aa, Vibrio cholerae; identical to SEQ ID NO: 4657

SEQ ID NO: 5918 - DNA, 1356 bp, Staphylococcus aureus; identical to SEQ ID NO: 4658
  CDS (1)..(1356)

SEQ ID NO: 5919 - protein, 451 aa, Staphylococcus aureus; identical to SEQ ID NO: 4659

SEQ ID NO: 5920 - DNA, 2004 bp, Agrobacterium tumefaciens; identical to SEQ ID NO: 4660
  CDS (1)..(2004)

SEQ ID NO: 5921 - protein, 667 aa, Agrobacterium tumefaciens; identical to SEQ ID NO: 4661

SEQ ID NO: 5922 - DNA, 1434 bp, Aquifex aeolicus; identical to SEQ ID NO: 4662
  CDS (1)..(1434)

SEQ ID NO: 5923 - protein, 477 aa, Aquifex aeolicus; identical to SEQ ID NO: 4663

SEQ ID NO: 5924 - DNA, 1368 bp, Helicobacter pylori; identical to SEQ ID NO: 4664
  CDS (1)..(1368)

SEQ ID NO: 5925 - protein, 455 aa, Helicobacter pylori; identical to SEQ ID NO: 4665

SEQ ID NO: 5926 - DNA, 1332 bp, Campylobacter jejuni; identical to SEQ ID NO: 4666
  CDS (1)..(1332)

SEQ ID NO: 5927 - protein, 443 aa, Campylobacter jejuni; identical to SEQ ID NO: 4667

SEQ ID NO: 5928 - DNA, 1833 bp, Halobacterium sp. NRC-1; identical to SEQ ID NO: 4668
  CDS (1)..(1833)

SEQ ID NO: 5929 - protein, 610 aa, Halobacterium sp. NRC-1; identical to SEQ ID NO: 4669

SEQ ID NO: 5930 - DNA, 1797 bp, Mycobacterium leprae; identical to SEQ ID NO: 4670
  CDS (1)..(1797)

SEQ ID NO: 5931 - protein, 598 aa, Mycobacterium leprae; identical to SEQ ID NO: 4671

SEQ ID NO: 5932 - DNA, 1347 bp, Caulobacter crescentus; identical to SEQ ID NO: 4672
  CDS (1)..(1347)

SEQ ID NO: 5933 - protein, 448 aa, Caulobacter crescentus; identical to SEQ ID NO: 4673

SEQ ID NO: 5934 - DNA, 1965 bp, Caulobacter crescentus; identical to SEQ ID NO: 4674
  CDS (1)..(1965)

SEQ ID NO: 5935 - protein, 654 aa, Caulobacter crescentus; identical to SEQ ID NO: 4675

SEQ ID NO: 5936 - DNA, 1989 bp, Sinorhizobium meliloti; identical to SEQ ID NO: 4676
  CDS (1)..(1989)

SEQ ID NO: 5937 - protein, 662 aa, Sinorhizobium meliloti; identical to SEQ ID NO: 4677

SEQ ID NO: 5938 - DNA, 1374 bp, Chlamydia trachomatis; identical to SEQ ID NO: 4678
  CDS (1)..(1374)

SEQ ID NO: 5939 - protein, 457 aa, Chlamydia trachomatis; identical to SEQ ID NO: 4679

SEQ ID NO: 5940 - DNA, 1362 bp, Neisseria meningitidis; identical to SEQ ID NO: 4680
  CDS (1)..(1362)

SEQ ID NO: 5941 - protein, 453 aa, Neisseria meningitidis; identical to SEQ ID NO: 4681

SEQ ID NO: 5942 - DNA, 3624 bp, Caulobacter crescentus; identical to SEQ ID NO: 4682
  CDS (1)..(3624)

SEQ ID NO: 5943 - protein, 1207 aa, Caulobacter crescentus; identical to SEQ ID NO: 4683

SEQ ID NO: 5944 - DNA, 2013 bp, Sinorhizobium meliloti; identical to SEQ ID NO: 4684
  CDS (1)..(2013)

SEQ ID NO: 5945 - protein, 670 aa, Sinorhizobium meliloti; identical to SEQ ID NO: 4685

SEQ ID NO: 5946 - DNA, 7041 bp, Homo sapiens (man); identical to SEQ ID NO: 4686
  CDS (1)..(7041)

SEQ ID NO: 5947 - protein, 2346 aa, Homo sapiens (man); identical to SEQ ID NO: 4687

SEQ ID NO: 5948 - DNA, 4201 bp, Saccharomyces cerevisiae; identical to SEQ ID NO: 4688
  CDS (430)..(3966)

SEQ ID NO: 5949 - protein, 1178 aa, Saccharomyces cerevisiae; identical to SEQ ID NO: 4689

SEQ ID NO: 5950 - DNA, 7020 bp, Homo sapiens (man); identical to SEQ ID NO: 4690
  CDS (1)..(7020)

SEQ ID NO: 5951 - protein, 2339 aa, Homo sapiens (man) [sequence omitted]

SEQ ID NO: 5952 - DNA, 6042 bp, Saccharomyces cerevisiae; identical to SEQ ID NO: 4692
  CDS (373)..(5880)

SEQ ID NO: 5953 - protein, 1835 aa, Saccharomyces cerevisiae; identical to SEQ ID NO: 4693

SEQ ID NO: 5954 - DNA, 4315 bp, Saccharomyces cerevisiae; identical to SEQ ID NO: 4694
  CDS (676)..(4218)

SEQ ID NO: 5955 - protein, 1180 aa, Saccharomyces cerevisiae; identical to SEQ ID NO: 4695

SEQ ID NO: 5956 - DNA, 6558 bp, Ustilago maydis (corn smut); identical to SEQ ID NO: 4696
  CDS (1)..(6558)

SEQ ID NO: 5957 - protein, 2185 aa, Ustilago maydis (corn smut); identical to SEQ ID NO: 4697

SEQ ID NO: 5958 - DNA, 8521 bp, Saccharomyces cerevisiae; identical to SEQ ID NO: 4698
  CDS (1539)..(8240)

SEQ ID NO: 5959 - protein, 2233 aa, Saccharomyces cerevisiae; identical to SEQ ID NO: 4699

SEQ ID NO: 5960 - DNA, 1794 bp, Saccharopolyspora erythraea; identical to SEQ ID NO: 4700
  CDS (1)..(1794)

SEQ ID NO: 5961 - protein, 597 aa, Saccharopolyspora erythraea; identical to SEQ ID NO: 4701

SEQ ID NO: 5962 - DNA, 1347 bp, Synechocystis sp; identical to SEQ ID NO: 4702
  CDS (1)..(1347)

SEQ ID NO: 5963 - protein, 448 aa, Synechocystis sp; identical to SEQ ID NO: 4703

SEQ ID NO: 5964 - DNA, 1970 bp, Arabidopsis thaliana (mouse-ear cress); identical to SEQ ID NO: 4704
  CDS (140)..(1753)

SEQ ID NO: 5965 - protein, 537 aa, Arabidopsis thaliana (mouse-ear cress); identical to SEQ ID NO: 4705

SEQ ID NO: 5966 - DNA, 1921 bp, Nicotiana tabacum (common tobacco); identical to SEQ ID NO: 4706
  CDS (85)..(1695)

SEQ ID NO: 5967 - protein, 536 aa, Nicotiana tabacum (common tobacco); identical to SEQ ID NO: 4707

SEQ ID NO: 5968 - DNA, 1998 bp, Leishmania major; identical to SEQ ID NO: 4708
  CDS (1)..(1998)

SEQ ID NO: 5969 - protein, 665 aa, Leishmania major; identical to SEQ ID NO: 4709

SEQ ID NO: 5970 - DNA, 6993 bp, Triticum aestivum (common wheat); identical to SEQ ID NO: 4710
  CDS (39)..(6974)

SEQ ID NO: 5971 - protein, 2311 aa, Triticum aestivum (common wheat); identical to SEQ ID NO: 4711

SEQ ID NO: 5972 - DNA, 6786 bp, Glycine max (soybean); identical to SEQ ID NO: 4712
  CDS (1)..(6786)

SEQ ID NO: 5973 - protein, 2261 aa, Glycine max (soybean); identical to SEQ ID NO: 4713

SEQ ID NO: 5974 - DNA, 2030 bp, Glycine max (soybean); identical to SEQ ID NO: 4714
  CDS (90)..(1709)

SEQ ID NO: 5975 - protein, 539 aa, Glycine max (soybean); identical to SEQ ID NO: 4715

SEQ ID NO: 5976 - DNA, 6915 bp, Brassica napus (rape); identical to SEQ ID NO: 4716
  CDS (1)..(6915)

SEQ ID NO: 5977 - protein, 2304 aa, Brassica napus (rape); identical to SEQ ID NO: 4717

SEQ ID NO: 5978 - DNA, 7175 bp, Medicago sativa (alfalfa); identical to SEQ ID NO: 4718
  CDS (70)..(6843)

SEQ ID NO: 5979 - protein, 2257 aa, Medicago sativa (alfalfa); identical to SEQ ID NO: 4719

SEQ ID NO: 5980 - DNA, 2175 bp, Caenorhabditis elegans; identical to SEQ ID NO: 4720
  CDS (1)..(2175)

SEQ ID NO: 5981 - protein, 724 aa, Caenorhabditis elegans; identical to SEQ ID NO: 4721

SEQ ID NO: 5982 - DNA, 3864 bp, Caenorhabditis elegans; identical to SEQ ID NO: 4722
  CDS (36)..(3563)

SEQ ID NO: 5983 - protein, 1175 aa, Caenorhabditis elegans; identical to SEQ ID NO: 4723

SEQ ID NO: 5984 - DNA, 4974 bp, Caenorhabditis elegans; identical to SEQ ID NO: 4724
  CDS (1)..(4974)

SEQ ID NO: 5985 - protein, 1657 aa, Caenorhabditis elegans; identical to SEQ ID NO: 4725

SEQ ID NO: 5986 - DNA, 6867 bp, Emericella nidulans, Aspergillus nidulans; identical to SEQ ID NO: 4726
  CDS (1)..(6867)

SEQ ID NO: 5987 - protein, 2288 aa, Emericella nidulans, Aspergillus nidulans; identical to SEQ ID NO: 4727

SEQ ID NO: 5988 - DNA, 6165 bp, Caenorhabditis elegans; identical to SEQ ID NO: 4728
  CDS (1)..(6165)

SEQ ID NO: 5989 - protein, 2054 aa, Caenorhabditis elegans; identical to SEQ ID NO: 4729

SEQ ID NO: 5990 - DNA, 6843 bp, Schizosaccharomyces pombe; identical to SEQ ID NO: 4730
  CDS (1)..(6843)

SEQ ID NO: 5991 - protein, 2280 aa, Schizosaccharomyces pombe; identical to SEQ ID NO: 4731

SEQ ID NO: 5992 - DNA, 1773 bp, Streptomyces coelicolor; identical to SEQ ID NO: 4732
  CDS (1)..(1773)

SEQ ID NO: 5993 - protein, 590 aa, Streptomyces coelicolor; identical to SEQ ID NO: 4733

SEQ ID NO: 5994 - DNA, 1773 bp, Streptomyces coelicolor; identical to SEQ ID NO: 4734
  CDS (1)..(1773)

SEQ ID NO: 5995 - protein, 590 aa, Streptomyces coelicolor; identical to SEQ ID NO: 4735

SEQ ID NO: 5996 - DNA, 3933 bp, Aedes aegypti (yellow fever mosquito); identical to SEQ ID NO: 4736
  CDS (69)..(3656)

SEQ ID NO: 5997 - protein, 1195 aa, Aedes aegypti (yellow fever mosquito); identical to SEQ ID NO: 4737

SEQ ID NO: 5998 - DNA, 1542 bp, Sulfolobus metallicus; identical to SEQ ID NO: 4738
  CDS (1)..(1542)

SEQ ID NO: 5999 - protein, 513 aa, Sulfolobus metallicus; identical to SEQ ID NO: 4739

SEQ ID NO: 6000 - DNA, 1335 bp, Bacillus subtilis; identical to SEQ ID NO: 4740
  CDS (1)..(1335)

SEQ ID NO: 6001 - protein, 444 aa, Bacillus subtilis; identical to SEQ ID NO: 4741

SEQ ID NO: 6002 - DNA, 6822 bp, Brassica napus; identical to SEQ ID NO: 4742
  CDS (1)..(6822)

SEQ ID NO: 6003 - protein, 2273 aa, Brassica napus; identical to SEQ ID NO: 4743

SEQ ID NO: 6004 - DNA, 1599 bp, Corynebacterium glutamicum; identical to SEQ ID NO: 4744
  CDS (1)..(1599)

SEQ ID NO: 6005 - protein, 532 aa, Corynebacterium glutamicum; identical to SEQ ID NO: 4745

SEQ ID NO: 6006 - DNA, 3728 bp, Corynebacterium glutamicum; identical to SEQ ID NO: 4746
  CDS (165)..(3587)

SEQ ID NO: 6007 - protein, 1140 aa, Corynebacterium glutamicum; identical to SEQ ID NO: 4747

SEQ ID NO: 6008 - DNA, 7371 bp, Rattus norvegicus; identical to SEQ ID NO: 4748
  CDS (1)..(7371)

SEQ ID NO: 6009 - protein, 2456 aa, Rattus norvegicus; identical to SEQ ID NO: 4749

SEQ ID NO: 6010 - DNA, 3916 bp, Aspergillus terreus; identical to SEQ ID NO: 4750
  CDS (139)..(3720)

SEQ ID NO: 6011 - protein, 1193 aa, Aspergillus terreus; identical to SEQ ID NO: 4751

SEQ ID NO: 6012 - DNA, 3195 bp, Corynebacterium glutamicum; identical to SEQ ID NO: 4752
  CDS (872)..(2647)

SEQ ID NO: 6013 - protein, 591 aa, Corynebacterium glutamicum; identical to SEQ ID NO: 4753

SEQ ID NO: 6014 - DNA, 3558 bp, Schizosaccharomyces pombe; identical to SEQ ID NO: 4754
  CDS (1)..(3558)

SEQ ID NO: 6015 - protein, 1185 aa, Schizosaccharomyces pombe; identical to SEQ ID NO: 4755

SEQ ID NO: 6016 - DNA, 1620 bp, Arabidopsis thaliana; identical to SEQ ID NO: 4756
  CDS (1)..(1620): n means a or g or c or t/u

SEQ ID NO: 6017 - protein, 539 aa, Arabidopsis thaliana; identical to SEQ ID NO: 4757
  misc_feature (351)..(351): Xaa can be Asp or Glu

SEQ ID NO: 6018 - DNA, 3727 bp, Bacillus stearothermophilus; identical to SEQ ID NO: 4758
  CDS (92)..(3535)

SEQ ID NO: 6019 - protein, 1147 aa, Bacillus stearothermophilus; identical to SEQ ID NO: 4759

SEQ ID NO: 6020 - DNA, 6765 bp, Arabidopsis thaliana; identical to SEQ ID NO: 4760
  CDS (1)..(6765)

SEQ ID NO: 6021 - protein, 2254 aa, Arabidopsis thaliana; identical to SEQ ID NO: 4761

SEQ ID NO: 6022 - DNA, 6783 bp, Triticum aestivum; identical to SEQ ID NO: 4762
  CDS (1)..(6783): y means t/u or c

SEQ ID NO: 6023 - protein, 2260 aa, Triticum aestivum; identical to SEQ ID NO: 4763
  misc_feature (1980)..(1980): Xaa can be Pro or Ser

SEQ ID NO: 6024 - DNA, 3375 bp, Mycobacterium tuberculosis; identical to SEQ ID NO: 4764
  CDS (1)..(3375)

SEQ ID NO: 6025 - protein, 1124 aa, Mycobacterium tuberculosis; identical to SEQ ID NO: 4765

SEQ ID NO: 6026 - DNA, 1362 bp, Synechococcus sp; identical to SEQ ID NO: 4766
  CDS (1)..(1362)

SEQ ID NO: 6027 - protein, 453 aa, Synechococcus sp; identical to SEQ ID NO: 4767

SEQ ID NO: 6028 - DNA, 3800 bp, Rhizobium etli; identical to SEQ ID NO: 4768
  CDS (150)..(3614)

SEQ ID NO: 6029 - protein, 1154 aa, Rhizobium etli; identical to SEQ ID NO: 4769

SEQ ID NO: 6030 - DNA, 1422 bp, Wolinella succinogenes; identical to SEQ ID NO: 4770
  CDS (1)..(1422)

SEQ ID NO: 6031 - protein, 473 aa, Wolinella succinogenes; identical to SEQ ID NO: 4771

SEQ ID NO: 6032 - DNA, 3603 bp, Wolinella succinogenes; identical to SEQ ID NO: 4772
  CDS (1)..(3603)

SEQ ID NO: 6033 - protein, 1200 aa, Wolinella succinogenes; identical to SEQ ID NO: 4773

SEQ ID NO: 6034 - DNA, 1347 bp, Wolinella succinogenes; identical to SEQ ID NO: 4774
  CDS (1)..(1347)

SEQ ID NO: 6035 - protein, 448 aa, Wolinella succinogenes; identical to SEQ ID NO: 4775

SEQ ID NO: 6036 - DNA, 1956 bp, Chromobacterium violaceum; identical to SEQ ID NO: 4776
  CDS (1)..(1956)

SEQ ID NO: 6037 - protein, 651 aa, Chromobacterium violaceum; identical to SEQ ID NO: 4777

SEQ ID NO: 6038 - DNA, 1779 bp, Photorhabdus luminescens; identical to SEQ ID NO: 4778
  CDS (1)..(1779)

SEQ ID NO: 6039 - protein, 592 aa, Photorhabdus luminescens; identical to SEQ ID NO: 4779

SEQ ID NO: 6040 - DNA, 1350 bp, Photorhabdus luminescens; identical to SEQ ID NO: 4780
  CDS (1)..(1350)

SEQ ID NO: 6041 - protein, 449 aa, Photorhabdus luminescens; identical to SEQ ID NO: 4781

SEQ ID NO: 6042 - DNA, 1350 bp, Gloeobacter violaceus; identical to SEQ ID NO: 4782
  CDS (1)..(1350)

SEQ ID NO: 6043 - protein, 449 aa, Gloeobacter violaceus; identical to SEQ ID NO: 4783

SEQ ID NO: 6044 - DNA, 3609 bp, Gloeobacter violaceus; identical to SEQ ID NO: 4784
  CDS (1)..(3609)

SEQ ID NO: 6045 - protein, 1202 aa, Gloeobacter violaceus; identical to SEQ ID NO: 4785

SEQ ID NO: 6046 - DNA, 1491 bp, Chromobacterium violaceum; identical to SEQ ID NO: 4786
  CDS (1)..(1491)

SEQ ID NO: 6047 - protein, 496 aa, Chromobacterium violaceum; identical to SEQ ID NO: 4787

SEQ ID NO: 6048 - DNA, 1965 bp, Chromobacterium violaceum; identical to SEQ ID NO: 4788
  CDS (1)..(1965)

SEQ ID NO: 6049 - protein, 654 aa, Chromobacterium violaceum; identical to SEQ ID NO: 4789

SEQ ID NO: 6050 - DNA, 1998 bp, Rickettsia sibirica; identical to SEQ ID NO: 4790
  CDS (1)..(1998)

SEQ ID NO: 6051 - protein, 665 aa, Rickettsia sibirica; identical to SEQ ID NO: 4791

SEQ ID NO: 6052 - DNA, 1164 bp, Anopheles gambiae str; identical to SEQ ID NO: 4792
  CDS (1)..(1164)

SEQ ID NO: 6053 - protein, 387 aa, Anopheles gambiae str; identical to SEQ ID NO: 4793

SEQ ID NO: 6054 - DNA, 8736 bp, Plasmodium yoelii yoelii; identical to SEQ ID NO: 4794
  CDS (1)..(8736): m means a or c

SEQ ID NO: 6055 - protein, 2911 aa, Plasmodium yoelii yoelii; identical to SEQ ID NO: 4795
  misc_feature (1554)..(1554): Xaa can be Asp or Glu

SEQ ID NO: 6056 - DNA, 6828 bp, Neurospora crassa; identical to SEQ ID NO: 4796
  CDS (1)..(6828)

SEQ ID NO: 6057 - protein, 2275 aa, Neurospora crassa; identical to SEQ ID NO: 4797

SEQ ID NO: 6058 - DNA, 2232 bp, Neurospora crassa; identical to SEQ ID NO: 4798
  CDS (1)..(2232)

SEQ ID NO: 6059 - protein, 743 aa, Neurospora crassa; identical to SEQ ID NO: 4799

SEQ ID NO: 6060 - DNA, 1347 bp, Synechococcus sp; identical to SEQ ID NO: 4800
  CDS (1)..(1347)

SEQ ID NO: 6061 - protein, 448 aa, Synechococcus sp; identical to SEQ ID NO: 4801

SEQ ID NO: 6062 - DNA, 3501 bp, Rhodopirellula baltica; identical to SEQ ID NO: 4802
  CDS (1)..(3501)

SEQ ID NO: 6063 - protein, 1166 aa, Rhodopirellula baltica; identical to SEQ ID NO: 4803

SEQ ID NO: 6064 - DNA, 1353 bp, Rhodopirellula baltica; identical to SEQ ID NO: 4804
  CDS (1)..(1353)

SEQ ID NO: 6065 - protein, 450 aa, Rhodopirellula baltica; identical to SEQ ID NO: 4805

SEQ ID NO: 6066 - DNA, 1350 bp, Prochlorococcus marinus subsp; identical to SEQ ID NO: 4806
  CDS (1)..(1350)

SEQ ID NO: 6067 - protein, 449 aa, Prochlorococcus marinus subsp; identical to SEQ ID NO: 4807

SEQ ID NO: 6068 - DNA, 1347 bp, Prochlorococcus marinus; identical to SEQ ID NO: 4808
  CDS (1)..(1347)

SEQ ID NO: 6069 - protein, 448 aa, Prochlorococcus marinus; identical to SEQ ID NO: 4809

SEQ ID NO: 6070 - DNA, 1350 bp, Prochlorococcus marinus; identical to SEQ ID NO: 4810
  CDS (1)..(1350)

SEQ ID NO: 6071 - protein, 449 aa, Prochlorococcus marinus; identical to SEQ ID NO: 4811

SEQ ID NO: 6072 - DNA, 1425 bp, Helicobacter hepaticus; identical to SEQ ID NO: 4812
  CDS (1)..(1425)

SEQ ID NO: 6073 - protein, 474 aa, Helicobacter hepaticus; identical to SEQ ID NO: 4813

SEQ ID NO: 6074 - DNA, 1353 bp, Candidatus Blochmannia floridanus; identical to SEQ ID NO: 4814
  CDS (1)..(1353)

SEQ ID NO: 6075 - protein, 450 aa, Candidatus Blochmannia floridanus; identical to SEQ ID NO: 4815

SEQ ID NO: 6076 - DNA, 2022 bp, Bordetella parapertussis; identical to SEQ ID NO: 4816
  CDS (1)..(2022)

SEQ ID NO: 6077 - protein, 673 aa, Bordetella parapertussis; identical to SEQ ID NO: 4817

SEQ ID NO: 6078 - DNA, 1371 bp, Bordetella parapertussis; identical to SEQ ID NO: 4818
  CDS (1)..(1371)

SEQ ID NO: 6079 - protein, 456 aa, Bordetella parapertussis; identical to SEQ ID NO: 4819

SEQ ID NO: 6080 - DNA, 1365 bp, Bordetella bronchiseptica; identical to SEQ ID NO: 4820
  CDS (1)..(1365)

SEQ ID NO: 6081 - protein, 454 aa, Bordetella bronchiseptica; identical to SEQ ID NO: 4821

SEQ ID NO: 6082 - DNA, 1347 bp, Bordetella bronchiseptica; identical to SEQ ID NO: 4822
  CDS (1)..(1347)

SEQ ID NO: 6083 - protein, 448 aa, Bordetella bronchiseptica; identical to SEQ ID NO: 4823

SEQ ID NO: 6084 - DNA, 1365 bp, Bordetella bronchiseptica; identical to SEQ ID NO: 4824
  CDS (1)..(1365)

SEQ ID NO: 6085 - protein, 454 aa, Bordetella bronchiseptica; identical to SEQ ID NO: 4825

SEQ ID NO: 6086 - DNA, 3504 bp, Bordetella bronchiseptica; identical to SEQ ID NO: 4826
  CDS (1)..(3504)

SEQ ID NO: 6087 - protein, 1167 aa, Bordetella bronchiseptica; identical to SEQ ID NO: 4827

SEQ ID NO: 6088 - DNA, 7327 bp, Zea mays; identical to SEQ ID NO: 4828
  CDS (8)..(6985)

SEQ ID NO: 6089 - protein, 2325 aa, Zea mays; identical to SEQ ID NO: 4829

SEQ ID NO: 6090 - DNA, 7324 bp, Zea mays; identical to SEQ ID NO: 4830
  CDS (8)..(6982)

SEQ ID NO: 6091 - protein, 2324 aa, Zea mays; identical to SEQ ID NO: 4831

SEQ ID NO: 6092 - DNA, 3537 bp, Sus scrofa; identical to SEQ ID NO: 4832
  CDS (1)..(3537)

SEQ ID NO: 6093 - protein, 1178 aa, Sus scrofa; identical to SEQ ID NO: 4833

SEQ ID NO: 6094 - DNA, 7041 bp, Homo sapiens; identical to SEQ ID NO: 4834
  CDS (1)..(7041)

SEQ ID NO: 6095 - protein, 2346 aa, Homo sapiens [sequence omitted]

SEQ ID NO: 6096 - DNA, 2467 bp, Mus musculus; identical to SEQ ID NO: 4836
  CDS (6)..(2180)

SEQ ID NO: 6097 - protein, 724 aa, Mus musculus; identical to SEQ ID NO: 4837

SEQ ID NO: 6098 - DNA, 1323 bp, Bacillus cereus; identical to SEQ ID NO: 4838
  CDS (1)..(1323)

SEQ ID NO: 6099 - protein, 440 aa, Bacillus cereus; identical to SEQ ID NO: 4839

SEQ ID NO: 6100 - DNA, 3447 bp, Bacillus cereus; identical to SEQ ID NO: 4840
  CDS (1)..(3447)

SEQ ID NO: 6101 - protein, 1148 aa, Bacillus cereus; identical to SEQ ID NO: 4841

SEQ ID NO: 6102 - DNA, 1353 bp, Bacillus anthracis; identical to SEQ ID NO: 4842
  CDS (1)..(1353)

SEQ ID NO: 6103 - protein, 450 aa, Bacillus anthracis; identical to SEQ ID NO: 4843

SEQ ID NO: 6104 - DNA, 3447 bp, Bacillus anthracis; identical to SEQ ID NO: 4844
  CDS (1)..(3447)

SEQ ID NO: 6105 - protein, 1148 aa, Bacillus anthracis; identical to SEQ ID NO: 4845

SEQ ID NO: 6106 - DNA, 3636 bp, Nitrosomonas europaea; identical to SEQ ID NO: 4846
  CDS (1)..(3636)

SEQ ID NO: 6107 - protein, 1211 aa, Nitrosomonas europaea; identical to SEQ ID NO: 4847

SEQ ID NO: 6108 - DNA, 1356 bp, Chlamydophila caviae; identical to SEQ ID NO: 4848
  CDS (1)..(1356)

SEQ ID NO: 6109 - protein, 451 aa, Chlamydophila caviae; identical to SEQ ID NO: 4849

SEQ ID NO: 6110 - DNA, 3516 bp, Streptomyces avermitilis; identical to SEQ ID NO: 4850
  CDS (1)..(3516)

SEQ ID NO: 6111 - protein, 1171 aa, Streptomyces avermitilis; identical to SEQ ID NO: 4851

SEQ ID NO: 6112 - DNA, 2103 bp, Streptomyces avermitilis; identical to SEQ ID NO: 4852
  CDS (1)..(2103)

SEQ ID NO: 6113 - protein, 700 aa, Streptomyces avermitilis; identical to SEQ ID NO: 4853

SEQ ID NO: 6114 - DNA, 1851 bp, Streptomyces avermitilis; identical to SEQ ID NO: 4854
  CDS (1)..(1851)

SEQ ID NO: 6115 - protein, 616 aa, Streptomyces avermitilis; identical to SEQ ID NO: 4855

SEQ ID NO: 6116 - DNA, 1773 bp, Streptomyces avermitilis; identical to SEQ ID NO: 4856
  CDS (1)..(1773)

SEQ ID NO: 6117 - protein, 590 aa, Streptomyces avermitilis; identical to SEQ ID NO: 4857

SEQ ID NO: 6118 - DNA, 1359 bp, Nitrosomonas europaea; identical to SEQ ID NO: 4858
  CDS (1)..(1359)

SEQ ID NO: 6119 - protein, 452 aa, Nitrosomonas europaea; identical to SEQ ID NO: 4859

SEQ ID NO: 6120 - DNA, 1371 bp, Enterococcus faecalis; identical to SEQ ID NO: 4860
  CDS (1)..(1371)

SEQ ID NO: 6121 - protein, 456 aa, Enterococcus faecalis; identical to SEQ ID NO: 4861

SEQ ID NO: 6122 - DNA, 3492 bp, Enterococcus faecalis; identical to SEQ ID NO: 4862
  CDS (64)..(3492)

SEQ ID NO: 6123 - protein, 1142 aa, Enterococcus faecalis; identical to SEQ ID NO: 4863

SEQ ID NO: 6124 - DNA, 1347 bp, Coxiella burnetii; identical to SEQ ID NO: 4864
  CDS (1)..(1347)

SEQ ID NO: 6125 - protein, 448 aa, Coxiella burnetii; identical to SEQ ID NO: 4865

SEQ ID NO: 6126 - DNA, 1986 bp, Coxiella burnetii; identical to SEQ ID NO: 4866
  CDS (1)..(1986)

SEQ ID NO: 6127 - protein, 661 aa, Coxiella burnetii; identical to SEQ ID NO: 4867

SEQ ID NO: 6128 - DNA, 3396 bp, Tropheryma whipplei; identical to SEQ ID NO: 4868
  CDS (1)..(3396)

SEQ ID NO: 6129 - protein, 1131 aa, Tropheryma whipplei; identical to SEQ ID NO: 4869

SEQ ID NO: 6130 - DNA, 1776 bp, Tropheryma whipplei; identical to SEQ ID NO: 4870
  CDS (1)..(1776)

SEQ ID NO: 6131 - protein, 591 aa, Tropheryma whipplei; identical to SEQ ID NO: 4871

SEQ ID NO: 6132 - DNA, 2004 bp, Methylobacterium extorquens; identical to SEQ ID NO: 4872
  CDS (1)..(2004)

SEQ ID NO: 6133 - protein, 667 aa, Methylobacterium extorquens; identical to SEQ ID NO: 4873

SEQ ID NO: 6134 - DNA, 7446 bp, Setaria italica; identical to SEQ ID NO: 4874
  CDS (59)..(7024)

SEQ ID NO: 6135 - protein, 2321 aa, Setaria italica; identical to SEQ ID NO: 4875

SEQ ID NO: 6136 - DNA, 3994 bp, Bos taurus; identical to SEQ ID NO: 4876
  CDS (69)..(3605)

SEQ ID NO: 6137 - protein, 1178 aa, Bos taurus; identical to SEQ ID NO: 4877

SEQ ID NO: 6138 - DNA, 1530 bp, Acidianus brierleyi; identical to SEQ ID NO: 4878
  CDS (1)..(1530)

SEQ ID NO: 6139 - protein, 509 aa, Acidianus brierleyi; identical to SEQ ID NO: 4879

SEQ ID NO: 6140 - DNA, 1368 bp, Xylella fastidiosa; identical to SEQ ID NO: 4880
  CDS (1)..(1368)

SEQ ID NO: 6141 - protein, 455 aa, Xylella fastidiosa; identical to SEQ ID NO: 4881

SEQ ID NO: 6142 - DNA, 2115 bp, Vibrio parahaemolyticus; identical to SEQ ID NO: 4882
  CDS (1)..(2115)

SEQ ID NO: 6143 - protein, 704 aa, Vibrio parahaemolyticus; identical to SEQ ID NO: 4883

SEQ ID NO: 6144 - DNA, 1344 bp, Vibrio parahaemolyticus; identical to SEQ ID NO: 4884
  CDS (1)..(1344)

SEQ ID NO: 6145 - protein, 447 aa, Vibrio parahaemolyticus; identical to SEQ ID NO: 4885

SEQ ID NO: 6146 - DNA, 1416 bp, Pseudomonas syringae; identical to SEQ ID NO: 4886
  CDS (1)..(1416)

SEQ ID NO: 6147 - protein, 471 aa, Pseudomonas syringae; identical to SEQ ID NO: 4887

SEQ ID NO: 6148 - DNA, 1740 bp, Pseudomonas syringae; identical to SEQ ID NO: 4888
  CDS (1)..(1740)

SEQ ID NO: 6149 - protein, 579 aa, Pseudomonas syringae; identical to SEQ ID NO: 4889

SEQ ID NO: 6150 - DNA, 1344 bp, Pseudomonas syringae; identical to SEQ ID NO: 4890
  CDS (1)..(1344)

SEQ ID NO: 6151 - protein, 447 aa, Pseudomonas syringae; identical to SEQ ID NO: 4891

SEQ ID NO: 6152 - DNA, 3681 bp, Pseudomonas syringae; identical to SEQ ID NO: 4892
  CDS (1)..(3681)

SEQ ID NO: 6153 - protein, 1226 aa, Pseudomonas syringae; identical to SEQ ID NO: 4893

SEQ ID NO: 6154 - DNA, 1353 bp, Pseudomonas syringae; identical to SEQ ID NO: 4894
  CDS (1)..(1353)

SEQ ID NO: 6155 - protein, 450 aa, Pseudomonas syringae; identical to SEQ ID NO: 4895

SEQ ID NO: 6156 - DNA, 1950 bp, Pseudomonas syringae; identical to SEQ ID NO: 4896
  CDS (1)..(1950)

SEQ ID NO: 6157 - protein, 649 aa, Pseudomonas syringae; identical to SEQ ID NO: 4897

SEQ ID NO: 6158 - DNA, 1416 bp, Pseudomonas putida; identical to SEQ ID NO: 4898
  CDS (1)..(1416)

SEQ ID NO: 6159 - protein, 471 aa, Pseudomonas putida; identical to SEQ ID NO: 4899

SEQ ID NO: 6160 - DNA, 1953 bp, Pseudomonas putida; identical to SEQ ID NO: 4900
  CDS (1)..(1953)

SEQ ID NO: 6161 - protein, 650 aa, Pseudomonas putida; identical to SEQ ID NO: 4901

SEQ ID NO: 6162 - DNA, 1356 bp, Pseudomonas putida; identical to SEQ ID NO: 4902
  CDS (1)..(1356)

SEQ ID NO: 6163 - protein, 451 aa, Pseudomonas putida; identical to SEQ ID NO: 4903

SEQ ID NO: 6164 - DNA, 3435 bp, Lactobacillus plantarum; identical to SEQ ID NO: 4904
  CDS (1)..(3435)

SEQ ID NO: 6165 - protein, 1144 aa, Lactobacillus plantarum; identical to SEQ ID NO: 4905

SEQ ID NO: 6166 - DNA, 1389 bp, Lactobacillus plantarum; identical to SEQ ID NO: 4906
  CDS (1)..(1389)

SEQ ID NO: 6167 - protein, 462 aa, Lactobacillus plantarum; identical to SEQ ID NO: 4907

SEQ ID NO: 6168 - DNA, 1341 bp, Clostridium tetani; identical to SEQ ID NO: 4908
  CDS (1)..(1341)

SEQ ID NO: 6169 - protein, 446 aa, Clostridium tetani; identical to SEQ ID NO: 4909

SEQ ID NO: 6170 - DNA, 3318 bp, Bradyrhizobium japonicum; identical to SEQ ID NO: 4910
  CDS (1)..(3318)

SEQ ID NO: 6171 - protein, 1105 aa, Bradyrhizobium japonicum; identical to SEQ ID NO: 4911

SEQ ID NO: 6172 - DNA, 2016 bp, Bradyrhizobium japonicum; identical to SEQ ID NO: 4912
  CDS (1)..(2016)

SEQ ID NO: 6173 - protein, 671 aa, Bradyrhizobium japonicum; identical to SEQ ID NO: 4913

SEQ ID NO: 6174 - DNA, 2064 bp, Bradyrhizobium japonicum; identical to SEQ ID NO: 4914
  CDS (1)..(2064)

SEQ ID NO: 6175 - protein, 687 aa, Bradyrhizobium japonicum; identical to SEQ ID NO: 4915

SEQ ID NO: 6176 - DNA, 1359 bp, Bradyrhizobium japonicum; identical to SEQ ID NO: 4916
  CDS (1)..(1359)

SEQ ID NO: 6177 - protein, 452 aa, Bradyrhizobium japonicum; identical to SEQ ID NO: 4917

SEQ ID NO: 6178 - DNA, 1356 bp, Bradyrhizobium japonicum; identical to SEQ ID NO: 4918
  CDS (1)..(1356)

SEQ ID NO: 6179 - protein, 451 aa, Bradyrhizobium japonicum; identical to SEQ ID NO: 4919

SEQ ID NO: 6180 - DNA, 1977 bp, Bradyrhizobium japonicum; identical to SEQ ID NO: 4920
  CDS (1)..(1977)

SEQ ID NO: 6181 - protein, 658 aa, Bradyrhizobium japonicum; identical to SEQ ID NO: 4921

SEQ ID NO: 6182 - DNA, 1512 bp, Bacteroides thetaiotaomicron; identical to SEQ ID NO: 4922
  CDS (1)..(1512)

SEQ ID NO: 6183 - protein, 503 aa, Bacteroides thetaiotaomicron; identical to SEQ ID NO: 4923

SEQ ID NO: 6184 - DNA, 1512 bp, Bacteroides thetaiotaomicron; identical to SEQ ID NO: 4924
  CDS (1)..(1512)

SEQ ID NO: 6185 - protein, 503 aa, Bacteroides thetaiotaomicron; identical to SEQ ID NO: 4925

SEQ ID NO: 6186 - DNA, 2748 bp, Pagrus major; identical to SEQ ID NO: 4926
  CDS (188)..(2341): n means a or g or c or t/u

SEQ ID NO: 6187 - protein, 717 aa, Pagrus major; identical to SEQ ID NO: 4927

SEQ ID NO: 6188 - DNA, 4010 bp, Pagrus major; identical to SEQ ID NO: 4928
  CDS (389)..(3928): n means a or g or c or t/u

SEQ ID NO: 6189 - protein, 1179 aa, Pagrus major; identical to SEQ ID NO: 4929

SEQ ID NO: 6190 - DNA, 1359 bp, Staphylococcus epidermidis; identical to SEQ ID NO: 4930
  CDS (1)..(1359)

SEQ ID NO: 6191 - protein, 452 aa, Staphylococcus epidermidis; identical to SEQ ID NO: 4931

SEQ ID NO: 6192 - DNA, 1359 bp, Staphylococcus epidermidis; identical to SEQ ID NO: 4932
  CDS (1)..(1359)

SEQ ID NO: 6193 - protein, 452 aa, Staphylococcus epidermidis; identical to SEQ ID NO: 4933

SEQ ID NO: 6194 - DNA, 3465 bp, Staphylococcus epidermidis; identical to SEQ ID NO: 4934
  CDS (4)..(3465)

SEQ ID NO: 6195 - protein, 1153 aa, Staphylococcus epidermidis; identical to SEQ ID NO: 4935

SEQ ID NO: 6196 - DNA, 1338 bp, Wigglesworthia glossinidia brevipalpis; identical to SEQ ID NO: 4936
  CDS (1)..(1338)

SEQ ID NO: 6197 - protein, 445 aa, Wigglesworthia glossinidia brevipalpis; identical to SEQ ID NO: 4937

SEQ ID NO: 6198 - DNA, 1362 bp, Synechococcus elongatus; identical to SEQ ID NO: 4938
  CDS (1)..(1362)

SEQ ID NO: 6199 - protein, 453 aa, Synechococcus elongatus; identical to SEQ ID NO: 4939

SEQ ID NO: 6200 - DNA, 1371 bp, Streptococcus mutans; identical to SEQ ID NO: 4940
  CDS (1)..(1371)

SEQ ID NO: 6201 - protein, 456 aa, Streptococcus mutans; identical to SEQ ID NO: 4941

SEQ ID NO: 6202 - DNA, 1371 bp, Streptococcus agalactiae; identical to SEQ ID NO: 4942
  CDS (1)..(1371)

SEQ ID NO: 6203 - protein, 456 aa, Streptococcus agalactiae; identical to SEQ ID NO: 4943

SEQ ID NO: 6204 - DNA, 2085 bp, Shewanella oneidensis; identical to SEQ ID NO: 4944
  CDS (1)..(2085)

SEQ ID NO: 6205 - protein, 694 aa, Shewanella oneidensis; identical to SEQ ID NO: 4945

SEQ ID NO: 6206 - DNA, 4554 bp, Shewanella oneidensis; identical to SEQ ID NO: 4946
  CDS (1)..(4554)

SEQ ID NO: 6207 - protein, 1517 aa, Shewanella oneidensis; identical to SEQ ID NO: 4947

SEQ ID NO: 6208 - DNA, 1368 bp, Oceanobacillus iheyensis; identical to SEQ ID NO: 4948
  CDS (1)..(1368)

SEQ ID NO: 6209 - protein, 455 aa, Oceanobacillus iheyensis; identical to SEQ ID NO: 4949

SEQ ID NO: 6210 - DNA, 1341 bp, Oceanobacillus iheyensis; identical to SEQ ID NO: 4950
  CDS (1)..(1341)

SEQ ID NO: 6211 - protein, 446 aa, Oceanobacillus iheyensis; identical to SEQ ID NO: 4951

SEQ ID NO: 6212 - DNA, 3444 bp, Oceanobacillus iheyensis; identical to SEQ ID NO: 4952
  CDS (1)..(3444)

SEQ ID NO: 6213 - protein, 1147 aa, Oceanobacillus iheyensis; identical to SEQ ID NO: 4953

SEQ ID NO: 6214 - DNA, 1464 bp, Leptospira interrogans; identical to SEQ ID NO: 4954
  CDS (1)..(1464)

SEQ ID NO: 6215 - protein, 487 aa, Leptospira interrogans; identical to SEQ ID NO: 4955

SEQ ID NO: 6216 - DNA, 2381 bp, Corynebacterium efficiens; identical to SEQ ID NO: 4956
  CDS (982)..(2352)

SEQ ID NO: 6217 - protein, 456 aa, Corynebacterium efficiens; identical to SEQ ID NO: 4957

SEQ ID NO: 6218 - DNA, 3609 bp, Corynebacterium efficiens; identical to SEQ ID NO: 4958
  CDS (1)..(3609)

SEQ ID NO: 6219 - protein, 1202 aa, Corynebacterium efficiens; identical to SEQ ID NO: 4959

SEQ ID NO: 6220 - DNA, 3507 bp, Corynebacterium efficiens; identical to SEQ ID NO: 4960
  CDS (1)..(3507)

SEQ ID NO: 6221 - protein, 1168 aa, Corynebacterium efficiens; identical to SEQ ID NO: 4961

SEQ ID NO: 6222 - DNA, 3477 bp, Brucella suis; identical to SEQ ID NO: 4962
  CDS (1)..(3477)

SEQ ID NO: 6223 - protein, 1158 aa, Brucella suis; identical to SEQ ID NO: 4963

SEQ ID NO: 6224 - DNA, 2004 bp, Brucella suis; identical to SEQ ID NO: 4964
  CDS (1)..(2004)

SEQ ID NO: 6225 - protein, 667 aa, Brucella suis; identical to SEQ ID NO: 4965

SEQ ID NO: 6226 - DNA, 1359 bp, Brucella suis; identical to SEQ ID NO: 4966
  CDS (1)..(1359)

SEQ ID NO: 6227 - protein, 452 aa, Brucella suis; identical to SEQ ID NO: 4967

SEQ ID NO: 6228 - DNA, 1965 bp, Bifidobacterium longum; identical to SEQ ID NO: 4968
  CDS (1)..(1965)

SEQ ID NO: 6229 - protein, 654 aa, Bifidobacterium longum; identical to SEQ ID NO: 4969

SEQ ID NO: 6230 - DNA, 10011 bp, Plasmodium falciparum; identical to SEQ ID NO: 4970
  CDS (1)..(10011)

SEQ ID NO: 6231 - protein, 3336 aa, Plasmodium falciparum; identical to SEQ ID NO: 4971

SEQ ID NO: 6232 - DNA, 1533 bp, Metallosphaera sedula; identical to SEQ ID NO: 4972
  CDS (1)..(1533)

SEQ ID NO: 6233 - protein, 510 aa, Metallosphaera sedula; identical to SEQ ID NO: 4973

SEQ ID NO: 6234 - DNA, 3559 bp, Gallus gallus; identical to SEQ ID NO: 4974
  CDS (1)..(3537): s means g or c

SEQ ID NO: 6235 - protein, 1178 aa, Gallus gallus; identical to SEQ ID NO: 4975
  misc_feature (566)..(566): Xaa can be Ala or Pro

SEQ ID NO: 6236 - DNA, 1365 bp, Streptococcus pyogenes; identical to SEQ ID NO: 4976
  CDS (1)..(1365)

SEQ ID NO: 6237 - protein, 454 aa, Streptococcus pyogenes; identical to SEQ ID NO: 4977

SEQ ID NO: 6238 - DNA, 1344 bp, Chlorobium tepidum; identical to SEQ ID NO: 4978
  CDS (1)..(1344)

SEQ ID NO: 6239 - protein, 447 aa, Chlorobium tepidum; identical to SEQ ID NO: 4979

SEQ ID NO: 6240 - DNA, 7589 bp, Alopecurus myosuroides; identical to SEQ ID NO: 4980
  CDS (157)..(7119)

SEQ ID NO: 6241 - protein, 2320 aa, Alopecurus myosuroides; identical to SEQ ID NO: 4981

SEQ ID NO: 6242 - DNA, 4439 bp, Drosophila melanogaster; identical to SEQ ID NO: 4982
  CDS (417)..(4010)

SEQ ID NO: 6243 - protein, 1197 aa, Drosophila melanogaster; identical to SEQ ID NO: 4983

SEQ ID NO: 6244 - DNA, 1362 bp, Staphylococcus aureus; identical to SEQ ID NO: 4984
  CDS (1)..(1362)

SEQ ID NO: 6245 - protein, 453 aa, Staphylococcus aureus; identical to SEQ ID NO: 4985

SEQ ID NO: 6246 - DNA, 3453 bp, Staphylococcus aureus; identical to SEQ ID NO: 4986
  CDS (1)..(3453)

SEQ ID NO: 6247 - protein, 1150 aa, Staphylococcus aureus; identical to SEQ ID NO: 4987

SEQ ID NO: 6248 - DNA, 2028 bp, Xanthomonas campestris; identical to SEQ ID NO: 4988
  CDS (1)..(2028)

SEQ ID NO: 6249 - protein, 675 aa, Xanthomonas campestris; identical to SEQ ID NO: 4989

SEQ ID NO: 6250 - DNA, 3648 bp, Xanthomonas axonopodis; identical to SEQ ID NO: 4990
  CDS (1)..(3648)

SEQ ID NO: 6251 - protein, 1215 aa, Xanthomonas axonopodis; identical to SEQ ID NO: 4991

SEQ ID NO: 6252 - DNA, 2028 bp, Xanthomonas axonopodis; identical to SEQ ID NO: 4992
  CDS (1)..(2028)

SEQ ID NO: 6253 - protein, 675 aa, Xanthomonas axonopodis; identical to SEQ ID NO: 4993

SEQ ID NO: 6254 - DNA, 1494 bp, Methanosarcina mazei; identical to SEQ ID NO: 4994
  CDS (1)..(1494)

SEQ ID NO: 6255 - protein, 497 aa, Methanosarcina mazei; identical to SEQ ID NO: 4995

SEQ ID NO: 6256 - DNA, 1897 bp, Amycolatopsis mediterranei; identical to SEQ ID NO: 4996
  CDS (101)..(1897)

SEQ ID NO: 6257 - protein, 598 aa, Amycolatopsis mediterranei; identical to SEQ ID NO: 4997

SEQ ID NO: 6258 - DNA, 2381 bp, Corynebacterium efficiens; identical to SEQ ID NO: 4998
  CDS (577)..(2352)

SEQ ID NO: 6259 - protein, 591 aa, Corynebacterium efficiens; identical to SEQ ID NO: 4999

SEQ ID NO: 6260 - DNA, 7223 bp, Oryza sativa; identical to SEQ ID NO: 5000
  CDS (1)..(6804)

SEQ ID NO: 6261 - protein, 2267 aa, Oryza sativa; identical to SEQ ID NO: 5001

SEQ ID NO: 6262 - DNA, 1482 bp, Methanosarcina acetivorans; identical to SEQ ID NO: 5002
  CDS (1)..(1482)

SEQ ID NO: 6263 - protein, 493 aa, Methanosarcina acetivorans; identical to SEQ ID NO: 5003

SEQ ID NO: 6264 - DNA, 2511 bp, Homo sapiens; identical to SEQ ID NO: 5004
  CDS (47)..(2233)

SEQ ID NO: 6265 - protein, 728 aa, Homo sapiens; identical to SEQ ID NO: 5005

SEQ ID NO: 6266 - DNA, 4190 bp, Pichia angusta; identical to SEQ ID NO: 5006
  CDS (275)..(3802)

SEQ ID NO: 6267 - protein, 1175 aa, Pichia angusta; identical to SEQ ID NO: 5007

SEQ ID NO: 6268 - DNA, 1353 bp, Clostridium perfringens; identical to SEQ ID NO: 5008
  CDS (1)..(1353)

SEQ ID NO: 6269 - protein, 450 aa, Clostridium perfringens; identical to SEQ ID NO: 5009

SEQ ID NO: 6270 - DNA, 1368 bp, Ralstonia solanacearum; identical to SEQ ID NO: 5010
  CDS (1)..(1368)

SEQ ID NO: 6271 - protein, 455 aa, Ralstonia solanacearum; identical to SEQ ID NO: 5011

SEQ ID NO: 6272 - DNA, 1371 bp, Ralstonia solanacearum; identical to SEQ ID NO: 5012
  CDS (1)..(1371)

SEQ ID NO: 6273 - protein, 456 aa, Ralstonia solanacearum; identical to SEQ ID NO: 5013

SEQ ID NO: 6274 - DNA, 2139 bp, Ralstonia solanacearum; identical to SEQ ID NO: 5014
  CDS (1)..(2139)

SEQ ID NO: 6275 - protein, 712 aa, Ralstonia solanacearum; identical to SEQ ID NO: 5015

SEQ ID NO: 6276 - DNA, 3459 bp, Rhizobium meliloti; identical to SEQ ID NO: 5016
  CDS (1)..(3459)

SEQ ID NO: 6277 - protein, 1152 aa, Rhizobium meliloti; identical to SEQ ID NO: 5017

SEQ ID NO: 6278 - DNA, 1350 bp, Rhizobium meliloti; identical to SEQ ID NO: 5018
  CDS (1)..(1350)

SEQ ID NO: 6279 - protein, 449 aa, Rhizobium meliloti; identical to SEQ ID NO: 5019

SEQ ID NO: 6280 - DNA, 1677 bp, Brassica napus; identical to SEQ ID NO: 5020
  CDS (34)..(1641)

SEQ ID NO: 6281 - protein, 535 aa, Brassica napus; identical to SEQ ID NO: 5021

SEQ ID NO: 6282 - DNA, 1542 bp, Sulfolobus tokodaii; identical to SEQ ID NO: 5022
  CDS (1)..(1542)

SEQ ID NO: 6283 - protein, 513 aa, Sulfolobus tokodaii; identical to SEQ ID NO: 5023

SEQ ID NO: 6284 - DNA, 2085 bp, Rhizobium loti; identical to SEQ ID NO: 5024
  CDS (1)..(2085)

SEQ ID NO: 6285 - protein, 694 aa, Rhizobium loti; identical to SEQ ID NO: 5025

SEQ ID NO: 6286 - DNA, 1962 bp, Rhizobium loti; identical to SEQ ID NO: 5026
  CDS (1)..(1962)

SEQ ID NO: 6287 - protein, 653 aa, Rhizobium loti; identical to SEQ ID NO: 5027

SEQ ID NO: 6288 - DNA, 3459 bp, Rhizobium loti; identical to SEQ ID NO: 5028
  CDS (1)..(3459)

SEQ ID NO: 6289 - protein, 1152 aa, Rhizobium loti; identical to SEQ ID NO: 5029

SEQ ID NO: 6290 - DNA, 2013 bp, Rhizobium loti; identical to SEQ ID NO: 5030
  CDS (1)..(2013)

SEQ ID NO: 6291 - protein, 670 aa, Rhizobium loti; identical to SEQ ID NO: 5031

SEQ ID NO: 6292 - DNA, 1347 bp, Pasteurella multocida; identical to SEQ ID NO: 5032
  CDS (1)..(1347)

SEQ ID NO: 6293 - protein, 448 aa, Pasteurella multocida; identical to SEQ ID NO: 5033

SEQ ID NO: 6294 - DNA, 4000 bp, Brachydanio rerio; identical to SEQ ID NO: 5034
  CDS (25)..(3567)

SEQ ID NO: 6295 - protein, 1180 aa, Brachydanio rerio; identical to SEQ ID NO: 5035

SEQ ID NO: 6296 - DNA, 1386 bp, Streptomyces sp; identical to SEQ ID NO: 5036
  CDS (1)..(1386)

SEQ ID NO: 6297 - protein, 461 aa, Streptomyces sp; identical to SEQ ID NO: 5037

SEQ ID NO: 6298 - DNA, 1344 bp, Gamma; identical to SEQ ID NO: 5038
  CDS (1)..(1344)

SEQ ID NO: 6299 - protein, 447 aa, Gamma; identical to SEQ ID NO: 5039

SEQ ID NO: 6300 - DNA, 4218 bp, Mycobacterium smegmatis; identical to SEQ ID NO: 5040
  CDS (600)..(3983)

SEQ ID NO: 6301 - protein, 1127 aa, Mycobacterium smegmatis; identical to SEQ ID NO: 5041

SEQ ID NO: 6302 - DNA, 1722 bp, Myxococcus xanthus; identical to SEQ ID NO: 5042
  CDS (1)..(1722)

SEQ ID NO: 6303 - protein, 573 aa, Myxococcus xanthus; identical to SEQ ID NO: 5043

SEQ ID NO: 6304 - DNA, 6966 bp, Brassica napus; identical to SEQ ID NO: 5044
  CDS (1)..(6966)

SEQ ID NO: 6305 - protein, 2321 aa, Brassica napus; identical to SEQ ID NO: 5045

SEQ ID NO: 6306 - DNA, 7128 bp, Arabidopsis thaliana; identical to SEQ ID NO: 5046
  CDS (1)..(7128)

SEQ ID NO: 6307 - protein, 2375 aa, Arabidopsis thaliana; identical to SEQ ID NO: 5047

SEQ ID NO: 6308 - DNA, 3579 bp, Aspergillus niger; identical to SEQ ID NO: 5048
  CDS (1)..(3579)

SEQ ID NO: 6309 - protein, 1192 aa, Aspergillus niger; identical to SEQ ID NO: 5049

SEQ ID NO: 6310 - DNA, 1482 bp, Methanosarcina barkeri; identical to SEQ ID NO: 5050
  CDS (1)..(1482)

SEQ ID NO: 6311 - protein, 493 aa, Methanosarcina barkeri; identical to SEQ ID NO: 5051

SEQ ID NO: 6312 - DNA, 1845 bp, Streptomyces coelicolor; identical to SEQ ID NO: 5052
  CDS (1)..(1845)

SEQ ID NO: 6313 - protein, 614 aa, Streptomyces coelicolor; identical to SEQ ID NO: 5053

SEQ ID NO: 6314 - DNA, 1941 bp, Streptomyces coelicolor; identical to SEQ ID NO: 5054
  CDS (1)..(1941)

SEQ ID NO: 6315 - protein, 646 aa, Streptomyces coelicolor; identical to SEQ ID NO: 5055

SEQ ID NO: 6316 - DNA, 1293 bp, Bacillus subtilis; identical to SEQ ID NO: 5056
  CDS (1)..(1293)

SEQ ID NO: 6317 - protein, 430 aa, Bacillus subtilis; identical to SEQ ID NO: 5057

SEQ ID NO: 6318 - DNA, 1323 bp, Lactobacillus plantarum; identical to SEQ ID NO: 5058
  CDS (1)..(1323)

SEQ ID NO: 6319 - protein, 440 aa, Lactobacillus plantarum; identical to SEQ ID NO: 5059

SEQ ID NO: 6320 - DNA, 1620 bp, Glycine max; identical to SEQ ID NO: 5060
  CDS (1)..(1620)

SEQ ID NO: 6321 - protein, 539 aa, Glycine max; identical to SEQ ID NO: 5061

SEQ ID NO: 6322 - DNA, 3622 bp, Lactococcus lactis; identical to SEQ ID NO: 5062
  CDS (105)..(3518)

SEQ ID NO: 6323 - protein, 1137 aa, Lactococcus lactis; identical to SEQ ID NO: 5063

SEQ ID NO: 6324 - DNA, 3375 bp, Streptomyces coelicolor; identical to SEQ ID NO: 5064
  CDS (1)..(3375)

SEQ ID NO: 6325 - protein, 1124 aa, Streptomyces coelicolor; identical to SEQ ID NO: 5065

SEQ ID NO: 6326 - DNA, 8001 bp, Drosophila melanogaster; identical to SEQ ID NO: 5066
  CDS (177)..(7625)

SEQ ID NO: 6327 - protein, 2482 aa, Drosophila melanogaster; identical to SEQ ID NO: 5067

SEQ ID NO: 6328 - DNA, 2397 bp, Drosophila melanogaster; identical to SEQ ID NO: 5068
  CDS (74)..(2170)

SEQ ID NO: 6329 - protein, 698 aa, Drosophila melanogaster; identical to SEQ ID NO: 5069

SEQ ID NO: 6330 - DNA, 4311 bp, Pseudomonas fluorescens; identical to SEQ ID NO: 5070
  CDS (125)..(3766)

SEQ ID NO: 6331 - protein, 1213 aa, Pseudomonas fluorescens; identical to SEQ ID NO: 5071

SEQ ID NO: 6332 - DNA, 1755 bp, Streptomyces venezuelae; identical to SEQ ID NO: 5072
  CDS (1)..(1755)

SEQ ID NO: 6333 - protein, 584 aa, Streptomyces venezuelae; identical to SEQ ID NO: 5073

SEQ ID NO: 6334 - DNA, 4391 bp, Drosophila melanogaster; identical to SEQ ID NO: 5074
  CDS (417)..(3962)

SEQ ID NO: 6335 - protein, 1181 aa, Drosophila melanogaster; identical to SEQ ID NO: 5075

SEQ ID NO: 6336 - DNA, 9422 bp, Ovis aries; identical to SEQ ID NO: 5076
  CDS (320)..(7360)

SEQ ID NO: 6337 - protein, 2346 aa, Ovis aries; identical to SEQ ID NO: 5077

SEQ ID NO: 6338 - DNA, 7452 bp, Homo sapiens; identical to SEQ ID NO: 5078
  CDS (1)..(7452)

SEQ ID NO: 6339 - protein, 2483 aa, Homo sapiens; identical to SEQ ID NO: 5079

SEQ ID NO: 6340 - DNA, 2546 bp, Homo sapiens; identical to SEQ ID NO: 5080
  CDS (133)..(2310)

SEQ ID NO: 6341 - protein, 725 aa, Homo sapiens; identical to SEQ ID NO: 5081

SEQ ID NO: 6342 - DNA, 3953 bp, Homo sapiens; identical to SEQ ID NO: 5082
  CDS (39)..(3575)

SEQ ID NO: 6343 - protein, 1178 aa, Homo sapiens; identical to SEQ ID NO: 5083

SEQ ID NO: 6344 - DNA, 4456 bp, Pichia pastoris; identical to SEQ ID NO: 5084
  CDS (700)..(4269)

SEQ ID NO: 6345 - protein, 1189 aa, Pichia pastoris; identical to SEQ ID NO: 5085

SEQ ID NO: 6346 - DNA, 3945 bp, Rattus norvegicus; identical to SEQ ID NO: 5086
  CDS (35)..(3571)

SEQ ID NO: 6347 - protein, 1178 aa, Rattus norvegicus; identical to SEQ ID NO: 5087

SEQ ID NO: 6348 - DNA, 3858 bp, Xenopus laevis; identical to SEQ ID NO: 5088
  CDS (33)..(3566)

SEQ ID NO: 6349 - protein, 1177 aa, Xenopus laevis; identical to SEQ ID NO: 5089

SEQ ID NO: 6350 - DNA, 3468 bp, Agrobacterium vitis; identical to SEQ ID NO: 5090
  CDS (1)..(3468)

SEQ ID NO: 6351 - protein, 1155 aa, Agrobacterium vitis; identical to SEQ ID NO: 5091

SEQ ID NO: 6352 - DNA, 1341 bp, Geobacter sulfurreducens; identical to SEQ ID NO: 5092
  CDS (1)..(1341)

SEQ ID NO: 6353 - protein, 446 aa, Geobacter sulfurreducens; identical to SEQ ID NO: 5093

SEQ ID NO: 6354 - DNA, 3447 bp, Geobacter sulfurreducens; identical to SEQ ID NO: 5094
  CDS (1)..(3447)

SEQ ID NO: 6355 - protein, 1148 aa, Geobacter sulfurreducens; identical to SEQ ID NO: 5095

SEQ ID NO: 6356 - DNA, 7496 bp, Homo sapiens; identical to SEQ ID NO: 5096
  CDS (120)..(7496)

SEQ ID NO: 6357 - protein, 2458 aa, Homo sapiens [sequence omitted]

SEQ ID NO: 6358 - DNA, 2172 bp, Emericella nidulans; identical to SEQ ID NO: 5098
  CDS (1)..(2172)

SEQ ID NO: 6359 - protein, 723 aa, Emericella nidulans; identical to SEQ ID NO: 5099

SEQ ID NO: 6360 - DNA, 3384 bp, Mycobacterium paratuberculosis; identical to SEQ ID NO: 5100
  CDS (1)..(3384)

SEQ ID NO: 6361 - protein, 1127 aa, Mycobacterium paratuberculosis; identical to SEQ ID NO: 5101

SEQ ID NO: 6362 - DNA, 1992 bp, Mycobacterium paratuberculosis; identical to SEQ ID NO: 5102
  CDS (1)..(1992)

SEQ ID NO: 6363 - protein, 663 aa, Mycobacterium paratuberculosis; identical to SEQ ID NO: 5103

SEQ ID NO: 6364 - DNA, 2016 bp, Mycobacterium paratuberculosis; identical to SEQ ID NO: 5104
  CDS (1)..(2016)

SEQ ID NO: 6365 - protein, 671 aa, Mycobacterium paratuberculosis; identical to SEQ ID NO: 5105

SEQ ID NO: 6366 - DNA, 3228 bp, Mycobacterium paratuberculosis; identical to SEQ ID NO: 5106
  CDS (1)..(3228)

SEQ ID NO: 6367 - protein, 1075 aa, Mycobacterium paratuberculosis; identical to SEQ ID NO: 5107

SEQ ID NO: 6368 - DNA, 1824 bp, Mycobacterium paratuberculosis; identical to SEQ ID NO: 5108
  CDS (1)..(1824)

SEQ ID NO: 6369 - protein, 607 aa, Mycobacterium paratuberculosis; identical to SEQ ID NO: 5109

SEQ ID NO: 6370 - DNA, 1320 bp, Treponema denticola; identical to SEQ ID NO: 5110
  CDS (1)..(1320)

SEQ ID NO: 6371 - protein, 439 aa, Treponema denticola; identical to SEQ ID NO: 5111

SEQ ID NO: 6372 - DNA, 2076 bp, Wolbachia pipientis wMel; identical to SEQ ID NO: 5112
  CDS (1)..(2076)

SEQ ID NO: 6373 - protein, 691 aa, Wolbachia pipientis wMel; identical to SEQ ID NO: 5113

SEQ ID NO: 6374 - DNA, 1338 bp, Bacillus cereus; identical to SEQ ID NO: 5114
  CDS (1)..(1338)

SEQ ID NO: 6375 - protein, 445 aa, Bacillus cereus; identical to SEQ ID NO: 5115

SEQ ID NO: 6376 - DNA, 6696 bp, Ashbya gossypii; identical to SEQ ID NO: 5116
  CDS (1)..(6696)

SEQ ID NO: 6377 - protein, 2231 aa, Ashbya gossypii; identical to SEQ ID NO: 5117

SEQ ID NO: 6378 - DNA, 3516 bp, Ashbya gossypii; identical to SEQ ID NO: 5118
  CDS (1)..(3516)

SEQ ID NO: 6379 - protein, 1171 aa, Ashbya gossypii; identical to SEQ ID NO: 5119

SEQ ID NO: 6380 - DNA, 5460 bp, Ashbya gossypii; identical to SEQ ID NO: 5120
  CDS (1)..(5460)

SEQ ID NO: 6381 - protein, 1819 aa, Ashbya gossypii; identical to SEQ ID NO: 5121

SEQ ID NO: 6382 - DNA, 1347 bp, uncultured marine gamma proteobacterium EBAC20E09; identical to SEQ ID NO: 5122
  CDS (1)..(1347)

SEQ ID NO: 6383 - protein, 448 aa, uncultured marine gamma proteobacterium EBAC20E09; identical to SEQ ID NO: 5123

SEQ ID NO: 6384 - DNA, 1338 bp, Thermus thermophilus; identical to SEQ ID NO: 5124
  CDS (1)..(1338)

SEQ ID NO: 6385 - protein, 445 aa, Thermus thermophilus; identical to SEQ ID NO: 5125

SEQ ID NO: 6386 - DNA, 3678 bp, Desulfovibrio vulgaris; identical to SEQ ID NO: 5126
  CDS (1)..(3678)

SEQ ID NO: 6387 - protein, 1225 aa, Desulfovibrio vulgaris; identical to SEQ ID NO: 5127

SEQ ID NO: 6388 - DNA, 1416 bp, Desulfovibrio vulgaris; identical to SEQ ID NO: 5128
  CDS (1)..(1416)

SEQ ID NO: 6389 - protein, 471 aa, Desulfovibrio vulgaris; identical to SEQ ID NO: 5129

SEQ ID NO: 6390 - DNA, 3441 bp, Listeria monocytogenes str; identical to SEQ ID NO: 5130
  CDS (1)..(3441)

SEQ ID NO: 6391 - protein, 1146 aa, Listeria monocytogenes str; identical to SEQ ID NO: 5131

SEQ ID NO: 6392 - DNA, 3516 bp, Oleomonas sagaranensis; identical to SEQ ID NO: 5132
  CDS (1)..(3516)

SEQ ID NO: 6393 - protein, 1171 aa, Oleomonas sagaranensis; identical to SEQ ID NO: 5133

SEQ ID NO: 6394 - DNA, 2016 bp, Caenorhabditis elegans; identical to SEQ ID NO: 5134
  CDS (1)..(2016)

SEQ ID NO: 6395 - protein, 671 aa, Caenorhabditis elegans; identical to SEQ ID NO: 5135

SEQ ID NO: 6396 - DNA, 1350 bp, Bacillus amyloliquefaciens; identical to SEQ ID NO: 5136
  CDS (1)..(1350)

SEQ ID NO: 6397 - protein, 449 aa, Bacillus amyloliquefaciens; identical to SEQ ID NO: 5137

SEQ ID NO: 6398 - DNA, 3549 bp, Rhodopseudomonas palustris; identical to SEQ ID NO: 5138
  CDS (1)..(3549)

SEQ ID NO: 6399 - protein, 1182 aa, Rhodopseudomonas palustris; identical to SEQ ID NO: 5139

SEQ ID NO: 6400 - DNA, 3312 bp, Rhodopseudomonas palustris; identical to SEQ ID NO: 5140
  CDS (1)..(3312)

SEQ ID NO: 6401 - protein, 1103 aa, Rhodopseudomonas palustris; identical to SEQ ID NO: 5141

SEQ ID NO: 6402 - DNA, 1983 bp, Rhodopseudomonas palustris; identical to SEQ ID NO: 5142
  CDS (1)..(1983)

SEQ ID NO: 6403 - protein, 660 aa, Rhodopseudomonas palustris; identical to SEQ ID NO: 5143

SEQ ID NO: 6404 - DNA, 1353 bp, Rhodopseudomonas palustris; identical to SEQ ID NO: 5144
  CDS (1)..(1353)

SEQ ID NO: 6405 - protein, 450 aa, Rhodopseudomonas palustris; identical to SEQ ID NO: 5145

SEQ ID NO: 6406 - DNA, 2016 bp, Rhodopseudomonas palustris; identical to SEQ ID NO: 5146
  CDS (1)..(2016)

SEQ ID NO: 6407 - protein, 671 aa, Rhodopseudomonas palustris; identical to SEQ ID NO: 5147

SEQ ID NO: 6408 - DNA, 2016 bp, Rhodopseudomonas palustris; identical to SEQ ID NO: 5148
  CDS (1)..(2016)

SEQ ID NO: 6409 - protein, 671 aa, Rhodopseudomonas palustris; identical to SEQ ID NO: 5149

SEQ ID NO: 6410 - DNA, 3426 bp, Corynebacterium diphtheriae; identical to SEQ ID NO: 5150
  CDS (1)..(3426)

SEQ ID NO: 6411 - protein, 1141 aa, Corynebacterium diphtheriae; identical to SEQ ID NO: 5151

SEQ ID NO: 6412 - DNA, 1785 bp, Corynebacterium diphtheriae; identical to SEQ ID NO: 5152
  CDS (1)..(1785)

SEQ ID NO: 6413 - protein, 594 aa, Corynebacterium diphtheriae; identical to SEQ ID NO: 5153

SEQ ID NO: 6414 - DNA, 1479 bp, Bdellovibrio bacteriovorus; identical to SEQ ID NO: 5154
  CDS (1)..(1479)

SEQ ID NO: 6415 - protein, 492 aa, Bdellovibrio bacteriovorus; identical to SEQ ID NO: 5155

SEQ ID NO: 6416 - DNA, 1503 bp, Bdellovibrio bacteriovorus; identical to SEQ ID NO: 5156
  CDS (1)..(1503)

SEQ ID NO: 6417 - protein, 500 aa, Bdellovibrio bacteriovorus; identical to SEQ ID NO: 5157

SEQ ID NO: 6418 - DNA, 1362 bp, Parachlamydia sp; identical to SEQ ID NO: 5158
  CDS (1)..(1362)

SEQ ID NO: 6419 - protein, 453 aa, Parachlamydia sp; identical to SEQ ID NO: 5159

SEQ ID NO: 6420 - DNA, 1506 bp, Methanococcus maripaludis; identical to SEQ ID NO: 5160
  CDS (1)..(1506)

SEQ ID NO: 6421 - protein, 501 aa, Methanococcus maripaludis; identical to SEQ ID NO: 5161

SEQ ID NO: 6422 - DNA, 1719 bp, Streptomyces antibioticus; identical to SEQ ID NO: 5162
  CDS (1)..(1719)

SEQ ID NO: 6423 - protein, 572 aa, Streptomyces antibioticus; identical to SEQ ID NO: 5163

SEQ ID NO: 6424 - DNA, 1344 bp, Photobacterium profundum; identical to SEQ ID NO: 5164
  CDS (1)..(1344)

SEQ ID NO: 6425 - protein, 447 aa, Photobacterium profundum; identical to SEQ ID NO: 5165

SEQ ID NO: 6426 - DNA, 26 bp, artificial sequence
  primer
ttatttttcctgaagaccgagttttt

SEQ ID NO: 6427 - DNA, 24 bp, artificial sequence
  primer
atgctggataaaattgttattgcc

SEQ ID NO: 6428 - DNA, 1062 bp, Escherichia coli K12; identical to SEQ ID NO: 2732
  CDS (1)..(1062)

SEQ ID NO: 6429 - protein, 353 aa, Escherichia coli K12; identical to SEQ ID NO: 2733

SEQ ID NO: 6430 - DNA, 1444 bp, Pseudomonas fluorescens; identical to SEQ ID NO: 2734
  CDS (156)..(1214)

SEQ ID NO: 6431 - protein, 352 aa, Pseudomonas fluorescens; identical to SEQ ID NO: 2735

SEQ ID NO: 6432 - DNA, 1484 bp, Haemophilus influenzae; identical to SEQ ID NO: 2736
  CDS (278)..(1342)

SEQ ID NO: 6433 - protein, 354 aa, Haemophilus influenzae; identical to SEQ ID NO: 2737

SEQ ID NO: 6434 - DNA, 1131 bp, Thermus aquaticus; identical to SEQ ID NO: 2738
  CDS (62)..(1084)

SEQ ID NO: 6435 - protein, 340 aa, Thermus aquaticus; identical to SEQ ID NO: 2739

SEQ ID NO: 6436 - DNA, 1196 bp, Aquifex pyrophilus; identical to SEQ ID NO: 2740
  CDS (51)..(1097)

SEQ ID NO: 6437 - protein, 348 aa, Aquifex pyrophilus; identical to SEQ ID NO: 2741

SEQ ID NO: 6438 - DNA, 1023 bp, Rickettsia prowazekii; identical to SEQ ID NO: 2742
  CDS (1)..(1023)

SEQ ID NO: 6439 - protein, 340 aa, Rickettsia prowazekii; identical to SEQ ID NO: 2743

SEQ ID NO: 6440 - DNA, 1329 bp, Myxococcus xanthus; identical to SEQ ID NO: 2744
  CDS (201)..(1229)

SEQ ID NO: 6441 - protein, 342 aa, Myxococcus xanthus; identical to SEQ ID NO: 2745

SEQ ID NO: 6442 - DNA, 1394 bp, Legionella pneumophila; identical to SEQ ID NO: 2746
  CDS (166)..(1212)

SEQ ID NO: 6443 - protein, 348 aa, Legionella pneumophila; identical to SEQ ID NO: 2747

SEQ ID NO: 6444 - DNA, 1224 bp, Treponema pallidum subsp. pallidum (syphilis spirochete); identical to SEQ ID NO: 2748
  CDS (1)..(1224): k means g or t/u

SEQ ID NO: 6445 - protein, 407 aa, Treponema pallidum subsp. pallidum (syphilis spirochete); identical to SEQ ID NO: 2749
  misc_feature (375)..(375): Xaa can be Phe or Cys

SEQ ID NO: 6446 - DNA, 1050 bp, Clostridium acetobutylicum; identical to SEQ ID NO: 2750
  CDS (1)..(1050)

SEQ ID NO: 6447 - protein, 349 aa, Clostridium acetobutylicum; identical to SEQ ID NO: 2751

SEQ ID NO: 6448 - DNA, 1047 bp, Listeria innocua; identical to SEQ ID NO: 2752
  CDS (1)..(1047)

SEQ ID NO: 6449 - protein, 348 aa, Listeria innocua; identical to SEQ ID NO: 2753

SEQ ID NO: 6450 - DNA, 1137 bp, Brucella melitensis; identical to SEQ ID NO: 2754
  CDS (1)..(1137)

SEQ ID NO: 6451 - protein, 378 aa, Brucella melitensis; identical to SEQ ID NO: 2755

SEQ ID NO: 6452 - DNA, 1062 bp, Salmonella enterica subsp. enterica serovar Typhi; identical to SEQ ID NO: 2756
  CDS (1)..(1062)

SEQ ID NO: 6453 - protein, 353 aa, Salmonella enterica subsp. enterica serovar Typhi; identical to SEQ ID NO: 2757

SEQ ID NO: 6454 - DNA, 1074 bp, Nostoc sp. PCC 7120; identical to SEQ ID NO: 2758
  CDS (1)..(1074)

SEQ ID NO: 6455 - protein, 357 aa, Nostoc sp. PCC 7120; identical to SEQ ID NO: 2759

SEQ ID NO: 6456 - DNA, 1044 bp, Xylella fastidiosa; identical to SEQ ID NO: 2760
  CDS (1)..(1044)

SEQ ID NO: 6457 - protein, 347 aa, Xylella fastidiosa; identical to SEQ ID NO: 2761

SEQ ID NO: 6458 - DNA, 1164 bp, Lactococcus lactis subsp. lactis; identical to SEQ ID NO: 2762
  CDS (1)..(1164)

SEQ ID NO: 6459 - protein, 387 aa, Lactococcus lactis subsp. lactis; identical to SEQ ID NO: 2763

SEQ ID NO: 6460 - DNA, 2025 bp, Borrelia burgdorferi (Lyme disease spirochete); identical to SEQ ID NO: 2764
  CDS (25)..(1122)

SEQ ID NO: 6461 - protein, 365 aa, Borrelia burgdorferi (Lyme disease spirochete); identical to SEQ ID NO: 2765

SEQ ID NO: 6462 - DNA, 1728 bp, Deinococcus radiodurans; identical to SEQ ID NO: 2766
  CDS (399)..(1490)

SEQ ID NO: 6463 - protein, 363 aa, Deinococcus radiodurans; identical to SEQ ID NO: 2767

SEQ ID NO: 6464 - DNA, 1071 bp, Caulobacter crescentus; identical to SEQ ID NO: 2768
  CDS (1)..(1071)

SEQ ID NO: 6465 - protein, 356 aa, Caulobacter crescentus; identical to SEQ ID NO: 2769

SEQ ID NO: 6466 - DNA, 1199 bp, Thermotoga maritima; identical to SEQ ID NO: 2770
  CDS (67)..(1137)

SEQ ID NO: 6467 - protein, 356 aa, Thermotoga maritima; identical to SEQ ID NO: 2771

SEQ ID NO: 6468 - DNA, 1662 bp, Arabidopsis thaliana (mouse-ear cress); identical to SEQ ID NO: 2772
  CDS (368)..(1498)

SEQ ID NO: 6469 - protein, 376 aa, Arabidopsis thaliana (mouse-ear cress); identical to SEQ ID NO: 2773

SEQ ID NO: 6470 - DNA, 1038 bp, Aquifex aeolicus; identical to SEQ ID NO: 2774
  CDS (1)..(1038)

SEQ ID NO: 6471 - protein, 345 aa, Aquifex aeolicus; identical to SEQ ID NO: 2775

SEQ ID NO: 6472 - DNA, 1062 bp, Chlamydophila pneumoniae, Chlamydia pneumoniae; identical to SEQ ID NO: 2776
  CDS (1)..(1062)

SEQ ID NO: 6473 - protein, 353 aa, Chlamydophila pneumoniae, Chlamydia pneumoniae; identical to SEQ ID NO: 2777

SEQ ID NO: 6474 - DNA, 1047 bp, Neisseria meningitidis; identical to SEQ ID NO: 2778
  CDS (1)..(1047)

SEQ ID NO: 6475 - protein, 348 aa, Neisseria meningitidis; identical to SEQ ID NO: 2779

SEQ ID NO: 6476 - DNA, 1032 bp, Campylobacter jejuni; identical to SEQ ID NO: 2780
  CDS (1)..(1032)

SEQ ID NO: 6477 - protein, 343 aa, Campylobacter jejuni; identical to SEQ ID NO: 2781

SEQ ID NO: 6478 - DNA, 1065 bp, Chlamydia muridarum, Chlamydia trachomatis MoPn; identical to SEQ ID NO: 2782
  CDS (1)..(1065)

SEQ ID NO: 6479 - protein, 354 aa, Chlamydia muridarum, Chlamydia trachomatis MoPn; identical to SEQ ID NO: 2783

SEQ ID NO: 6480 - DNA, 1050 bp, Bacillus halodurans; identical to SEQ ID NO: 2784
  CDS (1)..(1050)

SEQ ID NO: 6481 - protein, 349 aa, Bacillus halodurans; identical to SEQ ID NO: 2785

SEQ ID NO: 6482 - DNA, 1229 bp, Streptococcus pneumoniae; identical to SEQ ID NO: 2786
  CDS (26)..(1192)

SEQ ID NO: 6483 - protein, 388 aa, Streptococcus pneumoniae; identical to SEQ ID NO: 2787

SEQ ID NO: 6484 - DNA, 1251 bp, Agrobacterium tumefaciens; identical to SEQ ID NO: 2788
  CDS (1)..(1251)

SEQ ID NO: 6485 - protein, 416 aa, Agrobacterium tumefaciens; identical to SEQ ID NO: 2789

SEQ ID NO: 6486 - DNA, 1044 bp, Staphylococcus aureus; identical to SEQ ID NO: 2790
  CDS (1)..(1044)

SEQ ID NO: 6487 - protein, 347 aa, Staphylococcus aureus; identical to SEQ ID NO: 2791

SEQ ID NO: 6488 - DNA, 1506 bp, Acinetobacter calcoaceticus; identical to SEQ ID NO: 2792
  CDS (403)..(1452)

SEQ ID NO: 6489 - protein, 349 aa, Acinetobacter calcoaceticus; identical to SEQ ID NO: 2793

SEQ ID NO: 6490 - DNA, 1479 bp, Brucella abortus; identical to SEQ ID NO: 2794
  CDS (316)..(1398)

SEQ ID NO: 6491 - protein, 360 aa, Brucella abortus; identical to SEQ ID NO: 2795

SEQ ID NO: 6492 - DNA, 981 bp, Streptococcus pyogenes; identical to SEQ ID NO: 2796
  CDS (1)..(981)

SEQ ID NO: 6493 - protein, 326 aa, Streptococcus pyogenes; identical to SEQ ID NO: 2797

SEQ ID NO: 6494 - DNA, 1349 bp, Leptospira biflexa; identical to SEQ ID NO: 2798
  CDS (107)..(1270)

SEQ ID NO: 6495 - protein, 387 aa, Leptospira biflexa; identical to SEQ ID NO: 2799

SEQ ID NO: 6496 - DNA, 1762 bp, Xanthomonas campestris pv. campestris; identical to SEQ ID NO: 2800
  CDS (159)..(1190)

SEQ ID NO: 6497 - protein, 343 aa, Xanthomonas campestris pv. campestris; identical to SEQ ID NO: 2801

SEQ ID NO: 6498 - DNA, 1212 bp, Aeromonas salmonicida; identical to SEQ ID NO: 2802
  CDS (151)..(1212)

SEQ ID NO: 6499 - protein, 353 aa, Aeromonas salmonicida; identical to SEQ ID NO: 2803

SEQ ID NO: 6500 - DNA, 1433 bp, Azotobacter vinelandii; identical to SEQ ID NO: 2804
  CDS (311)..(1360)

SEQ ID NO: 6501 - protein, 349 aa, Azotobacter vinelandii; identical to SEQ ID NO: 2805

SEQ ID NO: 6502 - DNA, 1108 bp, Acetobacter polyoxogenes; identical to SEQ ID NO: 2806
  CDS (35)..(1081)

SEQ ID NO: 6503 - protein, 348 aa, Acetobacter polyoxogenes; identical to SEQ ID NO: 2807

SEQ ID NO: 6504 - DNA, 1230 bp, Neisseria gonorrhoeae; identical to SEQ ID NO: 2808
  CDS (133)..(1179)

SEQ ID NO: 6505 - protein, 348 aa, Neisseria gonorrhoeae; identical to SEQ ID NO: 2809

SEQ ID NO: 6506 - DNA, 1649 bp, Bacteroides fragilis; identical to SEQ ID NO: 2810
  CDS (351)..(1307)

SEQ ID NO: 6507 - protein, 318 aa, Bacteroides fragilis; identical to SEQ ID NO: 2811

SEQ ID NO: 6508 - DNA, 1349 bp, Methylobacillus sp; identical to SEQ ID NO: 2812
  CDS (293)..(1327)

SEQ ID NO: 6509 - protein, 344 aa, Methylobacillus sp; identical to SEQ ID NO: 2813

SEQ ID NO: 6510 - DNA, 1320 bp, Vibrio anguillarum; identical to SEQ ID NO: 2814
  CDS (166)..(1212)

SEQ ID NO: 6511 - protein, 348 aa, Vibrio anguillarum; identical to SEQ ID NO: 2815

SEQ ID NO: 6512 - DNA, 1394 bp, Anabaena variabilis; identical to SEQ ID NO: 2816
  CDS (125)..(1201)

SEQ ID NO: 6513 - protein, 358 aa, Anabaena variabilis; identical to SEQ ID NO: 2817

SEQ ID NO: 6514 - DNA, 1334 bp, Bacillus subtilis; identical to SEQ ID NO: 2818
  CDS (215)..(1258)

SEQ ID NO: 6515 - protein, 347 aa, Bacillus subtilis; identical to SEQ ID NO: 2819

SEQ ID NO: 6516 - DNA, 1348 bp, Proteus mirabilis; identical to SEQ ID NO: 2820
  CDS (151)..(1218)

SEQ ID NO: 6517 - protein, 355 aa, Proteus mirabilis; identical to SEQ ID NO: 2821

SEQ ID NO: 6518 - DNA, 1384 bp, Pseudomonas aeruginosa; identical to SEQ ID NO: 2822
  CDS (145)..(1185)

SEQ ID NO: 6519 - protein, 346 aa, Pseudomonas aeruginosa; identical to SEQ ID NO: 2823

SEQ ID NO: 6520 - DNA, 1352 bp, Pseudomonas cepacia; identical to SEQ ID NO: 2824
  CDS (223)..(1266)

SEQ ID NO: 6521 - protein, 347 aa, Pseudomonas cepacia; identical to SEQ ID NO: 2825

SEQ ID NO: 6522 - DNA, 1047 bp, Synechococcus sp; identical to SEQ ID NO: 2826
  CDS (1)..(1047)

SEQ ID NO: 6523 - protein, 348 aa, Synechococcus sp; identical to SEQ ID NO: 2827

SEQ ID NO: 6524 - DNA, 1190 bp, Aquaspirillum magnetotacticum; identical to SEQ ID NO: 2828
  CDS (112)..(1146)

SEQ ID NO: 6525 - protein, 344 aa, Aquaspirillum magnetotacticum; identical to SEQ ID NO: 2829

SEQ ID NO: 6526 - DNA, 1841 bp, Rhizobium leguminosarum bv. viciae; identical to SEQ ID NO: 2830
  CDS (32)..(1087)

SEQ ID NO: 6527 - protein, 351 aa, Rhizobium leguminosarum bv. viciae; identical to SEQ ID NO: 2831

SEQ ID NO: 6528 - DNA, 1047 bp, Rhizobium meliloti; identical to SEQ ID NO: 2832
  CDS (1)..(1047)

SEQ ID NO: 6529 - protein, 348 aa, Rhizobium meliloti; identical to SEQ ID NO: 2833

SEQ ID NO: 6530 - DNA, 2762 bp, Mycobacterium tuberculosis; identical to SEQ ID NO: 2834
  CDS (311)..(2683)

SEQ ID NO: 6531 - protein, 790 aa, Mycobacterium tuberculosis; identical to SEQ ID NO: 2835

SEQ ID NO: 6532 - DNA, 1249 bp, Methylomonas clara; identical to SEQ ID NO: 2836
  CDS (123)..(1151)

SEQ ID NO: 6533 - protein, 342 aa, Methylomonas clara; identical to SEQ ID NO: 2837

SEQ ID NO: 6534 - DNA, 1065 bp, Enterobacter agglomerans; identical to SEQ ID NO: 2838
  CDS (1)..(1065)

SEQ ID NO: 6535 - protein, 354 aa, Enterobacter agglomerans; identical to SEQ ID NO: 2839

SEQ ID NO: 6536 - DNA, 1125 bp, Streptomyces lividans; identical to SEQ ID NO: 2840
  CDS (1)..(1125)

SEQ ID NO: 6537 - protein, 374 aa, Streptomyces lividans; identical to SEQ ID NO: 2841

SEQ ID NO: 6538 - DNA, 1347 bp, Rhodobacter sphaeroides; identical to SEQ ID NO: 2842
  CDS (220)..(1251)

SEQ ID NO: 6539 - protein, 343 aa, Rhodobacter sphaeroides; identical to SEQ ID NO: 2843

SEQ ID NO: 6540 - DNA, 1065 bp, Vibrio cholerae; identical to SEQ ID NO: 2844
  CDS (1)..(1065)

SEQ ID NO: 6541 - protein, 354 aa, Vibrio cholerae; identical to SEQ ID NO: 2845

SEQ ID NO: 6542 - DNA, 1068 bp, Rhodobacter capsulatus; identical to SEQ ID NO: 2846
  CDS (1)..(1068)

SEQ ID NO: 6543 - protein, 355 aa, Rhodobacter capsulatus; identical to SEQ ID NO: 2847

SEQ ID NO: 6544 - DNA, 1533 bp, Helicobacter pylori; identical to SEQ ID NO: 2848
  CDS (275)..(1318)

SEQ ID NO: 6545 - protein, 347 aa, Helicobacter pylori; identical to SEQ ID NO: 2849

SEQ ID NO: 6546 - DNA, 1065 bp, Synechocystis sp; identical to SEQ ID NO: 2850
  CDS (1)..(1065)

SEQ ID NO: 6547 - protein, 354 aa, Synechocystis sp; identical to SEQ ID NO: 2851

SEQ ID NO: 6548 - DNA, 1351 bp, Arabidopsis thaliana (mouse-ear cress); identical to SEQ ID NO: 2852
  CDS (1)..(1320)

SEQ ID NO: 6549 - protein, 439 aa, Arabidopsis thaliana (mouse-ear cress); identical to SEQ ID NO: 2853

SEQ ID NO: 6550 - DNA, 1392 bp, Pseudomonas putida; identical to SEQ ID NO: 2854
  CDS (111)..(1178)

SEQ ID NO: 6551 - protein, 355 aa, Pseudomonas putida; identical to SEQ ID NO: 2855

SEQ ID NO: 6552 - DNA, 1053 bp, Mycobacterium tuberculosis; identical to SEQ ID NO: 2856
  CDS (1)..(1053)

SEQ ID NO: 6553 - protein, 350 aa, Mycobacterium tuberculosis; identical to SEQ ID NO: 2857

SEQ ID NO: 6554 - DNA, 1053 bp, Wolinella succinogenes; identical to SEQ ID NO: 2858
  CDS (1)..(1053)

SEQ ID NO: 6555 - protein, 350 aa, Wolinella succinogenes; identical to SEQ ID NO: 2859

SEQ ID NO: 6556 - DNA, 1110 bp, Vibrio vulnificus; identical to SEQ ID NO: 2860
  CDS (1)..(1110)

SEQ ID NO: 6557 - protein, 369 aa, Vibrio vulnificus; identical to SEQ ID NO: 2861

SEQ ID NO: 6558 - DNA, 1068 bp, Photorhabdus luminescens; identical to SEQ ID NO: 2862
  CDS (1)..(1068)

SEQ ID NO: 6559 - protein, 355 aa, Photorhabdus luminescens; identical to SEQ ID NO: 2863

SEQ ID NO: 6560 - DNA, 1110 bp, Gloeobacter violaceus; identical to SEQ ID NO: 2864
  CDS (1)..(1110)

SEQ ID NO: 6561 - protein, 369 aa, Gloeobacter violaceus; identical to SEQ ID NO: 2865

SEQ ID NO: 6562 - DNA, 1053 bp, Chromobacterium violaceum; identical to SEQ ID NO: 2866
  CDS (1)..(1053)

SEQ ID NO: 6563 - protein, 350 aa, Chromobacterium violaceum; identical to SEQ ID NO: 2867

SEQ ID NO: 6564 - DNA, 1128 bp, Synechococcus sp; identical to SEQ ID NO: 2868
  CDS (1)..(1128)

SEQ ID NO: 6565 - protein, 375 aa, Synechococcus sp; identical to SEQ ID NO: 2869

SEQ ID NO: 6566 - DNA, 1128 bp, Rhodopirellula baltica; identical to SEQ ID NO: 2870
  CDS (1)..(1128)

SEQ ID NO: 6567 - protein, 375 aa, Rhodopirellula baltica; identical to SEQ ID NO: 2871

SEQ ID NO: 6568 - DNA, 1113 bp, Prochlorococcus marinus subsp; identical to SEQ ID NO: 2872
  CDS (1)..(1113)

SEQ ID NO: 6569 - protein, 370 aa, Prochlorococcus marinus subsp; identical to SEQ ID NO: 2873

SEQ ID NO: 6570 - DNA, 1140 bp, Prochlorococcus marinus; identical to SEQ ID NO: 2874
  CDS (1)..(1140)

SEQ ID NO: 6571 - protein, 379 aa, Prochlorococcus marinus; identical to SEQ ID NO: 2875

SEQ ID NO: 6572 - DNA, 1140 bp, Prochlorococcus marinus; identical to SEQ ID NO: 2876
  CDS (1)..(1140)

SEQ ID NO: 6573 - protein, 379 aa, Prochlorococcus marinus; identical to SEQ ID NO: 2877

SEQ ID NO: 6574 - DNA, 1038 bp, Helicobacter hepaticus; identical to SEQ ID NO: 2878
  CDS (1)..(1038)

SEQ ID NO: 6575 - protein, 345 aa, Helicobacter hepaticus; identical to SEQ ID NO: 2879

SEQ ID NO: 6576 - DNA, 1119 bp, Haemophilus ducreyi; identical to SEQ ID NO: 2880
  CDS (1)..(1119)

SEQ ID NO: 6577 - protein, 372 aa, Haemophilus ducreyi; identical to SEQ ID NO: 2881

SEQ ID NO: 6578 - DNA, 1048 bp, Campylobacter lari; identical to SEQ ID NO: 2882
  CDS (9)..(1043)

SEQ ID NO: 6579 - protein, 344 aa, Campylobacter lari; identical to SEQ ID NO: 2883

SEQ ID NO: 6580 - DNA, 1077 bp, Burkholderia fungorum; identical to SEQ ID NO: 2884
  CDS (1)..(1077)

SEQ ID NO: 6581 - protein, 358 aa, Burkholderia fungorum; identical to SEQ ID NO: 2885

SEQ ID NO: 6582 - DNA, 963 bp, Mycobacteriophage CJW1; identical to SEQ ID NO: 2886
  CDS (1)..(963)

SEQ ID NO: 6583 - protein, 320 aa, Mycobacteriophage CJW1; identical to SEQ ID NO: 2887

SEQ ID NO: 6584 - DNA, 1563 bp, Zymomonas mobilis; identical to SEQ ID NO: 2888
  CDS (231)..(1250)

SEQ ID NO: 6585 - protein, 339 aa, Zymomonas mobilis; identical to SEQ ID NO: 2889

SEQ ID NO: 6586 - DNA, 1038 bp, Bacillus megaterium; identical to SEQ ID NO: 2890
  CDS (1)..(1038)

SEQ ID NO: 6587 - protein, 345 aa, Bacillus megaterium; identical to SEQ ID NO: 2891

SEQ ID NO: 6588 - DNA, 1038 bp, Bacillus megaterium; identical to SEQ ID NO: 2892
  CDS (1)..(1038)

SEQ ID NO: 6589 - protein, 345 aa, Bacillus megaterium; identical to SEQ ID NO: 2893

SEQ ID NO: 6590 - DNA, 1044 bp, Bacillus amyloliquefaciens; identical to SEQ ID NO: 2894
  CDS (1)..(1044)

SEQ ID NO: 6591 - protein, 347 aa, Bacillus amyloliquefaciens; identical to SEQ ID NO: 2895

SEQ ID NO: 6592 - DNA, 1047 bp, Listeria monocytogenes; identical to SEQ ID NO: 2896
  CDS (1)..(1047): m means a or c

SEQ ID NO: 6593 - protein, 348 aa, Listeria monocytogenes; identical to SEQ ID NO: 2897
  misc_feature (228)..(228): Xaa can be Pro or Gln

SEQ ID NO: 6594 - DNA, 1035 bp, Oryza sativa; identical to SEQ ID NO: 2898
  CDS (1)..(1035)

SEQ ID NO: 6595 - protein, 344 aa, Oryza sativa; identical to SEQ ID NO: 2899

SEQ ID NO: 6596 - DNA, 1035 bp, Campylobacter lari; identical to SEQ ID NO: 2900
  CDS (1)..(1035)

SEQ ID NO: 6597 - protein, 344 aa, Campylobacter lari; identical to SEQ ID NO: 2901

SEQ ID NO: 6598 - DNA, 2035 bp, Borrelia hermsii; identical to SEQ ID NO: 2902
  CDS (256)..(1326)

SEQ ID NO: 6599 - protein, 356 aa, Borrelia hermsii; identical to SEQ ID NO: 2903

SEQ ID NO: 6600 - DNA, 1487 bp, Chlamydomonas reinhardtii; identical to SEQ ID NO: 2904
  CDS (121)..(1365)

SEQ ID NO: 6601 - protein, 414 aa, Chlamydomonas reinhardtii; identical to SEQ ID NO: 2905

SEQ ID NO: 6602 - DNA, 1669 bp, Streptococcus suis; identical to SEQ ID NO: 2906
  CDS (469)..(1500)

SEQ ID NO: 6603 - protein, 343 aa, Streptococcus suis; identical to SEQ ID NO: 2907

SEQ ID NO: 6604 - DNA, 1439 bp, Peanut witches; identical to SEQ ID NO: 2908
  CDS (218)..(1228)

SEQ ID NO: 6605 - protein, 336 aa, Peanut witches; identical to SEQ ID NO: 2909

SEQ ID NO: 6606 - DNA, 1377 bp, Myxococcus xanthus; identical to SEQ ID NO: 2910
  CDS (201)..(1277)

SEQ ID NO: 6607 - protein, 358 aa, Myxococcus xanthus; identical to SEQ ID NO: 2911

SEQ ID NO: 6608 - DNA, 1404 bp, Acidiphilium facilis; identical to SEQ ID NO: 2912
  CDS (187)..(1251)

SEQ ID NO: 6609 - protein, 354 aa, Acidiphilium facilis; identical to SEQ ID NO: 2913

SEQ ID NO: 6610 - DNA, 1059 bp, Actinobacillus actinomycetemcomitans; identical to SEQ ID NO: 2914
  CDS (1)..(1059)

SEQ ID NO: 6611 - protein, 352 aa, Actinobacillus actinomycetemcomitans; identical to SEQ ID NO: 2915

SEQ ID NO: 6612 - DNA, 1565 bp, Alcaligenes eutrophus; identical to SEQ ID NO: 2916
  CDS (194)..(1255)

SEQ ID NO: 6613 - protein, 353 aa, Alcaligenes eutrophus; identical to SEQ ID NO: 2917

SEQ ID NO: 6614 - DNA, 1047 bp, Amycolatopsis mediterranei; identical to SEQ ID NO: 2918
  CDS (1)..(1047)

SEQ ID NO: 6615 - protein, 348 aa, Amycolatopsis mediterranei; identical to SEQ ID NO: 2919

SEQ ID NO: 6616 - DNA, 1035 bp, Bacteroides thetaiotaomicron; identical to SEQ ID NO: 2920
  CDS (1)..(1035)

SEQ ID NO: 6617 - protein, 344 aa, Bacteroides thetaiotaomicron; identical to SEQ ID NO: 2921

SEQ ID NO: 6618 - DNA, 1194 bp, Bifidobacterium longum; identical to SEQ ID NO: 2922
  CDS (1)..(1194)

SEQ ID NO: 6619 - protein, 397 aa, Bifidobacterium longum; identical to SEQ ID NO: 2923

SEQ ID NO: 6620 - DNA, 1062 bp, Bordetella pertussis; identical to SEQ ID NO: 2924
  CDS (1)..(1062)

SEQ ID NO: 6621 - protein, 353 aa, Bordetella pertussis; identical to SEQ ID NO: 2925

SEQ ID NO: 6622 - DNA, 1089 bp, Bradyrhizobium japonicum; identical to SEQ ID NO: 2926
  CDS (1)..(1089)

SEQ ID NO: 6623 - protein, 362 aa, Bradyrhizobium japonicum; identical to SEQ ID NO: 2927

SEQ ID NO: 6624 - DNA, 2058 bp, Campylobacter fetus; identical to SEQ ID NO: 2928
  CDS (401)..(1438)

SEQ ID NO: 6625 - protein, 345 aa, Campylobacter fetus; identical to SEQ ID NO: 2929

SEQ ID NO: 6626 - DNA, 1458 bp, Chloroflexus aurantiacus; identical to SEQ ID NO: 2930
  CDS (116)..(1171)

SEQ ID NO: 6627 - protein, 351 aa, Chloroflexus aurantiacus; identical to SEQ ID NO: 2931

SEQ ID NO: 6628 - DNA, 1053 bp, Chlamydophila caviae; identical to SEQ ID NO: 2932
  CDS (1)..(1053)

SEQ ID NO: 6629 - protein, 350 aa, Chlamydophila caviae; identical to SEQ ID NO: 2933

SEQ ID NO: 6630 - DNA, 1087 bp, Chromatium vinosum; identical to SEQ ID NO: 2934
  CDS (1)..(1044)

SEQ ID NO: 6631 - protein, 347 aa, Chromatium vinosum; identical to SEQ ID NO: 2935

SEQ ID NO: 6632 - DNA, 1346 bp, Clostridium perfringens; identical to SEQ ID NO: 2936
  CDS (172)..(1230)

SEQ ID NO: 6633 - protein, 352 aa, Clostridium perfringens; identical to SEQ ID NO: 2937

SEQ ID NO: 6634 - DNA, 1053 bp, Clostridium tetani; identical to SEQ ID NO: 2938
  CDS (1)..(1053)

SEQ ID NO: 6635 - protein, 350 aa, Clostridium tetani; identical to SEQ ID NO: 2939

SEQ ID NO: 6636 - DNA, 1161 bp, Corynebacterium efficiens; identical to SEQ ID NO: 2940
  CDS (1)..(1161)

SEQ ID NO: 6637 - protein, 386 aa, Corynebacterium efficiens; identical to SEQ ID NO: 2941

SEQ ID NO: 6638 - DNA, 1402 bp, Corynebacterium glutamicum; identical to SEQ ID NO: 2942
  CDS (133)..(1263)

SEQ ID NO: 6639 - protein, 376 aa, Corynebacterium glutamicum; identical to SEQ ID NO: 2943

SEQ ID NO: 6640 - DNA, 1409 bp, Corynebacterium pseudotuberculosis; identical to SEQ ID NO: 2944
  CDS (223)..(1332)

SEQ ID NO: 6641 - protein, 369 aa, Corynebacterium pseudotuberculosis; identical to SEQ ID NO: 2945

SEQ ID NO: 6642 - DNA, 1032 bp, Coxiella burnetii; identical to SEQ ID NO: 2946
  CDS (1)..(1032)

SEQ ID NO: 6643 - protein, 343 aa, Coxiella burnetii; identical to SEQ ID NO: 2947

SEQ ID NO: 6644 - DNA, 1047 bp, Enterococcus faecalis; identical to SEQ ID NO: 2948
  CDS (1)..(1047)

SEQ ID NO: 6645 - protein, 348 aa, Enterococcus faecalis; identical to SEQ ID NO: 2949

SEQ ID NO: 6646 - DNA, 1072 bp, Erwinia carotovora; identical to SEQ ID NO: 2950
  CDS (1)..(1029)

SEQ ID NO: 6647 - protein, 342 aa, Erwinia carotovora; identical to SEQ ID NO: 2951

SEQ ID NO: 6648 - DNA, 1137 bp, Fusobacterium nucleatum; identical to SEQ ID NO: 2952
  CDS (1)..(1137)

SEQ ID NO: 6649 - protein, 378 aa, Fusobacterium nucleatum; identical to SEQ ID NO: 2953

SEQ ID NO: 6650 - DNA, 1613 bp, Herbaspirillum seropedicae; identical to SEQ ID NO: 2954
  CDS (199)..(1254)

SEQ ID NO: 6651 - protein, 351 aa, Herbaspirillum seropedicae; identical to SEQ ID NO: 2955

SEQ ID NO: 6652 - DNA, 1143 bp, Lactobacillus plantarum; identical to SEQ ID NO: 2956
  CDS (1)..(1143)

SEQ ID NO: 6653 - protein, 380 aa, Lactobacillus plantarum; identical to SEQ ID NO: 2957

SEQ ID NO: 6654 - DNA, 1101 bp, Leptospira interrogans; identical to SEQ ID NO: 2958
  CDS (1)..(1101)

SEQ ID NO: 6655 - protein, 366 aa, Leptospira interrogans; identical to SEQ ID NO: 2959

SEQ ID NO: 6656 - DNA, 1126 bp, Mycoplasma mycoides; identical to SEQ ID NO: 2960
  CDS (79)..(1116)

SEQ ID NO: 6657 - protein, 345 aa, Mycoplasma mycoides; identical to SEQ ID NO: 2961

SEQ ID NO: 6658 - DNA, 1050 bp, Mycobacterium smegmatis; identical to SEQ ID NO: 2962
  CDS (1)..(1050)

SEQ ID NO: 6659 - protein, 349 aa, Mycobacterium smegmatis; identical to SEQ ID NO: 2963

SEQ ID NO: 6660 - DNA, 1044 bp, Oceanobacillus iheyensis; identical to SEQ ID NO: 2964
  CDS (1)..(1044)

SEQ ID NO: 6661 - protein, 347 aa, Oceanobacillus iheyensis; identical to SEQ ID NO: 2965

SEQ ID NO: 6662 - DNA, 1071 bp, Paracoccus denitrificans; identical to SEQ ID NO: 2966
  CDS (1)..(1071)

SEQ ID NO: 6663 - protein, 356 aa, Paracoccus denitrificans; identical to SEQ ID NO: 2967

SEQ ID NO: 6664 - DNA, 1320 bp, Pasteurella haemolytica; identical to SEQ ID NO: 2968
  CDS (157)..(1263)

SEQ ID NO: 6665 - protein, 368 aa, Pasteurella haemolytica; identical to SEQ ID NO: 2969

SEQ ID NO: 6666 - DNA, 1500 bp, Pasteurella multocida; identical to SEQ ID NO: 2970
  CDS (175)..(1239)

SEQ ID NO: 6667 - protein, 354 aa, Pasteurella multocida; identical to SEQ ID NO: 2971

SEQ ID NO: 6668 - DNA, 1023 bp, Porphyromonas gingivalis; identical to SEQ ID NO: 2972
  CDS (1)..(1023)

SEQ ID NO: 6669 - protein, 340 aa, Porphyromonas gingivalis; identical to SEQ ID NO: 2973

SEQ ID NO: 6670 - DNA, 1824 bp, Prevotella ruminicola; identical to SEQ ID NO: 2974
  CDS (501)..(1523)

SEQ ID NO: 6671 - protein, 340 aa, Prevotella ruminicola; identical to SEQ ID NO: 2975

SEQ ID NO: 6672 - DNA, 978 bp, Proteus vulgaris; identical to SEQ ID NO: 2976
  CDS (1)..(978)

SEQ ID NO: 6673 - protein, 325 aa, Proteus vulgaris; identical to SEQ ID NO: 2977

SEQ ID NO: 6674 - DNA, 1047 bp, Pseudomonas oleovorans; identical to SEQ ID NO: 2978
  CDS (1)..(1047)

SEQ ID NO: 6675 - protein, 348 aa, Pseudomonas oleovorans; identical to SEQ ID NO: 2979

SEQ ID NO: 6676 - DNA, 1068 bp, Pseudomonas putida; identical to SEQ ID NO: 2980
  CDS (1)..(1068)

SEQ ID NO: 6677 - protein, 355 aa, Pseudomonas putida; identical to SEQ ID NO: 2981

SEQ ID NO: 6678 - DNA, 1110 bp, Pseudomonas syringae; identical to SEQ ID NO: 2982
  CDS (46)..(1110)

SEQ ID NO: 6679 - protein, 354 aa, Pseudomonas syringae; identical to SEQ ID NO: 2983

SEQ ID NO: 6680 - DNA, 1980 bp, Pseudomonas tolaasii; identical to SEQ ID NO: 2984
  CDS (414)..(1472)

SEQ ID NO: 6681 - protein, 352 aa, Pseudomonas tolaasii; identical to SEQ ID NO: 2985

SEQ ID NO: 6682 - DNA, 1501 bp, Rhizobium etli; identical to SEQ ID NO: 2986
  CDS (242)..(1327)

SEQ ID NO: 6683 - protein, 361 aa, Rhizobium etli; identical to SEQ ID NO: 2987

SEQ ID NO: 6684 - DNA, 1098 bp, Rhizobium loti; identical to SEQ ID NO: 2988
  CDS (1)..(1098)

SEQ ID NO: 6685 - protein, 365 aa, Rhizobium loti; identical to SEQ ID NO: 2989

SEQ ID NO: 6686 - DNA, 1092 bp, Rhodopseudomonas palustris; identical to SEQ ID NO: 2990
  CDS (1)..(1092)

SEQ ID NO: 6687 - protein, 363 aa, Rhodopseudomonas palustris; identical to SEQ ID NO: 2991

SEQ ID NO: 6688 - DNA, 1047 bp, Rhodopseudomonas viridis; identical to SEQ ID NO: 2992
  CDS (1)..(1047)

SEQ ID NO: 6689 - protein, 348 aa, Rhodopseudomonas viridis; identical to SEQ ID NO: 2993

SEQ ID NO: 6690 - DNA, 1074 bp, Shewanella oneidensis; identical to SEQ ID NO: 2994
  CDS (1)..(1074)

SEQ ID NO: 6691 - protein, 357 aa, Shewanella oneidensis; identical to SEQ ID NO: 2995

SEQ ID NO: 6692 - DNA, 1235 bp, Spirulina platensis; identical to SEQ ID NO: 2996
  CDS (54)..(1151)

SEQ ID NO: 6693 - protein, 365 aa, Spirulina platensis; identical to SEQ ID NO: 2997

SEQ ID NO: 6694 - DNA, 1074 bp, Staphylococcus epidermidis; identical to SEQ ID NO: 2998
  CDS (25)..(1074)

SEQ ID NO: 6695 - protein, 349 aa, Staphylococcus epidermidis; identical to SEQ ID NO: 2999

SEQ ID NO: 6696 - DNA, 1140 bp, Streptococcus agalactiae; identical to SEQ ID NO: 3000
  CDS (1)..(1140)

SEQ ID NO: 6697 - protein, 379 aa, Streptococcus agalactiae; identical to SEQ ID NO: 3001

SEQ ID NO: 6698 - DNA, 1119 bp, Streptomyces ambofaciens; identical to SEQ ID NO: 3002
  CDS (1)..(1119)

SEQ ID NO: 6699 - protein, 372 aa, Streptomyces ambofaciens; identical to SEQ ID NO: 3003

SEQ ID NO: 6700 - DNA, 1134 bp, Streptomyces avermitilis; identical to SEQ ID NO: 3004
  CDS (1)..(1134)

SEQ ID NO: 6701 - protein, 377 aa, Streptomyces avermitilis; identical to SEQ ID NO: 3005

SEQ ID NO: 6702 - DNA, 1152 bp, Streptococcus mutans; identical to SEQ ID NO: 3006
  CDS (1)..(1152)

SEQ ID NO: 6703 - protein, 383 aa, Streptococcus mutans; identical to SEQ ID NO: 3007

SEQ ID NO: 6704 - DNA, 1137 bp, Streptococcus pyogenes; identical to SEQ ID NO: 3008
  CDS (1)..(1137)

SEQ ID NO: 6705 - protein, 378 aa, Streptococcus pyogenes; identical to SEQ ID NO: 3009

SEQ ID NO: 6706 - DNA, 1356 bp, Streptococcus parasanguis; identical to SEQ ID NO: 3010
  CDS (118)..(1263)

SEQ ID NO: 6707 - protein, 381 aa, Streptococcus parasanguis; identical to SEQ ID NO: 3011

SEQ ID NO: 6708 - DNA, 1416 bp, Streptomyces rimosus; identical to SEQ ID NO: 3012
  CDS (229)..(1359)

SEQ ID NO: 6709 - protein, 376 aa, Streptomyces rimosus; identical to SEQ ID NO: 3013

SEQ ID NO: 6710 - DNA, 1916 bp, Streptococcus thermophilus; identical to SEQ ID NO: 3014
  CDS (555)..(1694)

SEQ ID NO: 6711 - protein, 379 aa, Streptococcus thermophilus; identical to SEQ ID NO: 3015

SEQ ID NO: 6712 - DNA, 1271 bp, Streptomyces violaceus; identical to SEQ ID NO: 3016
  CDS (75)..(1208)

SEQ ID NO: 6713 - protein, 377 aa, Streptomyces violaceus; identical to SEQ ID NO: 3017

SEQ ID NO: 6714 - DNA, 1068 bp, Synechococcus elongatus; identical to SEQ ID NO: 3018
  CDS (1)..(1068)

SEQ ID NO: 6715 - protein, 355 aa, Synechococcus elongatus; identical to SEQ ID NO: 3019

SEQ ID NO: 6716 - DNA, 1023 bp, Thermus thermophilus; identical to SEQ ID NO: 3020
  CDS (1)..(1023)

SEQ ID NO: 6717 - protein, 340 aa, Thermus thermophilus; identical to SEQ ID NO: 3021

SEQ ID NO: 6718 - DNA, 1405 bp, Thiobacillus ferrooxidans; identical to SEQ ID NO: 3022
  CDS (196)..(1236)

SEQ ID NO: 6719 - protein, 346 aa, Thiobacillus ferrooxidans; identical to SEQ ID NO: 3023

SEQ ID NO: 6720 - DNA, 1314 bp, Tropheryma whipplei; identical to SEQ ID NO: 3024
  CDS (1)..(1314)

SEQ ID NO: 6721 - protein, 437 aa, Tropheryma whipplei; identical to SEQ ID NO: 3025

SEQ ID NO: 6722 - DNA, 1411 bp, Vibrio cholerae; identical to SEQ ID NO: 3026
  CDS (183)..(1247)

SEQ ID NO: 6723 - protein, 354 aa, Vibrio cholerae; identical to SEQ ID NO: 3027

SEQ ID NO: 6724 - DNA, 1044 bp, Vibrio parahaemolyticus; identical to SEQ ID NO: 3028
  CDS (1)..(1044)

SEQ ID NO: 6725 - protein, 347 aa, Vibrio parahaemolyticus; identical to SEQ ID NO: 3029

SEQ ID NO: 6726 - DNA, 996 bp, Wigglesworthia glossinidia brevipalpis; identical to SEQ ID NO: 3030
  CDS (1)..(996)

SEQ ID NO: 6727 - protein, 331 aa, Wigglesworthia glossinidia brevipalpis; identical to SEQ ID NO: 3031

SEQ ID NO: 6728 - DNA, 1035 bp, Xanthomonas axonopodis; identical to SEQ ID NO: 3032
  CDS (1)..(1035)

SEQ ID NO: 6729 - protein, 344 aa, Xanthomonas axonopodis; identical to SEQ ID NO: 3033

SEQ ID NO: 6730 - DNA, 1594 bp, Xenorhabdus nematophilus; identical to SEQ ID NO: 3034
  CDS (142)..(1218)

SEQ ID NO: 6731 - protein, 358 aa, Xenorhabdus nematophilus; identical to SEQ ID NO: 3035

SEQ ID NO: 6732 - DNA, 1044 bp, Xylella fastidiosa; identical to SEQ ID NO: 3036
  CDS (1)..(1044)

SEQ ID NO: 6733 - protein, 347 aa, Xylella fastidiosa; identical to SEQ ID NO: 3037

SEQ ID NO: 6734 - DNA, 1020 bp, Zymomonas mobilis; identical to SEQ ID NO: 3038
  CDS (1)..(1020)

SEQ ID NO: 6735 - protein, 339 aa, Zymomonas mobilis; identical to SEQ ID NO: 3039

SEQ ID NO: 6736 - DNA, 1660 bp, primary endosymbiont of Sitophilus oryzae; identical to SEQ ID NO: 3040
  CDS (11)..(1078)

SEQ ID NO: 6737 - protein, 355 aa, primary endosymbiont of Sitophilus oryzae; identical to SEQ ID NO: 3041

SEQ ID NO: 6738 - DNA, 1110 bp, Azospirillum lipoferum; identical to SEQ ID NO: 3042
  CDS (1)..(1110)

SEQ ID NO: 6739 - protein, 369 aa, Azospirillum lipoferum; identical to SEQ ID NO: 3043

SEQ ID NO: 6740 - DNA, 1017 bp, Geobacter sulfurreducens; identical to SEQ ID NO: 3044
  CDS (1)..(1017)

SEQ ID NO: 6741 - protein, 338 aa, Geobacter sulfurreducens; identical to SEQ ID NO: 3045

SEQ ID NO: 6742 - DNA, 1230 bp, Mycobacterium paratuberculosis; identical to SEQ ID NO: 3046
  CDS (1)..(1230)

SEQ ID NO: 6743 - protein, 409 aa, Mycobacterium paratuberculosis; identical to SEQ ID NO: 3047

SEQ ID NO: 6744 - DNA, 1083 bp, Lactobacillus johnsonii; identical to SEQ ID NO: 3048
  CDS (1)..(1083)

SEQ ID NO: 6745 - protein, 360 aa, Lactobacillus johnsonii; identical to SEQ ID NO: 3049

SEQ ID NO: 6746 - DNA, 1245 bp, Treponema denticola; identical to SEQ ID NO: 3050
  CDS (1)..(1245)

SEQ ID NO: 6747 - protein, 414 aa, Treponema denticola; identical to SEQ ID NO: 3051

SEQ ID NO: 6748 - DNA, 1068 bp, Wolbachia pipientis wMel; identical to SEQ ID NO: 3052
  CDS (1)..(1068)

SEQ ID NO: 6749 - protein, 355 aa, Wolbachia pipientis wMel; identical to SEQ ID NO: 3053

SEQ ID NO: 6750 - DNA, 1074 bp, Desulfovibrio vulgaris; identical to SEQ ID NO: 3054
  CDS (1)..(1074)

SEQ ID NO: 6751 - protein, 357 aa, Desulfovibrio vulgaris; identical to SEQ ID NO: 3055

SEQ ID NO: 6752 - DNA, 1557 bp, Bacillus licheniformis; identical to SEQ ID NO: 3056
  CDS (369)..(1415)

SEQ ID NO: 6753 - protein, 348 aa, Bacillus licheniformis; identical to SEQ ID NO: 3057

SEQ ID NO: 6754 - DNA, 1119 bp, Corynebacterium diphtheriae; identical to SEQ ID NO: 3058
  CDS (1)..(1119)

SEQ ID NO: 6755 - protein, 372 aa, Corynebacterium diphtheriae; identical to SEQ ID NO: 3059

SEQ ID NO: 6756 - DNA, 1038 bp, Mycoplasma mycoides; identical to SEQ ID NO: 3060
  CDS (1)..(1038)

SEQ ID NO: 6757 - protein, 345 aa, Mycoplasma mycoides; identical to SEQ ID NO: 3061

SEQ ID NO: 6758 - DNA, 1134 bp, Bdellovibrio bacteriovorus; identical to SEQ ID NO: 3062
  CDS (1)..(1134)

SEQ ID NO: 6759 - protein, 377 aa, Bdellovibrio bacteriovorus; identical to SEQ ID NO: 3063

SEQ ID NO: 6760 - DNA, 1086 bp, Parachlamydia sp; identical to SEQ ID NO: 3064
  CDS (1)..(1086)

SEQ ID NO: 6761 - protein, 361 aa, Parachlamydia sp; identical to SEQ ID NO: 3065

SEQ ID NO: 6762 - DNA, 1071 bp, Photobacterium profundum; identical to SEQ ID NO: 3066

SEQ ID NO: 6763 - protein, 356 aa, Photobacterium profundum; identical to SEQ ID NO: 3067

SEQ ID NO: 6764 - DNA, 24 bp, artificial sequence
  primer
atggctatcgacgaaaacaaacag

SEQ ID NO: 6765 - DNA, 27 bp, artificial sequence
  primer
ttaaaaatcttcgttagtttctgctac

SEQ ID NO: 6766 - DNA, 1263 bp, Escherichia coli K12; identical to SEQ ID NO: 2696
  CDS (1)..(1263)

SEQ ID NO: 6767 - protein, 420 aa, Escherichia coli K12; identical to SEQ ID NO: 2697

SEQ ID NO: 6768 - DNA, 1278 bp, Agrobacterium tumefaciens; identical to SEQ ID NO: 2698
  CDS (1)..(1278)

SEQ ID NO: 6769 - protein, 425 aa, Agrobacterium tumefaciens; identical to SEQ ID NO: 2699

SEQ ID NO: 6770 - DNA, 1281 bp, Sinorhizobium meliloti; identical to SEQ ID NO: 2700
  CDS (1)..(1281)

SEQ ID NO: 6771 - protein, 426 aa, Sinorhizobium meliloti; identical to SEQ ID NO: 2701

SEQ ID NO: 6772 - DNA, 1281 bp, Escherichia coli; identical to SEQ ID NO: 2702
  CDS (1)..(1281)

SEQ ID NO: 6773 - protein, 426 aa, Escherichia coli; identical to SEQ ID NO: 2703

SEQ ID NO: 6774 - DNA, 1308 bp, Streptomyces coelicolor; identical to SEQ ID NO: 2704
  CDS (1)..(1308)

SEQ ID NO: 6775 - protein, 435 aa, Streptomyces coelicolor; identical to SEQ ID NO: 2705

SEQ ID NO: 6776 - DNA, 1296 bp, Photorhabdus luminescens; identical to SEQ ID NO: 2706
  CDS (1)..(1296)

SEQ ID NO: 6777 - protein, 431 aa, Photorhabdus luminescens; identical to SEQ ID NO: 2707

SEQ ID NO: 6778 - DNA, 1281 bp, Shigella flexneri; identical to SEQ ID NO: 2708
  CDS (1)..(1281)

SEQ ID NO: 6779 - protein, 426 aa, Shigella flexneri; identical to SEQ ID NO: 2709

SEQ ID NO: 6780 - DNA, 1263 bp, Shigella flexneri; identical to SEQ ID NO: 2710
  CDS (1)..(1263)

SEQ ID NO: 6781 - protein, 420 aa, Shigella flexneri; identical to SEQ ID NO: 2711

SEQ ID NO: 6782 - DNA, 1308 bp, Vibrio vulnificus; identical to SEQ ID NO: 2712
  CDS (1)..(1308)

SEQ ID NO: 6783 - protein, 435 aa, Vibrio vulnificus; identical to SEQ ID NO: 2713

SEQ ID NO: 6784 - DNA, 1281 bp, Escherichia coli O6; identical to SEQ ID NO: 2714
  CDS (1)..(1281): y means t/u or c

SEQ ID NO: 6785 - protein, 426 aa, Escherichia coli O6; identical to SEQ ID NO: 2715
  misc_feature (246)..(246): Xaa can be Ala or Val
  misc_feature (251)..(251): Xaa can be Ala or Val

SEQ ID NO: 6786 - DNA, 1263 bp, Escherichia coli O6; identical to SEQ ID NO: 2716
  CDS (1)..(1263): n means a or g or c or t/u, w means a or t/u

SEQ ID NO: 6787 - protein, 420 aa, Escherichia coli O6; identical to SEQ ID NO: 2717
  misc_feature (239)..(239): Xaa can be any amino acid
  misc_feature (265)..(265): Xaa can be Ser or Thr

SEQ ID NO: 6788 - DNA, 1260 bp, Klebsiella oxytoca; identical to SEQ ID NO: 2718
  CDS (1)..(1260)

SEQ ID NO: 6789 - protein, 419 aa, Klebsiella oxytoca; identical to SEQ ID NO: 2719

SEQ ID NO: 6790 - DNA, 1356 bp, Ralstonia solanacearum; identical to SEQ ID NO: 2720
  CDS (1)..(1356)

SEQ ID NO: 6791 - protein, 451 aa, Ralstonia solanacearum; identical to SEQ ID NO: 2721

SEQ ID NO: 6792 - DNA, 1272 bp, Salmonella typhimurium; identical to SEQ ID NO: 2722
  CDS (1)..(1272)

SEQ ID NO: 6793 - protein, 423 aa, Salmonella typhimurium; identical to SEQ ID NO: 2723

SEQ ID NO: 6794 - DNA, 1284 bp, Rhizobium loti; identical to SEQ ID NO: 2724
  CDS (1)..(1284)

SEQ ID NO: 6795 - protein, 427 aa, Rhizobium loti; identical to SEQ ID NO: 2725

SEQ ID NO: 6796 - DNA, 1299 bp, Yersinia pestis; identical to SEQ ID NO: 2726
  CDS (1)..(1299)

SEQ ID NO: 6797 - protein, 432 aa, Yersinia pestis; identical to SEQ ID NO: 2727

SEQ ID NO: 6798 - DNA, 1287 bp, Photobacterium profundum; identical to SEQ ID NO: 2728
  CDS (1)..(1287)

SEQ ID NO: 6799 - protein, 428 aa, Photobacterium profundum; identical to SEQ ID NO: 2729

SEQ ID NO: 6800 - DNA, 22 bp, artificial sequence
  primer
atgaaaacgttaattgcccggc

SEQ ID NO: 6801 - DNA, 22 bp, artificial sequence
  primer
ttattccgcacagccgtagcga

SEQ ID NO: 6802 - DNA, 506 bp, Saccharomyces cerevisiae; identical to SEQ ID NO: 5286
  CDS (135)..(458)

SEQ ID NO: 6803 - protein, 107 aa, Saccharomyces cerevisiae; identical to SEQ ID NO: 5287

SEQ ID NO: 6804 - DNA, 23 bp, artificial sequence
  primer
atgcgccttcagtggccaaagtt

SEQ ID NO: 6805 - DNA, 24 bp, artificial sequence
  primer
ttacaccactaaccacgtatttgc

SEQ ID NO: 6806 - DNA, 300 bp, Saccharomyces cerevisiae; identical to SEQ ID NO: 5168
  CDS (1)..(300)

SEQ ID NO: 6807 - protein, 99 aa, Saccharomyces cerevisiae; identical to SEQ ID NO: 5169

SEQ ID NO: 6808 - DNA, 282 bp, Saccharomyces cerevisiae; identical to SEQ ID NO: 5170
  CDS (1)..(282)

SEQ ID NO: 6809 - protein, 93 aa, Saccharomyces cerevisiae; identical to SEQ ID NO: 5171

SEQ ID NO: 6810 - DNA, 995 bp, Gallus gallus (chicken); identical to SEQ ID NO: 5172
  CDS (100)..(723)

SEQ ID NO: 6811 - protein, 207 aa, Gallus gallus (chicken); identical to SEQ ID NO: 5173

SEQ ID NO: 6812 - DNA, 603 bp, Strongylocentrotus purpuratus (purple urchin); identical to SEQ ID NO: 5174
  CDS (1)..(603)

SEQ ID NO: 6813 - protein, 200 aa, Strongylocentrotus purpuratus (purple urchin); identical to SEQ ID NO: 5175

SEQ ID NO: 6814 - DNA, 401 bp, Babesia bovis; identical to SEQ ID NO: 5176
  CDS (69)..(362)

SEQ ID NO: 6815 - protein, 97 aa, Babesia bovis; identical to SEQ ID NO: 5177

SEQ ID NO: 6816 - DNA, 327 bp, Schizosaccharomyces pombe; identical to SEQ ID NO: 5178
  CDS (1)..(327)

SEQ ID NO: 6817 - protein, 108 aa, Schizosaccharomyces pombe; identical to SEQ ID NO: 5179

SEQ ID NO: 6818 - DNA, 1381 bp, Caenorhabditis elegans; identical to SEQ ID NO: 5180
  CDS (176)..(883)

SEQ ID NO: 6819 - protein, 235 aa, Caenorhabditis elegans; identical to SEQ ID NO: 5181

SEQ ID NO: 6820 - DNA, 1194 bp, Homo sapiens; identical to SEQ ID NO: 5182
  CDS (77)..(724)

SEQ ID NO: 6821 - protein, 215 aa, Homo sapiens [sequence omitted]

SEQ ID NO: 6822 - DNA, 392 bp, Plasmodium falciparum; identical to SEQ ID NO: 5184
  CDS (79)..(372)

SEQ ID NO: 6823 - protein, 97 aa, Plasmodium falciparum; identical to SEQ ID NO: 5185

SEQ ID NO: 6824 - DNA, 543 bp, Plasmodium yoelii yoelii; identical to SEQ ID NO: 5186
  CDS (72)..(389): n means a or g or c or t/u

SEQ ID NO: 6825 - protein, 105 aa, Plasmodium yoelii yoelii; identical to SEQ ID NO: 5187

SEQ ID NO: 6826 - DNA, 312 bp, Neurospora crassa; identical to SEQ ID NO: 5188
  CDS (1)..(312)

SEQ ID NO: 6827 - protein, 103 aa, Neurospora crassa; identical to SEQ ID NO: 5189

SEQ ID NO: 6828 - DNA, 618 bp, Brachydanio rerio; identical to SEQ ID NO: 5190
  CDS (1)..(618)

SEQ ID NO: 6829 - protein, 205 aa, Brachydanio rerio; identical to SEQ ID NO: 5191

SEQ ID NO: 6830 - DNA, 627 bp, Dermacentor variabilis; identical to SEQ ID NO: 5192
  CDS (1)..(627)

SEQ ID NO: 6831 - protein, 208 aa, Dermacentor variabilis; identical to SEQ ID NO: 5193

SEQ ID NO: 6832 - DNA, 648 bp, Mus musculus; identical to SEQ ID NO: 5194
  CDS (1)..(648)

SEQ ID NO: 6833 - protein, 215 aa, Mus musculus; identical to SEQ ID NO: 5195

SEQ ID NO: 6834 - DNA, 300 bp, Plasmodium falciparum; identical to SEQ ID NO: 5196
  CDS (1)..(300)

SEQ ID NO: 6835 - protein, 99 aa, Plasmodium falciparum; identical to SEQ ID NO: 5197

SEQ ID NO: 6836 - DNA, 699 bp, Homo sapiens; identical to SEQ ID NO: 5198
  CDS (83)..(667)

SEQ ID NO: 6837 - protein, 195 aa, Homo sapiens; identical to SEQ ID NO: 5199

SEQ ID NO: 6838 - DNA, 915 bp, Gallus gallus; identical to SEQ ID NO: 5200
  CDS (183)..(830)

SEQ ID NO: 6839 - protein, 215 aa, Gallus gallus; identical to SEQ ID NO: 5201

SEQ ID NO: 6840 - DNA, 294 bp, Plasmodium falciparum; identical to SEQ ID NO: 5202
  CDS (1)..(294)

SEQ ID NO: 6841 - protein, 97 aa, Plasmodium falciparum; identical to SEQ ID NO: 5203

SEQ ID NO: 6842 - DNA, 279 bp, Candida albicans; identical to SEQ ID NO: 5204
  CDS (1)..(279)

SEQ ID NO: 6843 - protein, 92 aa, Candida albicans; identical to SEQ ID NO: 5205

SEQ ID NO: 6844 - DNA, 1266 bp, Mus musculus; identical to SEQ ID NO: 5206
  CDS (90)..(737)

SEQ ID NO: 6845 - protein, 215 aa, Mus musculus; identical to SEQ ID NO: 5195

SEQ ID NO: 6846 - DNA, 782 bp, Mus musculus; identical to SEQ ID NO: 5208
  CDS (60)..(692)

SEQ ID NO: 6847 - protein, 210 aa, Mus musculus; identical to SEQ ID NO: 5209

SEQ ID NO: 6848 - DNA, 1153 bp, Sus scrofa; identical to SEQ ID NO: 5210
  CDS (144)..(776)

SEQ ID NO: 6849 - protein, 210 aa, Sus scrofa; identical to SEQ ID NO: 5211

SEQ ID NO: 6850 - DNA, 285 bp, Ashbya gossypii; identical to SEQ ID NO: 5212
  CDS (1)..(285)

SEQ ID NO: 6851 - protein, 94 aa, Ashbya gossypii; identical to SEQ ID NO: 5213

SEQ ID NO: 6852 - DNA, 833 bp, Branchiostoma belcheri tsingtaunese; identical to SEQ ID NO: 5214
  CDS (61)..(729)

SEQ ID NO: 6853 - protein, 222 aa, Branchiostoma belcheri tsingtaunese; identical to SEQ ID NO: 5215

SEQ ID NO: 6854 - DNA, 24 bp, artificial sequence
  primer
atggccgcaactaaagaagcaaag

SEQ ID NO: 6855 - DNA, 25 bp, artificial sequence
  primer
tcaagcacgtgtagcattgtacaat

SEQ ID NO: 6856 - DNA, 603 bp, Saccharomyces cerevisiae; identical to SEQ ID NO: 1305
  CDS (1)..(603)

SEQ ID NO: 6857 - protein, 200 aa, Saccharomyces cerevisiae; identical to SEQ ID NO: 1306

SEQ ID NO: 6858 - DNA, 714 bp, Candida albicans; identical to SEQ ID NO: 1307
  CDS (1)..(714)

SEQ ID NO: 6859 - protein, 237 aa, Candida albicans; identical to SEQ ID NO: 1308

SEQ ID NO: 6860 - DNA, 24 bp, artificial sequence
  primer
atggcaggtatcaagttgacgcat

SEQ ID NO: 6861 - DNA, 28 bp, artificial sequence
  primer
tcattttgttaatagttttttgtatgct

SEQ ID NO: 6862 - DNA, 1716 bp, Saccharomyces cerevisiae; identical to SEQ ID NO: 230
  CDS (1)..(1716)

SEQ ID NO: 6863 - protein, 571 aa, Saccharomyces cerevisiae; identical to SEQ ID NO: 231

SEQ ID NO: 6864 - DNA, 2817 bp, Neurospora crassa; identical to SEQ ID NO: 1285
  CDS (1)..(2817)

SEQ ID NO: 6865 - protein, 938 aa, Neurospora crassa; identical to SEQ ID NO: 239

SEQ ID NO: 6866 - DNA, 2658 bp, Mus musculus; identical to SEQ ID NO: 1287
  CDS (1)..(2658)

SEQ ID NO: 6867 - protein, 885 aa, Mus musculus; identical to SEQ ID NO: 245

SEQ ID NO: 6868 - DNA, 2583 bp, Xenopus laevis; identical to SEQ ID NO: 246
  CDS (1)..(2583)

SEQ ID NO: 6869 - protein, 860 aa, Xenopus laevis; identical to SEQ ID NO: 247

SEQ ID NO: 6870 - DNA, 2568 bp, Homo sapiens; identical to SEQ ID NO: 1291
  CDS (1)..(2568)

SEQ ID NO: 6871 - protein, 855 aa, Homo sapiens; identical to SEQ ID NO: 241

SEQ ID NO: 6872 - DNA, 2625 bp, Homo sapiens; identical to SEQ ID NO: 242
  CDS (1)..(2625)

SEQ ID NO: 6873 - protein, 874 aa, Homo sapiens; identical to SEQ ID NO: 243

SEQ ID NO: 6874 - DNA, 2076 bp, Caenorhabditis elegans; identical to SEQ ID NO: 1295
  CDS (1)..(2076)

SEQ ID NO: 6875 - protein, 691 aa, Caenorhabditis elegans; identical to SEQ ID NO: 235

SEQ ID NO: 6876 - DNA, 1782 bp, Schizosaccharomyces pombe; identical to SEQ ID NO: 1297
  CDS (1)..(1782)

SEQ ID NO: 6877 - protein, 593 aa, Schizosaccharomyces pombe; identical to SEQ ID NO: 237

SEQ ID NO: 6878 - DNA, 26 bp, artificial sequence
  primer
atgaatgatcctcgtgaaattttagc

SEQ ID NO: 6879 - DNA, 25 bp, artificial sequence
  primer
ttatattatctcaagatcgctggca

SEQ ID NO: 6880 - DNA, 432 bp, Saccharomyces cerevisiae
  CDS (1)..(432)
atggagaccaatttttccttcgactcgaatttaattgttattatcattatcacgttgtttgccacaagaattattgctaaaagatttttatctactccaaaaatggtatcccaggaaacagttgctcacgtaaaggatctgattggccaaaaggaagtgtttgttgcagcaaagacatactgcccttactgtaaagctactttgtctaccctcttccaagaattgaacgttcccaaatccaaggcccttgtgttggaattagatgaaatgagcaatggctcagagattcaagacgctttagaagaaatctcgggccaaaaaactgtacctaacgtatacatcaatggcaagcacattggtggtaacagcgatttggaaactttgaagaaaaatggcaagttagctgaaatattgaagccggtatttcaatag

SEQ ID NO: 6881 - protein, 143 aa, Saccharomyces cerevisiae
METNFSFDSNLIVIIIITLFATRIIAKRFLSTPKMVSQETVAHVKDLIGQKEVFVAAKTYCPYCKATLSTLFQELNVPKSKALVLELDEMSNGSEIQDALEEISGQKTVPNVYINGKHIGGNSDLETLKKNGKLAEILKPVFQ

SEQ ID NO: 6882 - DNA, 309 bp, Arabidopsis thaliana (mouse-ear cress)
  CDS (1)..(309)
atggagaacctacagaagatgatctctgagaagtcggtagtaatttttagcaagaactcatgctgcatgtctcatacaattaagactctcttcttagactttggcgtgaacccgactatctatgagctcgacgagatcaacataggaagggagatagagcaagcattggctcagctcggatgcagcccgaccgttccggtggtgttcattggagggcagcttgttggtggagccaatcaagtcatgagtctccatctcaaccgctcccttgttcctatgcttaaacgtgctggagcattatggctttaa

SEQ ID NO: 6883 - protein, 102 aa, Arabidopsis thaliana (mouse-ear cress)
MENLQKMISEKSVVIFSKNSCCMSHTIKTLFLDFGVNPTIYELDEINIGREIEQALAQLGCSPTVPVVFIGGQLVGGANQVMSLHLNRSLVPMLKRAGALWL

SEQ ID NO: 6884 - DNA, 501 bp, Brucella melitensis
  CDS (28)..(306)
ttttgccgcttatataatgggcaaagaatggagtttctcatggttgacgtcatcatctatacccgccccggctgcccctattgcgcacgggcaaaggcgcttctggcccgaaagggtgccgagttcaatgaaatcgatgcctcggcaacgccggaattgcgcgctgaaatgcaagagcgctccgggcgcaataccttcccgcagatttttatcggctcggttcatgtcggcggctgcgacgatctttatgcactggaagacgagggcaagctcgatagcctgctgaaaaccggcaaacttatttagaggtcaaatcatgagcacctttcgcgctgccgcaatccagatgcgttcgggcattgatgtcgtccgcaatgtggaggctctcgaaaaactggtcgcagatgcggcagcgcaaggcgcccattatatccagacgccggaaatgaccggcgcgctgatgcgcgaccgtccggccctttttgcaagcgtgcgcgatga

SEQ ID NO: 6885 - protein, 92 aa, Brucella melitensis
MEFLMVDVIIYTRPGCPYCARAKALLARKGAEFNEIDASATPELRAEMQERSGRNTFPQIFIGSVHVGGCDDLYALEDEGKLDSLLKTGKLI

SEQ ID NO: 6886 - DNA, 324 bp, Nostoc sp. PCC 7120
  CDS (1)..(324)
atgacacaggaaaccagcgaaaaaattaataatttaataacacaaaataaaattatggttttcatgaagggaaccaaattgatgcctcagtgtggcttctctaacaatgttgtgcagattctcaatactttgggtgttccttttgagactatcaacgttttagaagaccaagaaattcgccagggtattaaagaatattccaactggccgacaattccccaagtttatatcaatggggagtttattggtggttccgatattctgattgaactttaccaaaaaggtgagttacagcaattagtggaagttgctttagcttcttag

SEQ ID NO: 6887 - protein, 107 aa, Nostoc sp. PCC 7120
MTQETSEKINNLITQNKIMVFMKGTKLMPQCGFSNNVVQILNTLGVPFETINVLEDQEIRQGIKEYSNWPTIPQVYINGEFIGGSDILIELYQKGELQQLVEVALAS

SEQ ID NO: 6888 - DNA, 309 bp, Arabidopsis thaliana (mouse-ear cress)
  CDS (1)..(309)
atggagaatctacaaaagatgatctccgagaagtcggtagtgatctttagcaagaactcttgctgcatgtctcacacaatcaagactctcttcttagaccttggcgtgaacccgacgatctatgaactcgatgagattagcagaggaaaggagatagagcatgcattggctcagctcgggtgcagcccgacagtgccagtggtgttcataggagggcagcttgttggtggagccaatcaagtcatgagtctccatctcaaccgctcccttgttccaatgcttaagcgcgctggagctttatggctttga

SEQ ID NO: 6889 - protein, 102 aa, Arabidopsis thaliana (mouse-ear cress)
MENLQKMISEKSVVIFSKNSCCMSHTIKTLFLDLGVNPTIYELDEISRGKEIEHALAQLGCSPTVPVVFIGGQLVGGANQVMSLHLNRSLVPMLKRAGALWL

SEQ ID NO: 6890 - DNA, 540 bp, Arabidopsis thaliana (mouse-ear cress)
  CDS (1)..(540)
atggtagccgcaacagtaaacctcgcgaacatgacatggacgtcgttaaattcaaatccagcaatctctttctccatgttaagcggaatcagaaacttgggcatgttacctttcaggagatgtctaaagccgacagttatcggaatcgcgtcgtggccaccactccgttgttcttctgttaaggctatgtcttcatcatcgtcttcgtctggatcgacattggaggagactgttaaaacgactgtggcagagaaccctgtcgttgtttactccaaaacctggtgctcatactcgtctcaagtgaagtccttgttcaagagtcttcaagttgagccactggttgttgaattggatcaacttggttcagaagggtcgcagctgcagaatgtgttggagaaaattactggacaatacactgttcccaatgttttcatcggaggcaagcacattggtggctgctcagatacattgcagctgcacaataaaggagagctggaagcaattttagctgaagccaatggaaaaaacggtcagacctag

SEQ ID NO: 6891 - protein, 179 aa, Arabidopsis thaliana (mouse-ear cress)
MVAATVNLANMTWTSLNSNPAISFSMLSGIRNLGMLPFRRCLKPTVIGIASWPPLRCSSVKAMSSSSSSSGSTLEETVKTTVAENPVVVYSKTWCSYSSQVKSLFKSLQVEPLVVELDQLGSEGSQLQNVLEKITGQYTVPNVFIGGKHIGGCSDTLQLHNKGELEAILAEANGKNGQT

SEQ ID NO: 6892 - DNA, 327 bp, vaccinia virus
  CDS (1)..(327)
atggccgaggaatttgtacaacagaggttggccaataacaaagtgacaatttttgtcaagtatacatgtcctttttgtagaaacgcactggatattctaaataagtttagtttcaaaagaggagcgtatgaaattgtcgatattaaagaatttaaacccgaaaatgaattgcgcgactattttgaacaaattactggtggtagaactgttcctaggatcttttttgggaaaacttctattggtggatatagcgacctgttggaaatagacaacatggacgcattgggtgatattctatcatctattggggtattgagaacttgttga

SEQ ID NO: 6893 - protein, 108 aa, vaccinia virus
MAEEFVQQRLANNKVTIFVKYTCPFCRNALDILNKFSFKRGAYEIVDIKEFKPENELRDYFEQITGGRTVPRIFFGKTSIGGYSDLLEIDNMDALGDILSSIGVLRTC

SEQ ID NO: 6894 - DNA, 312 bp, Arabidopsis thaliana (mouse-ear cress)
  CDS (1)..(312)
atggaacgagtaagagatttggcatcggagaaggcggctgtgatattcacgaagagctcgtgttgcatgtgtcatagcatcaagactctcttctacgaactcggggcgagtcctgccatccatgagcttgacaaggacccgcaaggccctgacatggaacgggccctcttccgggtattcgggtctaaccctgctgtccctgcggttttcgtaggaggaaggtacgtcggctcagctaaagacgtcatctccttccacgtggatggctccctcaagcagatgttaaaggcctctaacgccatatggttgtga

SEQ ID NO: 6895 - protein, 103 aa, Arabidopsis thaliana (mouse-ear cress)
MERVRDLASEKAAVIFTKSSCCMCHSIKTLFYELGASPAIHELDKDPQGPDMERALFRVFGSNPAVPAVFVGGRYVGSAKDVISFHVDGSLKQMLKASNAIWL

SEQ ID NO: 6896 - DNA, 309 bp, Arabidopsis thaliana (mouse-ear cress)
  CDS (1)..(309)
atggagaagatacaaaagatgatctccgagaagtcggtagtaatatttagcaataactcttgttgcatgtcacacacaatcaagactctcttcttagaccttggcgtgaacccgacaatctatgagctagacgagatcaacagaggaaaagagatagagtatgcattggctcagcttggctgcagcccgactgtgccagtggtgttcataggagggcagcttgttggtggagccaatcaagtcatgagtctccatctcaaccgttctctcattccaatgcttaaacgctttggggctttatggctttga

SEQ ID NO: 6897 - protein, 102 aa, Arabidopsis thaliana (mouse-ear cress)
MEKIQKMISEKSVVIFSNNSCCMSHTIKTLFLDLGVNPTIYELDEINRGKEIEYALAQLGCSPTVPVVFIGGQLVGGANQVMSLHLNRSLIPMLKRFGALWL

SEQ ID NO: 6898 - DNA, 309 bp, Arabidopsis thaliana (mouse-ear cress)
  CDS (1)..(309)
atggagaagctacagaagatgacctcggagaagtcgttagtgatatttagcaaaaactcatgctgcatgtcgcacacaatcaagactctcttcttagaccttggcgtaaatccgacgatttatgagctagatgagatcaacagaggaaaagagatagagcaagcattggctcagcttggctgcagcccgaccgtgccagtggtgttcataggagggcagcttgtcggtggagccaatcaagtcatgagtctccatctcaaccgttctctcattccaatgcttaaacgcgttggggcgttatggctttga

SEQ ID NO: 6899 - protein, 102 aa, Arabidopsis thaliana (mouse-ear cress)
MEKLQKMTSEKSLVIFSKNSCCMSHTIKTLFLDLGVNPTIYELDEINRGKEIEQALAQLGCSPTVPVVFIGGQLVGGANQVMSLHLNRSLIPMLKRVGALWL

SEQ ID NO: 6900 - DNA, 393 bp, Arabidopsis thaliana (mouse-ear cress)
  CDS (1)..(393)
atggttgaccagagtcctcgccgtgttgtcgtggcggcgctcctattgtttgtggttctgtgcgatctttcgaattctgcgggagctgcgaattctgtgtcagctttcgttcagaacgccatcttgtccaacaagattgtcatcttctccaaatcctactgcccgtattgtttgcggtcgaaacgtatattcagccaacttaaggaagagccatttgttgtggagcttgatcagagagaggacggagatcaaatccagtatgagcttttagaattcgttggtcgtcgtactgtcccgcaagtttttgttaacggcaagcatattggtggatcagatgatcttggagctgctttggagagtggtcagttgcaaaagcttcttgctgcaagttga

SEQ ID NO: 6901 - protein, 130 aa, Arabidopsis thaliana (mouse-ear cress)
MVDQSPRRVVVAALLLFVVLCDLSNSAGAANSVSAFVQNAILSNKIVIFSKSYCPYCLRSKRIFSQLKEEPFVVELDQREDGDQIQYELLEFVGRRTVPQVFVNGKHIGGSDDLGAALESGQLQKLLAAS

SEQ ID NO: 6902 - DNA, 589 bp, Bos primigenius taurus (cattle)
  CDS (36)..(356)
atgcagtggaggtgtaccccccggagggaggcagcatggctcaagcgttcgtcaacagcaagatccagcctgggaaggtggtcgtgttcatcaagcccacctgcccctactgcagaaagactcaggagcttctcagccaactgcccttcaaacaagggcttttggaatttgtcgatattacagccgccggtaacatcagtgagattcaagattacttgcagcagctcaccggagccagaacggtacctcgggtcttcatcggtcaagagtgcataggtggatgcacagatctagtaaatatgcacgagagaggggaactgttgacacggctaaagcaaatgggagctctgcaataattacagagcagacccaggctgatatccccccttggggataggatggcattgcagataatgacagcagttcctggaggatggacctggggtgactgtacccagttacagcaaccgtttacttaaaattctgaaatattttaactgcaataaatggggaagggaagtcaacggcttcttttgactcagtattaaaaatggaccaacttgcccaaaaaaaaaaaaaaaaaatcgga

SEQ ID NO: 6903 - protein, 106 aa, Bos primigenius taurus (cattle)
MAQAFVNSKIQPGKVVVFIKPTCPYCRKTQELLSQLPFKQGLLEFVDITAAGNISEIQDYLQQLTGARTVPRVFIGQECIGGCTDLVNMHERGELLTRLKQMGALQ

SEQ ID NO: 6904 - DNA, 309 bp, Arabidopsis thaliana (mouse-ear cress)
  CDS (1)..(309)
atggataagctacagaagatgatctccgagaagtcggtagtgatctttagcaaaaactcatgttgcatgtctcacactatcaagactctcttcatagactttggcgtgaatccaacgatctatgagctagatgagatcaacagaggaaaggagatagagcaagcattggctcagcttggctgcagcccaaccgtgcctgtggtgtttattggagggcagcttgttggtggagccaatcaagtcatgagtctccatctcaatcgctctctggttcctatgctaaagagggttggagcactatggctttga

SEQ ID NO: 6905 - protein, 102 aa, Arabidopsis thaliana (mouse-ear cress)
MDKLQKMISEKSVVIFSKNSCCMSHTIKTLFIDFGVNPTIYELDEINRGKEIEQALAQLGCSPTVPVVFIGGQLVGGANQVMSLHLNRSLVPMLKRVGALWL

SEQ ID NO: 6906 - DNA, 309 bp, Arabidopsis thaliana (mouse-ear cress)
  CDS (1)..(309)
atggagaagatatcaaatttgttagaagacaagcccgtggtgatattcagcaagacgtcctgctgtatgagtcactcgatcaagtcgcttatatctggttacggtgcgaattcaacagtgtatgagctagacgaaatgtctaatggaccagagatcgaacgagcacttgtagagcttgggtgcaaaccgactgtgccagctgtctttatagggcaagagctcgtaggtggtgcaaatcaacttatgtctcttcaagtcaggaaccaactagcttcgttgctccgaagagctggagccatatggatttaa

SEQ ID NO: 6907 - protein, 102 aa, Arabidopsis thaliana (mouse-ear cress)
MEKISNLLEDKPVVIFSKTSCCMSHSIKSLISGYGANSTVYELDEMSNGPEIERALVELGCKPTVPAVFIGQELVGGANQLMSLQVRNQLASLLRRAGAIWI

SEQ ID NO: 6908 - DNA, 575 bp, Oryza sativa (rice)
  CDS (45)..(383)
gtggaatcgcctcctcctcctcctcgaccccggaatccaggaagatggcgctcgccaaggccaaggagaccgtcgcctccgctcccgtcgtcgtctacagcaagtcttactgtcctttttgcgtccgtgtgaagaagttgttcgagcagcttggagcaactttcaaggccattgagttggatggggagagtgatggatctgagctgcagtcggcacttgctgaatggactggacaaaggactgttccaaatgtcttcatcaatgggaagcatattggtggctgtgatgatactttggcattgaacaatgaagggaagctggtgcctctgctgaccgaggctggagcaattgccagttctgcaaagacgacaatcaccgcatagttcttcgtgggacactgggactagccttcgttgacctctttatactgcatccattctattagataataaaggtggatgtttgtttggcaagaccattacttgttgccgtctagtatcgtgtgatagctatcctgtgcccgtgtgaaactccttggacatcaataatatcgtctttgtgatagcagttcgctg

SEQ ID NO: 6909 - protein, 112 aa, Oryza sativa (rice)
MALAKAKETVASAPVVVYSKSYCPFCVRVKKLFEQLGATFKAIELDGESDGSELQSALAEWTGQRTVPNVFINGKHIGGCDDTLALNNEGKLVPLLTEAGAIASSAKTTITA

SEQ ID NO: 6910 - DNA, 333 bp, Saccharomyces cerevisiae
  CDS (1)..(333)
atggtatctcaagaaactatcaagcacgtcaaggaccttattgcagaaaacgagatcttcgtcgcatccaaaacgtactgtccatactgccatgcagccctaaacacgctttttgaaaagttaaaggttcccaggtccaaagttctggttttgcaattgaatgacatgaaggaaggcgcagacattcaggctgcgttatatgagattaatggccaaagaaccgtgccaaacatctatattaatggtaaacatattggaggcaacgacgacttgcaggaattgagggagactggtgaattggaggaattgttagaacctattcttgcaaattaa

SEQ ID NO: 6911 - protein, 110 aa, Saccharomyces cerevisiae
MVSQETIKHVKDLIAENEIFVASKTYCPYCHAALNTLFEKLKVPRSKVLVLQLNDMKEGADIQAALYEINGQRTVPNIYINGKHIGGNDDLQELRETGELEELLEPILAN

SEQ ID NO: 6912 - DNA, 612 bp, Saccharomyces cerevisiae
  CDS (1)..(612)
atggctattgttataaacaaaagaaacgtgagagtcttggtaataactaatttactgctcattgttgtgttttttgtgttaaggaattcgaatgctagcgtcaacgaaagtattactactcaccatcctgattcattggtgacgtttgacaattcaggaaatgcacctggcactcaccaatctgtccatgatacagtaaatacacaagataaggaagccgaagaagttgataaaaatagtggggacgctgaatttgatgccgctgcagaatacaacaaaataatggaacagtcacccatgattgtatttagcaagactggctgcccatatagcaaaaaactgaaagctttgttgactaattcgtacacgttttctccatcttactacgttgtagaattggataggcacgaacacacaaaagaactacaagaccagattgaaaaagtcactggtaggagaacagtcccaaacgttatcatcggtggtacttccagaggtggttatactgagatagcagagttacataaaaatgatgaacttctagactctttcaaaaaatggagcgatggggcgtttactgtaaaagctaattcgcaatctgagagtgcctag

SEQ ID NO: 6913 - protein, 203 aa, Saccharomyces cerevisiae
MAIVINKRNVRVLVITNLLLIVVFFVLRNSNASVNESITTHHPDSLVTFDNSGNAPGTHQSVHDTVNTQDKEAEEVDKNSGDAEFDAAAEYNKIMEQSPMIVFSKTGCPYSKKLKALLTNSYTFSPSYYVVELDRHEHTKELQDQIEKVTGRRTVPNVIIGGTSRGGYTEIAELHKNDELLDSFKKWSDGAFTVKANSQSESA

SEQ ID NO: 6914 - DNA, 321 bp, Homo sapiens (man)
  CDS (1)..(321)
atggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaa

SEQ ID NO: 6915 - protein, 106 aa, Homo sapiens (man)
MAQEFVNCKIQPGKVVVFIKPTCPYCRRAQEILSQLPIKQGLLEFVDITATNHTNEIQDYLQQLTGARTVPRVFIGKDCIGGCSDLVSLQQSGELLTRLKQIGALQ

SEQ ID NO: 6916 - DNA, 583 bp, Ricinus communis (castor bean)
  CDS (44)..(352)
cgaacgattacggttttagggttaacgatcaagagcagcagagatggcgatgactaagaccaaagagcttgtttgctcaaacgctgttgtcgttttcagcaagacgtactgcccctattgcacgagcgtgaagaagctattggatcagttgggagctaaatataaggtcgtggagttggataccgagagtgatggaagtgagattcaaacagctctggcagagtggaccggacaacgcaccgtgcccaatgttttcattggcggaaagcacatcggtggctgtgacagtacaacagccaagcacagccaagggcagctggttcctctgctcacagaagctggagctgtatagacaagcctcttacaaggagagctttgtttgactatctagataataagtctagcaataaacaacaaaactttgcgcaattgtgtttggtttatgttggtaaatgtatggaggctgcttaagacaaggttgaatgcatctatttgtgtgtgttgggatgatttctggtgtagttttcaataaatttcagcagtctttaatggtcaaaaaaaaaaaaaaaaaaaaaaaaaaaaa

SEQ ID NO: 6917 - protein, 102 aa, Ricinus communis (castor bean)
MAMTKTKELVCSNAVVVFSKTYCPYCTSVKKLLDQLGAKYKVVELDTESDGSEIQTALAEWTGQRTVPNVFIGGKHIGGCDSTTAKHSQGQLVPLLTEAGAV

SEQ ID NO: 6918 - DNA, 531 bp, Arabidopsis thaliana (mouse-ear cress)
  CDS (1)..(531)
atggcagtcacagcatttaacacattgaaacttgtatcgtcgtctctagatccgattccttcagtctcttgttcttcttattccttctctctgatatatgtcggatctccttacaagagatgtctaaagcagtcatgttctgttcgagctatgacttcttcttcttcggctgcatcgtcttcttcttcgtcctttggatcgagaatggaagagagtattaggaaaacagtgactgagaacactgtcgttatttactccaaaacttggatttgttttatttctttctttttgcttaattggagaatgggtttatcaaatatccttccactggttgttgaattggatcaacttggtccacaagggccacaactgcagaaggtactggaaagacttactgggcaacacactgttcctaatgttttcgtatgtggcaagcacattggtggctgcacagatacagtgaagcttaacaggaaaggagatctggaactgatgttagctgaagccaacggtaaaaacggtcagagttga

SEQ ID NO: 6919 - protein, 176 aa, Arabidopsis thaliana (mouse-ear cress)
MAVTAFNTLKLVSSSLDPIPSVSCSSYSFSLIYVGSPYKRCLKQSCSVRAMTSSSSAASSSSSSFGSRMEESIRKTVTENTVVIYSKTWICFISFFLLNWRMGLSNILPLVVELDQLGPQGPQLQKVLERLTGQHTVPNVFVCGKHIGGCTDTVKLNRKGDLELMLAEANGKNGQS

SEQ ID NO: 6920 - DNA, 698 bp, Mesembryanthemum crystallinum (common ice plant)
  CDS (60)..(464)
gcgagtcaacccagacaaagcgaaagagaaagaggaaaaaaaaaaaataaaaaaaaaaaatgaagagaaatggcggaaattatgcgagtttgtgttatctaaggaatgtgatggcggtgataatggtgggaatgatttggatgaacgaagctatggccagcaattcagcttccgcatttgttaacaacgtcatctactccaaccgaattgcagttttctccaaatcctactgcccatattctgtgcgtgcgaagcgtgtatttagtgacctgcaggaacggccatttgttgttgagcttgatcttcgagatgatgggtctgaaattcaggatgttcttcttgaattggttggtcgacgcacagtcccacaagttttcgtgaatgggaaacatataggaggctctgatgatctccacagtgcagtcatgagcgggctgttgcagaagcatctctcaactagttgatcgcacttcaacgaagaccgagaaaacaaccctaatcaagtttctcaaatacacacagacacattgtttagaacttgtagggatcatgaaaggaaaagtttagtcttatttctcttctttttgatctagactttaaaaagggtgtgaaatgcctttttttcctttggctaagaccctgtaaataactcctttgctcaaagaatgaatttggatctcagttatgagattgttgcc

SEQ ID NO: 6921 - protein, 134 aa, Mesembryanthemum crystallinum (common ice plant)
MKRNGGNYASLCYLRNVMAVIMVGMIWMNEAMASNSASAFVNNVIYSNRIAVFSKSYCPYSVRAKRVFSDLQERPFVVELDLRDDGSEIQDVLLELVGRRTVPQVFVNGKHIGGSDDLHSAVMSGLLQKHLSTS

SEQ ID NO: 6922 - DNA, 441 bp, Caenorhabditis elegans
  CDS (1)..(441)
atgctcaggatactcacagtcgtcttagcactcgtaacgattgctactgttcacgcagaattatccaagaagaaggaagataaaacgttgaaggatttggaggataaaattgttaatgatgttatgacgcataaagttatggtatacagtaaaacctattgcccatggagcaaacgtctgaaggctattcttgccaactatgaaattgatgacatgaagattgttgagcttgatcgatcaaatcagactgaggaaatgcaggaaattctcaaaaagtactctggaagaacgacagttccccaattattcatcagtgggaagttcgtgggtggtcacgatgagactaaggcaatcgaggagaaaggagagctgaggccacttttggagaaagctcacgccttgttcactaaccgagtgcctgtccctgacaacggtgcgtga

SEQ ID NO: 6923 - protein, 146 aa, Caenorhabditis elegans
MLRILTVVLALVTIATVHAELSKKKEDKTLKDLEDKIVNDVMTHKVMVYSKTYCPWSKRLKAILANYEIDDMKIVELDRSNQTEEMQEILKKYSGRTTVPQLFISGKFVGGHDETKAIEEKGELRPLLEKAHALFTNRVPVPDNGA

SEQ ID NO: 6924 - DNA, 361 bp, Schizosaccharomyces pombe
  CDS (24)..(329)
ttgtttgttacgttattagaaccatgtctagtgttgaatcatttgttgactctgccgttgctgacaacgatgttgttgtttttgccaagtcttactgcccttactgccatgctactgaaaaggtgatcgctgataagaaaattaaggctcaggtataccagattgaccttatgaacaacggtgatgagattcaatcttacttattgaagaagaccggtcaacgtaccgtacccaatatctttattcaccaaaagcatgttggtggtaactcggatttccaagcattattcaagaagggcgagctcgactctctttttaatactgcctaatgaaattctatgagcaataaatttttttcttt

SEQ ID NO: 6925 - protein, 101 aa, Schizosaccharomyces pombe
MSSVESFVDSAVADNDVVVFAKSYCPYCHATEKVIADKKIKAQVYQIDLMNNGDEIQSYLLKKTGQRTVPNIFIHQKHVGGNSDFQALFKKGELDSLFNTA

SEQ ID NO: 6926 - DNA, 501 bp, Schizosaccharomyces pombe
  CDS (1)..(501)
atggctaatagaaagatttttcttattacatctcttataatatcgttattgcttattcatatcttcatattcagtccactgaatgaacctgagaaaaatgcaaaggcaggacctttaggtctttcagatgtctcagtgccatctgctcctaaattacctgctaaggattcaacagattttgaagtatttcttgaaaaccctgttatcatttttagtcgtcctggatgtccttatagtgctgcagctaaaaaacttctaacagaaacccttagattggatcctccagcagtggttgtagaagtcaccgactacgagcatactcaagagttaagagactggctttcttccattagcgatatatctacaatgcccaacatcttcgttggtggtcatagcatcggtggatctgattcggtccgtgctctgtaccaagaagaaaaacttcagtctactttggatgaatggacacataataaagttttaattttacctaccgactaa

SEQ ID NO: 6927 - protein, 166 aa, Schizosaccharomyces pombe
MANRKIFLITSLIISLLLIHIFIFSPLNEPEKNAKAGPLGLSDVSVPSAPKLPAKDSTDFEVFLENPVIIFSRPGCPYSAAAKKLLTETLRLDPPAVVVEVTDYEHTQELRDWLSSISDISTMPNIFVGGHSIGGSDSVRALYQEEKLQSTLDEWTHNKVLILPTD

SEQ ID NO: 6928 - DNA, 309 bp, Arabidopsis thaliana (mouse-ear cress)
  CDS (1)..(309)
atggaaagcgttagaagtttagttgaagacaaaccagtggtgatattcagcaaaagctcttgctgcatgagccactcaattcaaacactgatctcagggtttggggcaaagatgacggtctacgagctagaccaattctcaaacggtcaggagatcgagaaggcattggtacagatggggtgtaaacccagtgtaccagctgtgttcatagggcaacaattcatcggtggtgctaaccaagtaatgactcttcaggtcaagaaccagctagccgcaatgctaagaagagccggagccatatgggtgtaa

SEQ ID NO: 6929 - protein, 102 aa, Arabidopsis thaliana (mouse-ear cress)
MESVRSLVEDKPVVIFSKSSCCMSHSIQTLISGFGAKMTVYELDQFSNGQEIEKALVQMGCKPSVPAVFIGQQFIGGANQVMTLQVKNQLAAMLRRAGAIWV

SEQ ID NO: 6930 - DNA, 312 bp, Arabidopsis thaliana (mouse-ear cress)
  CDS (1)..(312)
atggagagaataagagatttgtcgtcgaagaaagcggcggtgatattcacaaagagctcatgttgtatgtgccatagcatcaagacgctattctacgaactaggcgctagtccggcgatccatgagctcgacaaagaccctgaaggccgtgaaatggaacgggccctacgtgccctcggctcatcgaacccggcggttccagctgttttcgttggaggaaggtacatcggatcagccaaagacatcatctcattccacgtggacgggtcactcaagcagatgcttaaagacgctaaggccatttggttatag

SEQ ID NO: 6931 - protein, 103 aa, Arabidopsis thaliana (mouse-ear cress)
MERIRDLSSKKAAVIFTKSSCCMCHSIKTLFYELGASPAIHELDKDPEGREMERALRALGSSNPAVPAVFVGGRYIGSAKDIISFHVDGSLKQMLKDAKAIWL

SEQ ID NO: 6932 - DNA, 391 bp, Arabidopsis thaliana (mouse-ear cress)
  CDS (33)..(341)
attgtcctgagccctcataccaaaatctgaccatggacaaggttatgagaatgtcatcggagaaaggagtcgtgatcttcaccaaaagttcatgttgtctctgctacgccgtgcaaatccttttccgtgatcttagggttcaaccaacaatccacgagatcgacaacgatcctgactgccgtgagatcgagaaggccttagttcgtcttggctgcgccaacgcggttcctgctgtctttgtaagtggcaagctcgtgggttcgaccaacgatgtcatgtcgcttcacctaagtggctccctcgttcccttgatcaagccgtatcagtcatttcataactagaaaaacaatatcgatgcttaagaaagataattagtatatactattaattg

SEQ ID NO: 6933 - protein, 102 aa, Arabidopsis thaliana (mouse-ear cress)
MDKVMRMSSEKGVVIFTKSSCCLCYAVQILFRDLRVQPTIHEIDNDPDCREIEKALVRLGCANAVPAVFVSGKLVGSTNDVMSLHLSGSLVPLIKPYQSFHN

SEQ ID NO: 6934 - DNA, 330 bp, Neurospora crassa
  CDS (1)..(330)
atgtccgacgccgctactcagaaggctaagcagctgatcaacgacaacgctgtcgttgttttcagcaagtcctactgcccctactgctccaacaccaagcaaatcctcgacggcctcaatgccaagtatgctacctacgagctcaaccaagaaagcgacggctccgatgtccaggacgctcttctcaagttgaccggccagcgcactgtcccaaacatcttcattggcaagcagcacattggcggtaactccgatctcgaggctgttgtcaagaacggcaagaacggcaagaagatccaagagctcctccaagaggcgggcgctctgtaa

SEQ ID NO: 6935 - protein, 109 aa, Neurospora crassa
MSDAATQKAKQLINDNAVVVFSKSYCPYCSNTKQILDGLNAKYATYELNQESDGSDVQDALLKLTGQRTVPNIFIGKQHIGGNSDLEAVVKNGKNGKKIQELLQEAGAL

SEQ ID NO: 6936 - DNA, 533 bp, Fritillaria agrestis
  CDS (39)..(353)
ggtggagtagcagcagcagctcgagagaggaggttgacatggctctcgcgaaggcaaaggatctcgtcgcctccaaccccgtcgtcgtcttcagcaagtcatactgtccctactgtatccgggttaaggagttgctggtgaagttgaaggcaacttacaaagtgattgaattggatctggaaagtgatggatcggcaatacaagctgcactagctgagtggaccggacaaaggacggtgccaaatgttttcatcggtgggaagcatatcggtggctgtgataagactatggagctgtacaactctggcaagctgcagccgttgttggtggaggctggggctcttgctgcttagatatcggtacggtgtgtttgtatgcagcgctaaagaataagatgacagtatgttgttggcttcctgatatgctcatctagctgcttctatgttgtgactttaatgcaaatgtttttttttccgtgtatttgtgtttggattatctatcgtgatcttaagatattaaaggaaaaaaaaaaa

SEQ ID NO: 6937 - protein, 104 aa, Fritillaria agrestis
MALAKAKDLVASNPVVVFSKSYCPYCIRVKELLVKLKATYKVIELDLESDGSAIQAALAEWTGQRTVPNVFIGGKHIGGCDKTMELYNSGKLQPLLVEAGALAA

SEQ ID NO: 6938 - DNA, 330 bp, Plasmodium yoelii yoelii
  CDS (1)..(330): m means a or c
atgggatccacatacgaagctattaaaaaatttgtacataaaatcatcgatgaaaataaaattgctgtattttcaaaaactgaatgcccatattgcgttaaagcaatatccattttaaaaggatataatcctaatgtgtatgtagagcaaattgagaaamaccctaatatggcagatatccaatcatatttcaaggaattaactggaaaaagttccgtaccaagaatatttattaacaaggaatttgtcggtggatgtgatgacttggtcaaggaaaacgaaaccggaaaacttcaagagagactcaagagcatcggratgattaactag

SEQ ID NO: 6939 - protein, 109 aa, Plasmodium yoelii yoelii
  misc_feature (54)..(54): Xaa can be Asn or His
MGSTYEAIKKFVHKIIDENKIAVFSKTECPYCVKAISILKGYNPNVYVEQIEKXPNMADIQSYFKELTGKSSVPRIFINKEFVGGCDDLVKENETGKLQERLKSIGMIN

SEQ ID NO: 6940 - DNA, 294 bp, Bordetella bronchiseptica
  CDS (1)..(294)
atgcccgccatcccatccccacccggagcgaccatgcagaaagtagtgatgtacagcaaggactattgtccctactgtgcgcgcgcccaggcgctgctcaagcagcgcggcgtcgccgatctcgaaatcatccgtatcgaccaggatccgtcgcaacgcgacatcatgatcgagcgcaccggccggcgcacggtcccgcagattttcatcggcgagacccatgtcggcgggagcgacgacctgcaggcgctggaccgctcaggcggcctgctcccgctgctcaacggcggctga

SEQ ID NO: 6941 - protein, 97 aa, Bordetella bronchiseptica
MPAIPSPPGATMQKVVMYSKDYCPYCARAQALLKQRGVADLEIIRIDQDPSQRDIMIERTGRRTVPQIFIGETHVGGSDDLQALDRSGGLLPLLNGG

SEQ ID NO: 6942 - DNA, 342 bp, Triticum aestivum
  CDS (1)..(342)
atggcgctcgccaaggccaaggagatcgtcgcctccgcttccgtcgtcgtcttcagcaagtcttactgccctttctgtgttcaagtgaagaagttgctcacgcagcttggagcaagtttcaaggccgttgagatggacactgaaagcgatggaactgagattcagtcagctcttgctgaatggactgggcagaggactgttcccaatgtcttcatcaatggaaaacacatcggtggctgtgacgatactattgcactgaacaagggagggaagctggttgctctgctgacagaggctggagcgatctccggttcttcttcgaagaccaccgtcactgcttag

SEQ ID NO: 6943 - protein, 113 aa, Triticum aestivum
MALAKAKEIVASASVVVFSKSYCPFCVQVKKLLTQLGASFKAVEMDTESDGTEIQSALAEWTGQRTVPNVFINGKHIGGCDDTIALNKGGKLVALLTEAGAISGSSSKTTVTA

SEQ ID NO: 6944 - DNA, 324 bp, Aphelenchus avenae
  CDS (1)..(324)
atgggaaaagtcaacgaatacgtggacagcgtcattgcgaagaacaaggtcgcggtgttttcgaagacctactgtccgtactgcgacaaggcgaagcaggcgctgaactcgttcaacataaagccgggcgcgctggaggtcgtcgagctggacaagcgtgacgacggcaacgagatccaggactatctcgctcagctgactggtggacggaccgttccgcgagtgttcatcaacggacagttcatcggcggaggcgacgacaccgcgcgcgccaagtccaacggcagtctggagaagaagctcaccgaaatcggtgctatctaa

SEQ ID NO: 6945 - protein, 107 aa, Aphelenchus avenae
MGKVNEYVDSVIAKNKVAVFSKTYCPYCDKAKQALNSFNIKPGALEVVELDKRDDGNEIQDYLAQLTGGRTVPRVFINGQFIGGGDDTARAKSNGSLEKKLTEIGAI

SEQ ID NO: 6946 - DNA, 327 bp, Cowpox virus
  CDS (1)..(327)
atggccgaggaatttgtacaacaaaggttggccaataacaaagtgacaatttttgtcaagtttacatgtcctttttgtagaaatgcactggatattctaaataagtttagtttcaaaagaggagcgtatgaaattgtcgatattaaagaatttaaacccgaaaatgaattgcgggattattttgaacaaattactggtggtagaactgttcctagaatcttttttgggaaaacttctattggtggatatagcgacctgttggaaatagacaacatggacgcattgggtgatattctatcatctattggggtattgagaacttgttga

SEQ ID NO: 6947 - protein, 108 aa, Cowpox virus
MAEEFVQQRLANNKVTIFVKFTCPFCRNALDILNKFSFKRGAYEIVDIKEFKPENELRDYFEQITGGRTVPRIFFGKTSIGGYSDLLEIDNMDALGDILSSIGVLRTC

SEQ ID NO: 6948 - DNA, 495 bp, Oryza sativa
  CDS (1)..(495)
atgccgccgcggagcctcaccctctcccgccttcccgtggccgcccttggcctccccttctcttcttgctccccgcctcctcctcgccttcgcttccccttcgccgcacgccgcgccaggtccctcgccaccagggcctcctcctcctctccggattcctccttcggctcgcggatggaggactctgtcaagaggacgctcgccgacaaccccgtcgtcatctactccaagtcctggtgctcctactccatggaggtcaaggcgctcttcaagcggatcggcgtccagccgcacgtcatcgagctcgaccaactcggcgcacagggacctcagttgcaaaaggtgttagagcggctgactggacagtccactgttcctaatgttttcattggtggaaagcacattggtggctgtacagatactgtgaagcttcatcgcaaaggggagctagctaccatgctgtcagagctggatatcgacgtcaacaactcatga

SEQ ID NO: 6949 - protein, 164 aa, Oryza sativa
MPPRSLTLSRLPVAALGLPFSSCSPPPPRLRFPFAARRARSLATRASSSSPDSSFGSRMEDSVKRTLADNPVVIYSKSWCSYSMEVKALFKRIGVQPHVIELDQLGAQGPQLQKVLERLTGQSTVPNVFIGGKHIGGCTDTVKLHRKGELATMLSELDIDVNNS

SEQ ID NO: 6950 - DNA, 270 bp, Vibrio vulnificus
  CDS (1)..(270)
atgccaaagattgaaatctacaccaaaagctactgcccacactgcaaagcagccaaacagaccttggcgagcatggggttggtttatcgagaaatcgaagtcagcgatgaccaagcactgtttaacgagatgctaaatcgcagccaacgcagaacggtgccacaaatttttgtcggcgatgtgcatgttggcgggaatcaagaccttatcacagcaatccgaaaaggccgatttgagaagattctacgtagccaagcaatccgtcactaa

SEQ ID NO: 6951 - protein, 89 aa, Vibrio vulnificus
MPKIEIYTKSYCPHCKAAKQTLASMGLVYREIEVSDDQALFNEMLNRSQRRTVPQIFVGDVHVGGNQDLITAIRKGRFEKILRSQAIRH

SEQ ID NO: 6952 - DNA, 525 bp, Arabidopsis thaliana
  CDS (1)..(525)
atggcagtcacagcatttaacacattgaaacttgtatcgtcgtctctagatccgattccttcagtctcttgttcttcttattccttctctctgatatatgtcggatctccttacaagagatgtctaaagcagtcatgttctgttcgagctatgacttcttcttcttcggctgcatcgtcttcttcttcgtcctttggatcgagaatggaagagagtattaggaaaacagtgactgagaacactgtcgttatttactccaaaacttggtgctcatactgtactgaagtgaagacattgttcaagagacttggggttcagccactggttgttgaattggatcaacttggtccacaagggccacaactgcagaaggtactggaaagacttactgggcaacacactgttcctaatgttttcgtatgtggcaagcacattggtggctgcacagatacagtgaagcttaacaggaaaggagatctggaactgatgttagctgaagccaacggtaaaaacggtcagagttga

SEQ ID NO: 6953 - protein, 174 aa, Arabidopsis thaliana
MAVTAFNTLKLVSSSLDPIPSVSCSSYSFSLIYVGSPYKRCLKQSCSVRAMTSSSSAASSSSSSFGSRMEESIRKTVTENTVVIYSKTWCSYCTEVKTLFKRLGVQPLVVELDQLGPQGPQLQKVLERLTGQHTVPNVFVCGKHIGGCTDTVKLNRKGDLELMLAEANGKNGQS

SEQ ID NO: 6954 - DNA, 608 bp, Arabidopsis thaliana
  CDS (68)..(445)
acaaaactcgagcagaggacatctgtaggagttgtgtcgtggtcgtctttggttaagagaagaagaaatgggttcaatgttcagtggaaaccgaatgagcaaggaagagatggaggtggtggtgaacaaggctaaagagatcgtctctgcttatcccgttgttgtcttcagcaagacatactgtggttattgccagagggtgaagcagttactgacgcagctaggagcaacttttaaagtacttgagctcgatgaaatgagtgatggaggtgagatccaatcagctttatcagagtggactggacagaccacagttccaaacgtcttcatcaaaggaaaacacatcggtggatgcgatagagtgatggagaccaacaagcaaggcaagcttgtgcctctacttactgaagctggggctattgcagataactcttctcaactttgatgaaactcgaaactagtgtgtgaagagtgtgtgttgtgtttagatcatgaaaaaagaggtatcgtcacatactcaataaagaaagatcattcccgttgtttaatacagaatatctaagtgtatacttttcatgttggtgtttcggttaatggaataaaacttg

SEQ ID NO: 6955 - protein, 125 aa, Arabidopsis thaliana
MGSMFSGNRMSKEEMEVVVNKAKEIVSAYPVVVFSKTYCGYCQRVKQLLTQLGATFKVLELDEMSDGGEIQSALSEWTGQTTVPNVFIKGKHIGGCDRVMETNKQGKLVPLLTEAGAIADNSSQL

SEQ ID NO: 6956 - DNA, 340 bp, Arabidopsis thaliana
  CDS (1)..(309)
atggatatgataacgaagatggtgatggagagaccggtggtgatttacagcaagagctcttgctgtatgtctcacacgatcaagactttgctctgcgatttcggagcaaatccagcggtttacgagctggatgagatatctagagggagggagatcgagcaggcgttgttgcggctcgggtgtagccccgcagttccgggcgttttcattggtggagagttggtcggtggagccaacgaggtcatgagtctacatcttaacggatccttgattcccatgcttaagcgggctggtgcattgtgggtttgacttatcatgtttttaactagtttacttaaca

SEQ ID NO: 6957 - protein, 102 aa, Arabidopsis thaliana
MDMITKMVMERPVVIYSKSSCCMSHTIKTLLCDFGANPAVYELDEISRGREIEQALLRLGCSPAVPGVFIGGELVGGANEVMSLHLNGSLIPMLKRAGALWV

SEQ ID NO: 6958 - DNA, 618 bp, Arabidopsis thaliana
  CDS (54)..(461)
aagtcatcgtcttcaattggcatctgaagaagaagaagaagaagaaaggagccatgacaatgtttagatctatctccatggtaatgctgctcgtcgcactagttacattcatttctatggtttcttctgctgcttcgtccccagaagccgactttgttaagaagactatctcttcccataagatcgtcattttctccaaatcctactgcccctactgcaacaaagctaaatcagtgttcagagagctggatcaagttccttatgttgtcgagcttgatgaaagagaagatggttggagcatccagactgcacttggagagattgttggaaggcgaacagtaccgcaagtcttcattaacggaaaacatctcggaggatcagatgataccgtagatgcgtatgagagcggtgaactcgccaagcttcttggtgtttccgggaacaaagaagctgaactctaggttatatatagttggaagaattgataacactctctgtgatgcttaggtgtaagcaattcaatttccatttgtattgtgttctgcagcttgatcatgaccttgtgacagcttgatcttgccttttaaacgtatcttatcaaagaccacattctgagct

SEQ ID NO: 6959 - protein, 135 aa, Arabidopsis thaliana
MTMFRSISMVMLLVALVTFISMVSSAASSPEADFVKKTISSHKIVIFSKSYCPYCNKAKSVFRELDQVPYVVELDEREDGWSIQTALGEIVGRRTVPQVFINGKHLGGSDDTVDAYESGELAKLLGVSGNKEAEL

SEQ ID NO: 6960 - DNA, 420 bp, Populus tremula x Populus tremuloides
  CDS (1)..(420)
atggcgacgaggataagattgccatcaatcttggctacagcagtaacattaacagtacttgcggcatcactcacctgggctgctggcagccctgaagctacttttgtcaaaaagaccatctcttctcatcagatcgtcatcttctccaagtcttattgcccgtattgtaagaaggctaaaggtgttttcaaagaactgaaccagacaccacatgttgtcgagctcgatcaaagagaggatgggcacgacattcaggatgccatgagtgaaattgttgggaggcgcaccgtgcctcaggttttcatagacgggaagcacattggtggctcagatgacaccgtggaagcatacgaaagtggagaacttgctaagcttttaggagttgcttcagagcagaaagatgactttaaactagaatga

SEQ ID NO: 6961 - protein, 139 aa, Populus tremula x Populus tremuloides
MATRIRLPSILATAVTLTVLAASLTWAAGSPEATFVKKTISSHQIVIFSKSYCPYCKKAKGVFKELNQTPHVVELDQREDGHDIQDAMSEIVGRRTVPQVFIDGKHIGGSDDTVEAYESGELAKLLGVASEQKDDFKLE

SEQ ID NO: 6962 - DNA, 664 bp, Mus musculus
  CDS (37)..(507)
ctgctgctctcccggagctgccggggacctttggctatgtcctggcgccgcgcggcttcggtggggaggcggctggtggcgagcgggaggatcttggcggggcggcgtggcgcggctggagctgcgggctcgggaatgggaaacagcacatcgtcgttttgggggaagtctacaactactcctgtgaaccagatccaagaaacaatttctaacaattgtgtggtgatcttctcaaaaacatcctgctcttactgttccatggccaagaagattttccatgacatgaatgtcaactacaaggctgtggagttggatatgctggaatatggcaaccagtttcaagatgcgcttcacaagatgactggggaaagaaccgttcccaggatatttgtcaatggacgatttattggaggcgcagcggacactcacaggcttcacaaagaagggaaattgctgcctctggttcatcagtgttatttaaaaaaaaaacaagaggaaagacattgaatgatgtggatagtcgccataccagtaaatgctagttagtgcagtcgtacctttgacttgaggctgttttcagtgtgtggattgccttcataaagatgattcagaataatgaacaataaattgccctggacccttcaaaaaaaaaaaaaaaaaaaaa

SEQ ID NO: 6963 - protein, 156 aa, Mus musculus
MSWRRAASVGRRLVASGRILAGRRGAAGAAGSGMGNSTSSFWGKSTTTPVNQIQETISNNCVVIFSKTSCSYCSMAKKIFHDMNVNYKAVELDMLEYGNQFQDALHKMTGERTVPRIFVNGRFIGGAADTHRLHKEGKLLPLVHQCYLKKKQEERH

SEQ ID NO: 6964 - DNA, 508 bp, Tilia platyphyllos
  CDS (28)..(375)
gaaagaaagaaagaaagaaagagagaaatggctttgccgaaggctaaggagatcgtttccgggaatccggtcgtcgttttcagcaagtcgtactgtccgttctgtgtgagcgtgaagcagttgcttgaacaaattggagcctctttcaaggccattgagcttgacaatgaaagtgatggaagtgaaattcaagcagctctggccgagtggactggtcagaggactgtgccaaatgttttcattggcgggaaacacattggtggctgtgactctacaacagctatgcacaagaatgggaagctgattcctctgctaaccgaagctggagctgttgctactgctactgctactgttactgctactgcttccgcttaagggttatgctgcctgttgtctagtctaatactcgtaaataaatgccgactttggtttatgttgattctgtcctttcagctgaatcttaatatatcataatggtattggatttgaaaaaaaaaaaaaaaaaaaa

SEQ ID NO: 6965 - protein, 115 aa, Tilia platyphyllos
MALPKAKEIVSGNPVVVFSKSYCPFCVSVKQLLEQIGASFKAIELDNESDGSEIQAALAEWTGQRTVPNVFIGGKHIGGCDSTTAMHKNGKLIPLLTEAGAVATATATVTATASA

SEQ ID NO: 6966 - DNA, 604 bp, Deschampsia antarctica
  CDS (85)..(426)
ggcctgcggctgtataaatacaggtccccggtgccggagatgggtatcgcttcctccacctcctccaacccagaatctgtagctatggcgctcgccaaggccaaggaaatcgccgcctcttctcccgtcgtcgtcttcagcaagtcttactgcccttactgcacacgggtaaagcaattgttcacaaagctaggagcaagtttcaaggctattgagctagatgtggaaggtgatggagctgatatgcagtcagcccttgctcaatggactggacagaagaccgttccaaatgtcttcatcaatgggaaacacatcggtggttgtgatgatacccttgcactggagaagtcagggaagctggtgcctctgctgagggaggccggagcaatctctggttctgcttcgaaggaaaccatgactgcttagctcgggcctgcgagttgcctcggtcgacatgttagtatgcgacatcgttccgtgttgtgaaataatgtaaggtactaaggtggatgtttagcaagatccatactgctgtctattatgtcgatgtaacggtgccaaatctatgtaaaactcgttagacataaatcaagttatcttggtg

SEQ ID NO: 6967 - protein, 113 aa, Deschampsia antarctica
MALAKAKEIAASSPVVVFSKSYCPYCTRVKQLFTKLGASFKAIELDVEGDGADMQSALAQWTGQKTVPNVFINGKHIGGCDDTLALEKSGKLVPLLREAGAISGSASKETMTA

SEQ ID NO: 6968 - DNA, 327 bp, Plasmodium berghei
  CDS (1)..(327)
atgggatccacatacgaaactattaaaaaatttgtacataaaatcatcgatgaaaataaaattgctgtattctcaaaaactgaatgcccatattgcattaaagcaatatccattttaaaaggatataatgttaatatgcatgtagagcaaattgagaaaaatgctaatatggcagatatccaatcatatttcaaggaattaactgggaaaagttccgtaccaagaatatttattaacaaagaaaatgtcggcggatgtgatgactggtcaagggaaacgaaaccggaaaccttcagagagactccagacattggaatgcttacctag

SEQ ID NO: 6969 - protein, 108 aa, Plasmodium berghei
MGSTYETIKKFVHKIIDENKIAVFSKTECPYCIKAISILKGYNVNMHVEQIEKNANMADIQSYFKELTGKSSVPRIFINKENVGGCDDWSRETKPETFRETPDIGMLT

SEQ ID NO: 6970 - DNA, 498 bp, Homo sapiens
  CDS (1)..(498)
atgaaccctcgagataagcaagtgagccgcttctcccctctaaaggatgtttacacgtgggtggcactcgctggaatccagcgctcgggcagccctgggaggacgcgctcagctgcgaggaggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtga

SEQ ID NO: 6971 - protein, 165 aa, Homo sapiens
MNPRDKQVSRFSPLKDVYTWVALAGIQRSGSPGRTRSAARRMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 6972 - DNA, 456 bp, Theileria parva
  CDS (1)..(456)
atgagttcagtgaagtatttagttttatttactttggtttgtgttgtgagtttatttcagccttcccagtgtcgtctggactatcatttcttctctgatttcctgagtaaatattccttcacgctgccgtttaaaatggccgaaaaaacgcccaaggactgggtcgacagcctcgtcaaaaaacacaaagtcgtcgtcttctccaagtcgtactgcccctactgtaccagagccaaagacgcactcaaaaaactcaacctacacgatctccacgtggaggagttggattctaatccgaacatggaccaggtccaagattacttaaaccaactcacaggagcgaggagtgtcccgcgtgtgtttgtgaatggtcgtttctacggagattccactaaaactgtttcagacgtcgagagtgggaagttcatggaacattacaagaaaactgacttataa

SEQ ID NO: 6973 - protein, 151 aa, Theileria parva
MSSVKYLVLFTLVCVVSLFQPSQCRLDYHFFSDFLSKYSFTLPFKMAEKTPKDWVDSLVKKHKVVVFSKSYCPYCTRAKDALKKLNLHDLHVEELDSNPNMDQVQDYLNQLTGARSVPRVFVNGRFYGDSTKTVSDVESGKFMEHYKKTDL

SEQ ID NO: 6974 - DNA, 336 bp, Arabidopsis thaliana
  CDS (1)..(336)
atggcgatgcagaaagctaaggagatcgttaacagcgaatcagtcgttgttttcagcaagacttattgtccatattgcgtgagagtgaaggagcttttgcaacaattgggagctaagttcaaggccgttgagctcgacaccgaaagtgatggtagccaaattcaatcaggtctcgcagaatggacaggacaacgtaccgtgcctaatgtgtttataggaggaaatcacatcggtggctgtgatgcaacatcaaacttgcataaagatgggaagttggttccgctgttaactgaagctggagcgatcgcaggaaagactgcaacaacttctgcttaa

SEQ ID NO: 6975 - protein, 111 aa, Arabidopsis thaliana
MAMQKAKEIVNSESVVVFSKTYCPYCVRVKELLQQLGAKFKAVELDTESDGSQIQSGLAEWTGQRTVPNVFIGGNHIGGCDATSNLHKDGKLVPLLTEAGAIAGKTATTSA

SEQ ID NO: 6976 - DNA, 383 bp, Mus musculus
  CDS (15)..(383)
cgggacctttggctatgtcctggcgccgccggcttcgaatgggaaacagcacatcgtcgttttgggggaagtctacaactactcctgtgaaccagatccaagaaacaatttctaacaattgtgtggtgatcttctcaaaaacatcctgctcttactgttccatggccaagaagattttccatgacatgaatgtcaactacaaggctgtggagttggatatgctggaatatggcaaccagtttcaagatgcgcttcacaagatgactggggaaagaaccgttcccaggatatttgtcaatggacgatttattggaggcgcacggacactcacaggcttcacaaagaagggaaattgctgcctctggttcatcagtgttatttaa

SEQ ID NO: 6977 - protein, 122 aa, Mus musculus
MSWRRRLRMGNSTSSFWGKSTTTPVNQIQETISNNCVVIFSKTSCSYCSMAKKIFHDMNVNYKAVELDMLEYGNQFQDALHKMTGERTVPRIFVNGRFIGGARTLTGFTKKGNCCLWFISVI

SEQ ID NO: 6978 - DNA, 318 bp, Caenorhabditis elegans
  CDS (1)..(318)
atgtcaaaagcctttgtcgacggacttctccaatcttccaaagttgtcgtattcagcaaatcgtactgcccgtactgccataaggctcgtgctgctcttgaatcggtcaacgtgaagcccgacgctctgcaatggatcgaaatcgacgagcgcaaggattgcaatgagattcaggattatcttggctctctaaccggagcccgctcggtgccacgtgtcttcatcaacggcaagttcttcggcggcggtgacgacacagcggccggagccaagaacggaaaactcgccgcactgctcaaggaaaccggagctctatag

SEQ ID NO: 6979 - protein, 105 aa, Caenorhabditis elegans
MSKAFVDGLLQSSKVVVFSKSYCPYCHKARAALESVNVKPDALQWIEIDERKDCNEIQDYLGSLTGARSVPRVFINGKFFGGGDDTAAGAKNGKLAALLKETGAL

SEQ ID NO: 6980 - DNA, 324 bp, Trypanosoma brucei
  CDS (1)..(324)
atgaataacgcattggatccggcaaaggcaccacaatttcttgatatgatgttgcgccgcaataaaatggtaatggtgtccgccacgtattgtcagttctgcacaaaactgaagatgttactgattgaactcaaacaccgtttcgtttcacttgaaattgatattattcccaacggtcgtgaagtgtttgcagaagtggtgggacgcacgggtgtacatacggtgcctcaagtttttcttaatgggaagtattttggcggttatgatgaacttgttgcaatgtaccgggcagggcacctttcagccgaaattgaaaggggctga

SEQ ID NO: 6981 - protein, 107 aa, Trypanosoma brucei
MNNALDPAKAPQFLDMMLRRNKMVMVSATYCQFCTKLKMLLIELKHRFVSLEIDIIPNGREVFAEVVGRTGVHTVPQVFLNGKYFGGYDELVAMYRAGHLSAEIERG

SEQ ID NO: 6982 - DNA, 336 bp, Plasmodium falciparum
  CDS (1)..(336)
atggctggtacaagtgaagcagttaaaaaatgggtaaacaaaataatagaagagaacatcattgctgtatttgcaaaaacggaatgcccatattgtattaaggcaatttcaattttgaagggttacaaccttaacagccatatgcatgtagaaaacattgagaaaaatccagatatggctaatattcaagcatacttaaaagaattaacaggtaaaagtagtgtacctagaatattcatcaataaggacgttgtcggcggatgtgatgatttagttaaagaaaatgatgaaggaaagctaaaagaaagactacaaaaattgggattagtcaattga

SEQ ID NO: 6983 - protein, 111 aa, Plasmodium falciparum
MAGTSEAVKKWVNKIIEENIIAVFAKTECPYCIKAISILKGYNLNSHMHVENIEKNPDMANIQAYLKELTGKSSVPRIFINKDVVGGCDDLVKENDEGKLKERLQKLGLVN

SEQ ID NO: 6984 - DNA, 654 bp, Homo sapiens
  CDS (11)..(505)
ggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtgga

SEQ ID NO: 6985 - protein, 164 aa, Homo sapiens
MIWRRAALAGTRLVWSRSGSAGWLDRAAGAAGAAAAAASGMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 6986 - DNA, 478 bp, Drosophila melanogaster
  CDS (48)..(392)
ccgcattgccccccaagtttccgtaccccctcctggatttcgagcttatgggtgcagttggatccgctttgagatccccaatagtcgacatgtccaccaagcaggcgaaattcgttgaaaacaccattgccagcaacaaagtggtgatattcagcaagacctactgtccctactgcacgatggccaaagagcccttcaaaaagctcaatgtggacgccaccataatagaactcgatggaaatcccgatggcaacgaaattcaggcagttctgggcgagattaccggtgccagaacggttccccgcgtctttatcgatggcaaattcattggcggtggcactgacatcaaacgaatgttcgagacaggagctctgcaaaaatatttccaataaatagtgttcttactctgttcagaactccgttttatgtaaaaagtttgttaatcttcaaagtccttaataaatgcttttaaaattta

SEQ ID NO: 6987 - protein, 114 aa, Drosophila melanogaster
MGAVGSALRSPIVDMSTKQAKFVENTIASNKVVIFSKTYCPYCTMAKEPFKKLNVDATIIELDGNPDGNEIQAVLGEITGARTVPRVFIDGKFIGGGTDIKRMFETGALQKYFQ

SEQ ID NO: 6988 - DNA, 351 bp, Drosophila melanogaster
  CDS (1)..(351)
atgggtacggtggtcagcacactgcagcgacccactctctacgtgagcatggacagctcgcatgcgcagttcgtgcgggacacaatcagcggcaacaaggtggtgatctttagcaagagctactgcccctattgcagcatggccaaggaacagttccgaaagatcaacgtcaaggcaacggtgatcgagctggaccagcgggatgatggcaacgagatccaggcggttcttggcgagatgacgggctcgaggaccgttccacgttgcttcatcgatggcaagttcgtgggtggcggcaccgacgtgaagcggctatacgaacagggcatactgcagaagtattttcagtga

SEQ ID NO: 6989 - protein, 116 aa, Drosophila melanogaster
MGTVVSTLQRPTLYVSMDSSHAQFVRDTISGNKVVIFSKSYCPYCSMAKEQFRKINVKATVIELDQRDDGNEIQAVLGEMTGSRTVPRCFIDGKFVGGGTDVKRLYEQGILQKYFQ

SEQ ID NO: 6990 - DNA, 644 bp, Homo sapiens
  CDS (26)..(481)
gcgccgcgcgctggcggggaccggcatggtttggagcaggagcggctcggcaggctggcttgacagggcggcgggactgcgggactgcggcactgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcttcttaaa

SEQ ID NO: 6991 - protein, 151 aa, Homo sapiens
MVWSRSGSAGWLDRAAGLRDCGTAASGMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 6992 - DNA, 572 bp, Gallus gallus
  CDS (47)..(352)
ctcgctggtgaagagcagagttcctgctcaacccatagccagcagcatggtcgattcttttgtacagagcaaactcagagataataaagttacccttttcgtgaagggatcctgcccttactgcaagaatgccatagtattgctaaaggaattcaactttctgccaggatgcctggaagtggttgatatcaccgggatggatgacatccaggattacttccagaaaacaacagggcagcgaaccgtccctcgtgtgtttattggaacaaaatgcattggaggattttcagatctgcagaagatggaacagcagctccccatgatgctacgtcaaattggtgctctggtgtagctgaaggtgcttctgctttcaggagagacgaccatgaagcttgacctacccttggacatgcatgcatcttgggacagattccttcagctgctttccgtagattgaatgcacctttttggggaatgcaactggcccatttcattcacatgtacctcaacttgtcacatctcttcctactttctgtggtactgaatgagatatacttcaacaaaaaaaaaaa

SEQ ID NO: 6993 - protein, 101 aa, Gallus gallus
MVDSFVQSKLRDNKVTLFVKGSCPYCKNAIVLLKEFNFLPGCLEVVDITGMDDIQDYFQKTTGQRTVPRVFIGTKCIGGFSDLQKMEQQLPMMLRQIGALV

SEQ ID NO: 6994 - DNA, 321 bp, Homo sapiens
  CDS (1)..(321)
atggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttatcggtaaagattgtataggcggatgcagtgatctagtctctttgcaacagagtggggaactgctgacgcggctaaagcagattggagctctgcagtaa

SEQ ID NO: 6995 - protein, 106 aa, Homo sapiens; identical to SEQ ID NO: 6915

SEQ ID NO: 6996 - DNA, 531 bp, Lycopersicon esculentum
  CDS (45)..(371)
ggcacgaggtataatctagggtttgaaaagcaaatcgattgaagatgtcacttgccaaggctaaggaaattgtttctggaaatccagttgcggtcttcagcaagacgtattgtcccttctgtgttagcgtcaaggatttgttgtcgaagcttggtgctacttttaaggctgttgagttagattctgaaaaggatggaagtgagatccaggctgcactggctgagtggactggtcagcgaactgtgccaaacgtcttcataggccgaaagcacattggtggctgtgacgcgacaactgcgttgcacagggaagggaagcttcttcctctgctaaccgaggctggagcaattgctaaaacttctacagcttagggaactatatagaaggttcaatctacttgtttctctgaaataaagtgatctatgttttttgtagttaagtgttgtcaatgctatttgatgtttcaaagaagaaagttgaaccagtaataatgcattttgaaaatttcgcgaaaaaaaaaaaaaaaaaaaa

SEQ ID NO: 6997 - protein, 108 aa, Lycopersicon esculentum
MSLAKAKEIVSGNPVAVFSKTYCPFCVSVKDLLSKLGATFKAVELDSEKDGSEIQAALAEWTGQRTVPNVFIGRKHIGGCDATTALHREGKLLPLLTEAGAIAKTSTA

SEQ ID NO: 6998 - DNA, 473 bp, Mus musculus
  CDS (9)..(332)
atgtcagcatggctcaggagtttgtgaactgcaagatccagtctgggaaggtggtcgtgttcatcaagcccacctgcccctactgcagaaagacccaagaaatcctcagtcaactgcctttcaaacaaggtcttctggagtttgtggacatcacagccactaacaacaccagtgcgattcaagattatttacaacagctcaccggagcgagaacagttcctcgggtcttcataggtaaagactgcataggcggatgcagtgatctaatctccatgcaacagactggggagctgatgactcggctgaagcagattggagctctgcagttataaaaggggtggcaggcagagtccatgctgacacagctgtctaaccatgctgatggccagtgcccctgagagttgatgtgcatcgcagaggatgtcagtatttcctggtgactgggatttttcaacaaggcggcctttattctt

SEQ ID NO: 6999 - protein, 107 aa, Mus musculus
MAQEFVNCKIQSGKVVVFIKPTCPYCRKTQEILSQLPFKQGLLEFVDITATNNTSAIQDYLQQLTGARTVPRVFIGKDCIGGCSDLISMQQTGELMTRLKQIGALQL

SEQ ID NO: 7000 - DNA, 575 bp, Sus scrofa
  CDS (24)..(344)
aattccggcagccgcctgtcagcatggctcaagcatttgtgaacagcaaaatccagcctgggaaggtggtagttttcatcaagcccacctgccccttctgcagaaagacacaggagctcctcagccaattgcccttcaaagaagggcttctggaatttgtcgatattacagccaccagtgacaccaacgagattcaagattatctgcaacagctcacaggagccagaacggtacctcgggtctttatcggtaaagagtgtataggtggatgcactgatctagaaagtatgcacaagagaggggagctcttgacccgcctgcagcaaattggagctctgaaataattacagcgaggcagacccaagctgatagctccctgtagagctggatggcagtgcagataatgacagcgcttcctggtggatggatgccgggctaccttcactcagctgcaactactgtttacttaaaaattctgaaatgtgttaacccaaataattggggggagtgggttttgggggacaaaacagatttttcttctgactctgtattaaaagtggaatcaatcttgcccc

SEQ ID NO: 7001 - protein, 106 aa, Sus scrofa
MAQAFVNSKIQPGKVVVFIKPTCPFCRKTQELLSQLPFKEGLLEFVDITATSDTNEIQDYLQQLTGARTVPRVFIGKECIGGCTDLESMHKRGELLTRLQQIGALK

SEQ ID NO: 7002 - DNA, 432 bp, Saccharomyces cerevisiae; identical to SEQ ID NO: 6880
  CDS (1)..(432)

SEQ ID NO: 7003 - protein, 143 aa, Saccharomyces cerevisiae; identical to SEQ ID NO: 6881

SEQ ID NO: 7004 - DNA, 441 bp, Caenorhabditis elegans; identical to SEQ ID NO: 6922
  CDS (1)..(441)

SEQ ID NO: 7005 - protein, 146 aa, Caenorhabditis elegans; identical to SEQ ID NO: 6923

SEQ ID NO: 7006 - DNA, 324 bp, Rattus norvegicus
  CDS (1)..(324)
atggctcaggagtttgtgaactgcaagattcagtctggaaaggtggtcgtgttcatcaaacccacctgcccctattgcagaaagactcaagaaatcctcagtcaactgcctttcaaacgtggtctcctggaatttgtggacatcacagctactaacaacaccaatgcgattcaagattatttacaacagctcaccggagcaagaacagttcctcgggtcttcataggtaaagactgcataggcggatgcagtgatctactctccatgcaacagaatggggagctgacggcccggctgaagcagattggagctctgcagttatga

SEQ ID NO: 7007 - protein, 107 aa, Rattus norvegicus
MAQEFVNCKIQSGKVVVFIKPTCPYCRKTQEILSQLPFKRGLLEFVDITATNNTNAIQDYLQQLTGARTVPRVFIGKDCIGGCSDLLSMQQNGELTARLKQIGALQL

SEQ ID NO: 7008 - DNA, 378 bp, Arabidopsis thaliana
  CDS (1)..(378)
atgtcaaggcccataacctatttcatcctcctcaagtcacttttcaaacacactttcaaattaacaaaaatggagaagctacagaagatgacctcggagaagtcgttagtgatatttagcaaaaactcatgctgcatgtcgcacacaatcaagactctcttcttagaccttggcgtaaatccgacgatttatgagctagatgagatcaacagaggaaaagagatagagcaagcattggctcagcttggctgcagcccgaccgtgccagtggtgttcataggagggcagcttgtcggtggagccaatcaagtcatgagtctccatctcaaccgttctctcattccaatgcttaaacgcgttggggcgttatggctttga

SEQ ID NO: 7009 - protein, 125 aa, Arabidopsis thaliana
MSRPITYFILLKSLFKHTFKLTKMEKLQKMTSEKSLVIFSKNSCCMSHTIKTLFLDLGVNPTIYELDEINRGKEIEQALAQLGCSPTVPVVFIGGQLVGGANQVMSLHLNRSLIPMLKRVGALWL

SEQ ID NO: 7010 - DNA, 651 bp, Ashbya gossypii
  CDS (1)..(651)
atgctacccaaatctaacagtaagttcatctcgaggcgggggatgcggatgctcctggtcacaggcgtgctcctcgtccttacgtactttattatccagaatggtacgaccagcgaccagttcgtcacgccgatagcgccgcggccagtgcctaacgcgcccagcgtgcaggacaccgtggaggccgaggagccaagcgtgcagctcctgtccaagggcgcggagggcgccgtggccgcaagcaaagaagacgtcgatgttgcgcgtgcgcagcagcagtcaaaggtgctgttcgatgcggccaagacgtacaacgagatcctctcgttgtcctcgatggtggtcttttccaagagtacctgtccgttgagctcgggcttgaaacagcttttgaacaacaactacgagttcctgcccgactatcaagtggtcgagctcgataagcacgccaacggcgccgagctccagaaatacgtcacgaagactaccgcgcgcagcaccgtgccgaacctcgttatcaacggggtctcgcgcggcggccacgatagcattatggagctccacaaaacgggcgagcttctggagagcctccgtaagtgggctaatggcaaacacgccgtaacgcaaaaacagcgcccgtcgaactcctag

SEQ ID NO: 7011 - protein, 216 aa, Ashbya gossypii
MLPKSNSKFISRRGMRMLLVTGVLLVLTYFIIQNGTTSDQFVTPIAPRPVPNAPSVQDTVEAEEPSVQLLSKGAEGAVAASKEDVDVARAQQQSKVLFDAAKTYNEILSLSSMVVFSKSTCPLSSGLKQLLNNNYEFLPDYQVVELDKHANGAELQKYVTKTTARSTVPNLVINGVSRGGHDSIMELHKTGELLESLRKWANGKHAVTQKQRPSNS

SEQ ID NO: 7012 - DNA, 336 bp, Ashbya gossypii
  CDS (1)..(336)
atggtttccccttcggttattaaacaggtgcaggcgctaatccagcagaaccgcgtgttcattgcatccaagacgtactgtccgtattgccaggcggcaaagcgtacgttgctggaggagaagcgcgtcccggcaagcgcagtaaaactgttggagcttgacaccatgggcgaggagggcgcggtgatccaagcggcgttgcaggagctgagcgggcagcgcaccgtgcccaacatctacatcaacgggcgccatgtgggtggcaacagcgacctcgaggcgctgaaggcgtctggcgagctggaccagctgttggaggaggcgctacgcgagtaa

SEQ ID NO: 7013 - protein, 111 aa, Ashbya gossypii
MVSPSVIKQVQALIQQNRVFIASKTYCPYCQAAKRTLLEEKRVPASAVKLLELDTMGEEGAVIQAALQELSGQRTVPNIYINGRHVGGNSDLEALKASGELDQLLEEALRE

SEQ ID NO: 7014 - DNA, 25 bp, artificial sequence
  primer
atggagaccaatttttccttcgact

SEQ ID NO: 7015 - DNA, 26 bp, artificial sequence
  primer
ctattgaaataccggcttcaatattt

SEQ ID NO: 7016 - DNA, 483 bp, Saccharomyces cerevisiae
  CDS (1)..(483)
atgagccagttagttctagacttaaaatgtttgaaggataaaatagcaacgaattacgatattcataacaatgtttacggtggaaacggaatggaaccaaacattattcatccgtccaaaagattcaggattgttgttcgattagtagatttcttgttctgtaaatcggatgaagaattcattaaaggttttttctgtcaaatgatagttagaaatcttcattgcctcaattcaacaaatggcgcagaggagatgcgtttgtatatgagcgaaagattattttcagcccataaagatgatttgagattgataaatgggcaggtactggatgttcgcattggggtatggtatggaatacaccaaagtccgccaatttttgaaatcattgattttaagatactatccaggaatgacgttcgtgatttctgtgaatttgtcaaatcaccacttggtgagaagtttctgaacatctctaactcctaa

SEQ ID NO: 7017 - protein, 160 aa, Saccharomyces cerevisiae
MSQLVLDLKCLKDKIATNYDIHNNVYGGNGMEPNIIHPSKRFRIVVRLVDFLFCKSDEEFIKGFFCQMIVRNLHCLNSTNGAEEMRLYMSERLFSAHKDDLRLINGQVLDVRIGVWYGIHQSPPIFEIIDFKILSRNDVRDFCEFVKSPLGEKFLNISNS

SEQ ID NO: 7018 - DNA, 25 bp, artificial sequence
  primer
atgagccagttagttctagacttaa

SEQ ID NO: 7019 - DNA, 25 bp, artificial sequence
  primer
ttaggagttagagatgttcagaaac

SEQ ID NO: 7020 - DNA, 735 bp, Escherichia coli K12
  CDS (1)..(735)
atgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctga

SEQ ID NO: 7021 - protein, 244 aa, Escherichia coli K12
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 7022 - DNA, 741 bp, Bacillus subtilis
  CDS (1)..(741)
atgcttaatgataaaacggctattgtcactggcgcatcccgcggaatcggccgctcaatcgcccttgatctggcaaaaagcggagcaaatgttgtcgtgaactactccggcaatgaagcgaaagcaaatgaagtggtagatgaaatcaaatcaatgggcagaaaagcaattgctgtaaaagcggatgtatcaaatcccgaagatgtacaaaacatgataaaagaaacattgtctgttttttctacgattgacattctggttaataatgcgggaattacaagagacaatctcatcatgagaatgaaagaagacgaatgggatgacgtcattaacattaacctgaagggtgttttcaactgcacaaaagctgttacaagacaaatgatgaaacagcgttcaggccgcattattaacgtatcgtctatcgtcggcgtcagcggaaaccctggacaagccaactacgtggctgcaaaagccggcgtcatcggtttaaccaaatcttctgctaaagagctcgccagccgaaatattacggtaaacgcaatagcgccaggatttatctcaactgatatgacagataaacttgcaaaagacgttcaagacgaaatgctgaaacaaattccgctcgcgcgctttggtgaacctagcgatgtcagcagtgttgtcacgttcctagcttcagagggagctcgttatatgacaggccaaacgcttcatattgacggcggaatggtgatgtaa

SEQ ID NO: 7023 - protein, 246 aa, Bacillus subtilis
MLNDKTAIVTGASRGIGRSIALDLAKSGANVVVNYSGNEAKANEVVDEIKSMGRKAIAVKADVSNPEDVQNMIKETLSVFSTIDILVNNAGITRDNLIMRMKEDEWDDVININLKGVFNCTKAVTRQMMKQRSGRIINVSSIVGVSGNPGQANYVAAKAGVIGLTKSSAKELASRNITVNAIAPGFISTDMTDKLAKDVQDEMLKQIPLARFGEPSDVSSVVTFLASEGARYMTGQTLHIDGGMVM

SEQ ID NO: 7024 - DNA, 744 bp, Campylobacter jejuni
  CDS (1)..(744)
atgaaatttagtggaaaaaatgttttaattactggagcaagtaagggaataggtgcttctatcgcaaaaactttggcaggttttgggcttaaagtttggatcaattatcgttcaaaacctgaacttgcagatgctttaaaagatgaaattattgcaagtggtggtgttgctgctgtgattaaatttgatgcaagcaaagaagatgagtttgaaaacggcgtaaaaactatagttgagagtgatggagagttaagttatcttgtaaataacgcaggcgttacaaatgataaacttgctttaagaatgaaattagaggactttagtggcgttgtggatacgaatttaagctcagcttttttaggttgtagagaagctttaaaaaccatgagtaaaaaacgctttggtgctgttgtaaatatcgcttctattgtcggagaaatgggcaatgctgggcaagtaaattattctgctagtaagggtggaatgatagctatgactaaatcttttgctaaagaaggagcaagtagaaatttacgctttaattgcgtaactccaggttttataaaaagcgatatgactgaagttttaagcaatgaaatcaaacaaacctatcaagataatatccctttaaaacgctttgcagagcctgaagaagtagctaattgtgtagcgtttttacttagtgattatgcctcttatgtgacaggcgatgtgcttaagatcaatggtggtttatatatgtaa

SEQ ID NO: 7025 - protein, 247 aa, Campylobacter jejuni
MKFSGKNVLITGASKGIGASIAKTLAGFGLKVWINYRSKPELADALKDEIIASGGVAAVIKFDASKEDEFENGVKTIVESDGELSYLVNNAGVTNDKLALRMKLEDFSGVVDTNLSSAFLGCREALKTMSKKRFGAVVNIASIVGEMGNAGQVNYSASKGGMIAMTKSFAKEGASRNLRFNCVTPGFIKSDMTEVLSNEIKQTYQDNIPLKRFAEPEEVANCVAFLLSDYASYVTGDVLKINGGLYM

SEQ ID NO: 7026 - DNA, 741 bp, Caulobacter crescentus
  CDS (1)..(741)
atgtttgatctcaccggcaagaccgcgctcgtcaccggcgccacgggcggcatcggcggggctatcgcccgcgccctgcacgcccagggcgcgcatgtcgtgctctcgggcacgcgggaatcggccctggccgagctgaaggcggaactgggcgagcgcgcctcgaccgtcgtcgccaacctctccgacgccgaacaggtcgatggcctggtggccaaggccgaagaagccgccggcgcgccgctggatatcgtgatcgccaacgccggcgtcacccgcgacggcctgatcgtgcgtatgaaggacgaggactgggacaccgtcatcaaggtgaacctggaaggctatttccgcctgtcgcgcgctgcggccaagggcatgatgaagcgccgcgccggccggatcatcggcatcacctcgatcgtcggcgtcacgggcaatcccggccagaccaactacgccgcctccaaggccggcatgatcggcttctccaaggccctggcccaggaactggccagccggggcgtgaccgtcaactgtgtcgcccccggcttcatcgccagcccgatgactgacgccctgaacgagcaacagaaggccggtattctgtcgaccattcccgccggcaagctgggcgagggggcggatatcgccgccgcctgtgtctatctggccagcgaccaggccggttacgtcacgggtcagaccttgcacgtcaacggcggcatggcgatgatctaa

SEQ ID NO: 7027 - protein, 246 aa, Caulobacter crescentus
MFDLTGKTALVTGATGGIGGAIARALHAQGAHVVLSGTRESALAELKAELGERASTVVANLSDAEQVDGLVAKAEEAAGAPLDIVIANAGVTRDGLIVRMKDEDWDTVIKVNLEGYFRLSRAAAKGMMKRRAGRIIGITSIVGVTGNPGQTNYAASKAGMIGFSKALAQELASRGVTVNCVAPGFIASPMTDALNEQQKAGILSTIPAGKLGEGADIAAACVYLASDQAGYVTGQTLHVNGGMAMI

SEQ ID NO: 7028 - DNA, 735 bp, Yersinia pestis
  CDS (1)..(735)
atgagcttcgaaggaaaaattgcactggtcactggcgcgagccgtggtattggtcgcgctattgcagaattattggttgaacgcggtgcttgtgttattggtaccgcgaccagtgagaagggcgctgaagctattagcgcctacttgggtgagaacggaaaaggtttaatgttgaacgttgtggatcccacttcgatcgacacagtactggcaacgattcgtgcggaatttggcgaagtcgatattttagttaataatgctggtattacgcgtgataacctgctgatgcgtatgaaggatgatgagtggcaggatattattgacacgaatctgacttccgtattccgtctgtcaaaagcggtaatgcgcgctatgatgaaaaagcgatttggccgtatcatcaccatagggtctgttgttgggacaatgggcaatgcggggcaggttaactacgcggcagctaaagctggagttattggttttagcaagtctttggcgcgtgaggtggcttcacgtggcattactgtcaacgttgtggcacctggctttattgagacggacatgactaggacgttgacggatgatcaacgcgcaggcattttagcccaagtaccagctaaccggcttggggatgctaaagaaatcgccagcgctgttgcatttttagcctctgacgaggccagctacatttctggtgaaacgttacatgtcaatggcggcatgtatatgatttaa

SEQ ID NO: 7029 - protein, 244 aa, Yersinia pestis
MSFEGKIALVTGASRGIGRAIAELLVERGACVIGTATSEKGAEAISAYLGENGKGLMLNVVDPTSIDTVLATIRAEFGEVDILVNNAGITRDNLLMRMKDDEWQDIIDTNLTSVFRLSKAVMRAMMKKRFGRIITIGSVVGTMGNAGQVNYAAAKAGVIGFSKSLAREVASRGITVNVVAPGFIETDMTRTLTDDQRAGILAQVPANRLGDAKEIASAVAFLASDEASYISGETLHVNGGMYMI

SEQ ID NO: 7030 - DNA, 735 bp, Salmonella enterica subsp. enterica serovar Typhi
  CDS (1)..(735)
atgagctttgaaggaaagattgcgctggtgactggtgcaagccgtggcataggccgcgcaattgcagagactctcgttgcccgcggcgcgaaagttatcgggactgcgaccagtgaaaatggtgcgaagaacattagcgactatttaggtgctaacgggaaaggtttgatgttgaatgtgaccgatcctgcatctattgaatctgttctggaaaatattcgcgcagaatttggtgaagtggatatcctggttaataatgccggtatcactcgtgataatctgttgatgcgaatgaaagatgatgagtggaacgatattatcgaaaccaatttatcatccgttttccgcctgtcaaaagcggtaatgcgcgctatgatgaaaaagcgttgtggtcgcattatcactattggttctgtggttggtaccatgggaaatgcaggtcaggcaaactacgctgcggcgaaagcgggcctgatcggtttcagtaaatcactggcgcgtgaagttgcgtcccgtggtattactgtcaatgttgtggctccgggttttattgaaacggacatgacgcgtgcgctgtctgacgatcagcgtgcgggtatcctggcgcaggtgcctgcgggtcgcctcggcggcgctcaggaaatcgccagtgcggttgcatttttagcctctgacgaagcgagttacatcactggtgagactctgcacgtcaacggcggaatgtacatggtttaa

SEQ ID NO: 7031 - protein, 244 aa, Salmonella enterica subsp. enterica serovar Typhi
MSFEGKIALVTGASRGIGRAIAETLVARGAKVIGTATSENGAKNISDYLGANGKGLMLNVTDPASIESVLENIRAEFGEVDILVNNAGITRDNLLMRMKDDEWNDIIETNLSSVFRLSKAVMRAMMKKRCGRIITIGSVVGTMGNAGQANYAAAKAGLIGFSKSLAREVASRGITVNVVAPGFIETDMTRALSDDQRAGILAQVPAGRLGGAQEIASAVAFLASDEASYITGETLHVNGGMYMV

SEQ ID NO: 7032 - DNA, 744 bp, Listeria innocua
  CDS (1)..(744)
atgactttacaaggcaaagtagcagtagtaacaggtggatcgcgcggaatcggtcgtgacatcgccatcaaattagctaaagaaggcgcaaatattttcttcaattacaatggtagcccagaagctgcggaagaaacagcaaaactcgttgccgaacatggtgtagaagtagaagcaatgaaagcaaacgtagcgattgctgaagatgtggatgcatttttcaaacaagcaatcgagcgctttggtcgtatcgacattttagtcaataatgcgggaattacgcgtgataatttattaatgcgaatgaaagaagacgagtgggatgacgttattaacatcaacctaaaaggaactttcctttgtacaaaagcagtaagtcgtacaatgatgaaacaacgcgctggtaaaattatcaacatggcttctgttgttggcttaattggtaatgcgggtcaagcaaactatgttgcaagtaaagcaggcgtaattggtttaacaaaaacaactgctcgtgaacttgctccacgtggtattaacgttaatgctgttgctcctggtttcattacaacagaaatgacagacaaattagatgataaaacaaaagaagcaatgctagctcaaattccgcttggtgcttacggaacaaccgaagatattgcgaatgcagttcttttcttagcaagcgatgcatcgaagtatattactggccaaacactatccgttgatggcggaatggtaatgtaa

SEQ ID NO: 7033 - protein, 247 aa, Listeria innocua
MTLQGKVAVVTGGSRGIGRDIAIKLAKEGANIFFNYNGSPEAAEETAKLVAEHGVEVEAMKANVAIAEDVDAFFKQAIERFGRIDILVNNAGITRDNLLMRMKEDEWDDVININLKGTFLCTKAVSRTMMKQRAGKIINMASVVGLIGNAGQANYVASKAGVIGLTKTTARELAPRGINVNAVAPGFITTEMTDKLDDKTKEAMLAQIPLGAYGTTEDIANAVLFLASDASKYITGQTLSVDGGMVM

SEQ ID NO: 7034 - DNA, 738 bp, Brucella melitensis
  CDS (1)..(738)
atgtttgatctgactggccgcaaggctctggtgaccggcgcaaccggcggtcttggtgaggcgattgcccgcgcgctgcacgcgcagggcgcaattgtcggcctgcacggtacgcgcgaggaaaagctgaaggaattggctgcggagctgggtgaacgcattttcgtcttcccggccaatctgtccgaccgtgaagccgtcaaggcgcttggccagaaggccgaagaggaaatgggtggtgtcgatattctggtcaacaatgcgggcatcacccgtgatggccttttcgtgcgcatgagcgacgaggattgggatgcggttctgaccgtcaatctgacgtcggtattcaatctcacgcgcgaactgacccatcccatgatgcgccgccgcaacggccgcatcatcaacatcacctccattgtcggtgtgacgggcaatccgggtcaggcaaattattgcgcctcgaaggctggcctcatcggcttctccaagtcgctggcgcaagagatcgcaagccgcaacgtgaccgtcaattgcatcgcgccgggctttatcgaatcggccatgaccggcaagctgaatgagaagcagaaggacgcgatcatgggcaatattcccatgaagcgcatgggggtcggcgccgatattgctgctgccgtggtctatcttgcaagcgacgaggcggcctatgtgaccggccagaccttgcatgtaaatggcggcatggccatgatttga

SEQ ID NO: 7035 - protein, 245 aa, Brucella melitensis
MFDLTGRKALVTGATGGLGEAIARALHAQGAIVGLHGTREEKLKELAAELGERIFVFPANLSDREAVKALGQKAEEEMGGVDILVNNAGITRDGLFVRMSDEDWDAVLTVNLTSVFNLTRELTHPMMRRRNGRIINITSIVGVTGNPGQANYCASKAGLIGFSKSLAQEIASRNVTVNCIAPGFIESAMTGKLNEKQKDAIMGNIPMKRMGVGADIAAAVVYLASDEAAYVTGQTLHVNGGMAMI

SEQ ID NO: 7036 - DNA, 756 bp, Nostoc sp. PCC 7120
  CDS (1)..(756)
atggcaatcttaagtgaaaatttacgaggacaagttgccgttgttacaggcgcttcacgggggattggacgagcgatcgccttagaattagctaattatggtgctactgtagtggtcaattacgctagttctagcactgctgccgatgaggtagtagcagaaattacaggtgctggtggtgaagctgtagccttaaaagccgatgtttcacaagttgagcaagtagacaatctgatcaatggggcgatcgataagttcaaacgcatcgatattttggtaaataatgcaggtattacccgcgacacattgctattaagaatgaagccagaagactggcaagcagttattgaccttaacttaactggtgtatttttatgcactcgtgccgtcagtaaacttatgctcaagcaacgttctggcagaattatcaatattacctctgtagctggacaaatgggtaatcccggtcaggcgaattacagtgccgccaaagcaggtgtgattggctttacaaaaacagttgctaaagaattagcttctcgtggcattaccgttaacgccgtcgcccctggtttcatcgctacagacatgaccagcaacctcaaatctgagggtattttgcaatacatccctctaggtcgctatggtcaaccagaggaaattgccggtatggtacgtttcctagcagccgaccccgccgccgcctatattaccggacaagtatttaatgtcgatggcggtatggtgatggcttaa

SEQ ID NO: 7037 - protein, 251 aa, Nostoc sp. PCC 7120
MAILSENLRGQVAVVTGASRGIGRAIALELANYGATVVVNYASSSTAADEVVAEITGAGGEAVALKADVSQVEQVDNLINGAIDKFKRIDILVNNAGITRDTLLLRMKPEDWQAVIDLNLTGVFLCTRAVSKLMLKQRSGRIINITSVAGQMGNPGQANYSAAKAGVIGFTKTVAKELASRGITVNAVAPGFIATDMTSNLKSEGILQYIPLGRYGQPEEIAGMVRFLAADPAAAYITGQVFNVDGGMVMA

SEQ ID NO: 7038 - DNA, 726 bp, Agrobacterium tumefaciens
  CDS (1)..(726)
atgagccgggttgcgttgatttccggcgggacgagcggcataggtgccgcaatcgcccgcgcccttcaggcagccggctaccgcgtggccgtcaactacgccttcacgacggacagggccgaagcattccagaaagaaaccggcatcccggcgtttcagtgggatgttcgcgattatgacgcctgcgtcgacggcataacgaaggttgaggaaaccttcggaccggtcgaagtgctcgtcaataatgcgggcatcacccgcgacgcgatgtttcacaagatgtcgccgcagcaatggcgagaggtgatcgacaccaacctcaccggcgtcttcaacatgacacaccccgtctggccgggcatgcgcgagcgcggcttcggccgcatcgtcaacatttcctccatcaacggccagaaaggacaggcgggacaggtcaattattccgcctcgaaagcgggtgatatcggcttcaccaaggcgcttgcccaggaaggcgccagccgtaacatcaccgtcaacgccatctgccccggctatatcggcacggagatggtgcgggcgataccggaaaaggttctggcggaacggatcgtgccgcaaattcccgtcggacgcttgggtgaaccggaagaaatcgcgcgttgcgtcctgtttctggtgtcggacgaggcgggtttcatcaccggctccacgatgacagccaatggcgggcaatatttcgcctga

SEQ ID NO: 7039 - protein, 241 aa, Agrobacterium tumefaciens
MSRVALISGGTSGIGAAIARALQAAGYRVAVNYAFTTDRAEAFQKETGIPAFQWDVRDYDACVDGITKVEETFGPVEVLVNNAGITRDAMFHKMSPQQWREVIDTNLTGVFNMTHPVWPGMRERGFGRIVNISSINGQKGQAGQVNYSASKAGDIGFTKALAQEGASRNITVNAICPGYIGTEMVRAIPEKVLAERIVPQIPVGRLGEPEEIARCVLFLVSDEAGFITGSTMTANGGQYFA

SEQ ID NO: 7040 - DNA, 744 bp, Helicobacter pylori
  CDS (1)..(744)
atgcaattcacagggaaaaatgttcttattactggagcttctaaaggcattggggccgaaatcgccaaaactctcgcttctatggggctgaaagtttggatcaattaccgcagtaatgctgaagtggctgacgctttgaaaaatgggcttgaagaaaaaggctataaagcggctgtcattaaatttgatgcggcttctgaaagcgattttgttgaagcgatacaaaccattgtccaaagcgatgggggtttgtcttacttggtgaataacgccggtgtggtacgcgataaattagcgatcaaaatgaaaacagaagattttcaccatgtcatagaaaataaccttacttcagcttttataggttgcagagaggctttaaaagtgatgagcaagagtcgttttgggagcgtggttaatgtcgcttctatcattggtgaaagaggcaatatggggcagacaaactactcagcgagtaagggggggatgattgcgatgagcaagtcctttgcttatgagggagctttaaggaatattcgtttcaactctgtaacgccaggctttatagaaaccgacatgaacgctaatttgaaagacgaactcaaagcggattacgttaaaaacattcctttaaacaggctagggtctgctaaggaagtggcagaagcggtagcgtttcttttgagtgatcactctagttacatcactggagagactctcaaagtcaatggcgggctttatatgtag

SEQ ID NO: 7041 - protein, 247 aa, Helicobacter pylori
MQFTGKNVLITGASKGIGAEIAKTLASMGLKVWINYRSNAEVADALKNGLEEKGYKAAVIKFDAASESDFVEAIQTIVQSDGGLSYLVNNAGVVRDKLAIKMKTEDFHHVIENNLTSAFIGCREALKVMSKSRFGSVVNVASIIGERGNMGQTNYSASKGGMIAMSKSFAYEGALRNIRFNSVTPGFIETDMNANLKDELKADYVKNIPLNRLGSAKEVAEAVAFLLSDHSSYITGETLKVNGGLYM

SEQ ID NO: 7042 - DNA, 741 bp, Staphylococcus aureus
  CDS (1)..(741)
atgaaaatgactaagagcgctttagtaacaggtgcatcaagaggaattggacgtagtattgcgttacaattagcagaagaaggatataatgtagcagtaaactatgcaggcagcaaagaaaaagctgaagcagtagtcgaagaaatcaaagctaaaggtgttgacagttttgcgattcaagcaaatgttgccgatgctgatgaagttaaagcaatgattaaagaagtagttagccaatttggttctttagatgttttagtaaataatgcaggtattactcgcgataatttattaatgcgtatgaaagaacaagagtgggacgatgttattgacacaaacttaaaaggtgtatttaactgtatccaaaaagcaacaccacaaatgttaagacaacgtagtggtgctatcatcaatttatcaagtgttgttggagcagtaggtaatccaggacaagcaaactatgttgcaacaaaagcaggtgttattggtttaactaaatctgcggcgcgtgaattagcatctcgtggtatcactgtaaatgcagttgcacctggttttattgtttctgatatgacagatgctttaagtgatgagcttaaagaacaaatgttgactcaaattccgttagcacgttttggtcaagacacagatattgctaatacagtagcgttcttagcatcagacaaagcaaaatatattacaggtcaaacaatccatgtaaatggtggaatgtacatgtag

SEQ ID NO: 7043 - protein, 246 aa, Staphylococcus aureus
MKMTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 7044 - DNA, 759 bp, Sulfolobus solfataricus
  CDS (1)..(759)
atgcgtaaattctgtgatttaagcgggagaatagccattgtaactggaggtgctagtggaataggaagggccatagcgttcaaattagcgagtctgggagctaccgtagttttaggcgatgtgaaattagaggaacttaaaaacgtcgtgaatgaaatcacccaacagacaagttctaaagtccttcccctttatgtaaatgtgggggatttcaattcagctaaggagttctatcaaaaagctactgagatcctaggaatagattacgtagatattttagtaaacaatgcggggataaatagggacgccttatttgttaagatgacttttgaacagtgggatgaggtaatgaaagtcgacctatatagtatgttcaatatgactaaacaagttgttgatggaatgataagaagaaactacggaagaataataaatatgtcgtcaatgagttggttggggaatattggacaagctaattattcagcagctaaggctggggttataggcttcacgaaaactctagcaagggaattggctaaatataacatcaccgtaaacgccataactccaggtttcattgatactccaatgacgagggcagttccagagaaggttagacaaaaaattatagagagaataccaatgggtagagttggtagtccagaagaggtagctaatctaatagctttcctatcctctgaagaagcatcctacataacgggagaggtaataggagttaccgggggtttggtgttgtga

SEQ ID NO: 7045 - protein, 252 aa, Sulfolobus solfataricus
MRKFCDLSGRIAIVTGGASGIGRAIAFKLASLGATVVLGDVKLEELKNVVNEITQQTSSKVLPLYVNVGDFNSAKEFYQKATEILGIDYVDILVNNAGINRDALFVKMTFEQWDEVMKVDLYSMFNMTKQVVDGMIRRNYGRIINMSSMSWLGNIGQANYSAAKAGVIGFTKTLARELAKYNITVNAITPGFIDTPMTRAVPEKVRQKIIERIPMGRVGSPEEVANLIAFLSSEEASYITGEVIGVTGGLVL

SEQ ID NO: 7046 - DNA, 738 bp, Rhizobium meliloti
  CDS (1)..(738)
atgttcgaattgaccgggcgcaaggcgctcgtcacgggcgcatcaggagccataggaggggctatcgcccgcgtgctgcatgctcagggcgctatcgtcggactgcacggcacccaaattgaaaaactggagacactggcaactgagcttggagaccgggtcaagctgttcccggctaatctggccaatcgagacgaagtcaaggcgcttggtcagagagcggaagccgatcttgaaggcgtcgacatcctggtcaacaatgctggcatcaccaaggatggattgttcttgcacatggcagaccccgactgggacattgtgctggaggtcaacctcaccgccatgttccgactgacccgcgagatcacccagcagatgatacgccgtcgaaatggccgcatcatcaatgtcacttcggtcgccggcgccatcggcaatccaggccagaccaattactgcgcctccaaggccggtatgatcggcttttccaagtcgctggcgcaggagatcgctacgcgaaacatcactgtcaactgcgtcgccccgggcttcatcgaatcggcaatgaccgataagctcaatcacaaacagaaggagaaaatcatggtggcgatcccgatccaccgcatgggcaccggtaccgaagtcgcgtccgccgttgcgtatctcgcttccgatcacgccgcctatgtcaccggacagaccattcacgtgaacggcggtatggcaatgatttga

SEQ ID NO: 7047 - protein, 245 aa, Rhizobium meliloti
MFELTGRKALVTGASGAIGGAIARVLHAQGAIVGLHGTQIEKLETLATELGDRVKLFPANLANRDEVKALGQRAEADLEGVDILVNNAGITKDGLFLHMADPDWDIVLEVNLTAMFRLTREITQQMIRRRNGRIINVTSVAGAIGNPGQTNYCASKAGMIGFSKSLAQEIATRNITVNCVAPGFIESAMTDKLNHKQKEKIMVAIPIHRMGTGTEVASAVAYLASDHAAYVTGQTIHVNGGMAMI

SEQ ID NO: 7048 - DNA, 726 bp, Rickettsia prowazekii
  CDS (1)..(726)
atgtcagaaattgcaattgtaacaggtggcactagagggatagggaaagctactgctttagaattaaaaaataaggatcttacggtaattgctaattttttcagtaattatgatgctgctaaggaaatggaatcaaaatatggtataagaactaaatgctggaatgttgcagatttggaagaatgtaaaaaagcagtaaatgaaattgaagaggaatttaaaaaatcagtaagtattcttgttaacaatgcaggtattaccaaagataaaatgctacatagaatgagtaatcaagattggaccgacgttattaacgttaatcttcattcttgctttaatatgtctagcagtgtaatgaaacagatgcgcaaccaaaattatggtcgtatagtaaatatcagttcaattaatgcccaagcaggacagattggtcaaactaattactctgctgctaaagctgggatcattggttttactaaggctcttgcacgtgaaactgcttctaaaaatatcacagttaactgcatagcgccaggatatattgcgacagaaatggtaaatacagtacctaaagatatacttactaaaatagttaatagtattcctaaaaaaagactaggacaacctgaagaaatagctagagcagtagcatttttagttgataaaaatgcaggttttataacaggcgagactatttcaatcaatggtggccataatatgatttaa

SEQ ID NO: 7049 - protein, 241 aa, Rickettsia prowazekii
MSEIAIVTGGTRGIGKATALELKNKDLTVIANFFSNYDAAKEMESKYGIRTKCWNVADLEECKKAVNEIEEEFKKSVSILVNNAGITKDKMLHRMSNQDWTDVINVNLHSCFNMSSSVMKQMRNQNYGRIVNISSINAQAGQIGQTNYSAAKAGIIGFTKALARETASKNITVNCIAPGYIATEMVNTVPKDILTKIVNSIPKKRLGQPEEIARAVAFLVDKNAGFITGETISINGGHNMI

SEQ ID NO: 7050 - DNA, 741 bp, Bacillus halodurans
  CDS (1)..(741)
atgctacaaggaaaaacagcgattgttacaggggcatctcgcggaattggccgagcaacagcgatggaactggcacgtcatggagcgaatgtcgtggtcaattatgcagggaataaggagaaagcggaaaaagtcgttgctgagattaaagaactcggagtggaggcaattgcgatccaagccgatgtagctgacagtgagtcggtccaagcaatggtcaaagagacgatcgatactttcggtgcagtcgatattctcgtcaacaacgcagggattacaagagacaacctatttatgcgcatgaaagaagaagattgggatgcggtgatcgatacgaatttaaaaggagttttccactgttcgaaagctgttacacgaccgatgatgaagcagcggtttgggcgaatcattaacgtatcgtctgttgttggtgccattgggaatgctggacaagcgaactatgttgcggccaaagcaggtgtcattggcttaacgaaaacacttgcccgtgagcttgctaaccgtaatattacggtaaatgcggtcgctccagggtttatcgaaacagatatgaccggtgaattgccggaagatgtcaaagcacaaatgctagggcaaatcccccttgctcgtctaggacagcctgaggaagtggcaaaagcggttcgtttcttagcgtccgacgatgcttcttacttaacaggacagacgatccatgtaaatggcggaatggtcatgtaa

SEQ ID NO: 7051 - protein, 246 aa, Bacillus halodurans
MLQGKTAIVTGASRGIGRATAMELARHGANVVVNYAGNKEKAEKVVAEIKELGVEAIAIQADVADSESVQAMVKETIDTFGAVDILVNNAGITRDNLFMRMKEEDWDAVIDTNLKGVFHCSKAVTRPMMKQRFGRIINVSSVVGAIGNAGQANYVAAKAGVIGLTKTLARELANRNITVNAVAPGFIETDMTGELPEDVKAQMLGQIPLARLGQPEEVAKAVRFLASDDASYLTGQTIHVNGGMVM

SEQ ID NO: 7052 - DNA, 729 bp, Haemophilus influenzae
  CDS (1)..(729)
atgcaaggtaaaattgctttagtgacaggatctacccgtggtatcggtcgtgcgattgcagaagaacttagttcaaaaggtgcatttgtaattggtacagcaacctctgaaaagggtgcagaggcgatctcggcttatttaggggataaaggtaaaggtttagttttaaacgtaacggataaagaatctatcgaaaccttacttgaacaaattaaaaatgattttggcgatattgatattctcgtgaataacgcaggtattactcgcgataatttattgatgcgtatgaaagatgaggaatggtttgatattatgcaaactaacttaacttcggtgtatcatctttctaaagccatgttacgttcaatgatgaaaaaacgttttggtcgtatcatcaatattggttcagtggttggttcaacgggtaatccaggacaaactaactattgtgcggcaaaagcgggtgtggttggtttttctaaatctttagcgaaagaagtagctgcacgtggtattactgtaaatgtggttgctcctggttttattgcaacagatatgacagaagtgcttacggatgaacaaaaagcggggatcttatctaatgttccagctggacgtttaggcgaagcaaaagacatagctaaagccgttgctttcttagcttctgatgatgcaggttatatcacgggaacaacgttacacgtgaatggtggcttatacttaagctaa

SEQ ID NO: 7053 - protein, 242 aa, Haemophilus influenzae
MQGKIALVTGSTRGIGRAIAEELSSKGAFVIGTATSEKGAEAISAYLGDKGKGLVLNVTDKESIETLLEQIKNDFGDIDILVNNAGITRDNLLMRMKDEEWFDIMQTNLTSVYHLSKAMLRSMMKKRFGRIINIGSVVGSTGNPGQTNYCAAKAGVVGFSKSLAKEVAARGITVNVVAPGFIATDMTEVLTDEQKAGILSNVPAGRLGEAKDIAKAVAFLASDDAGYITGTTLHVNGGLYLS

SEQ ID NO: 7054 - DNA, 738 bp, Agrobacterium tumefaciens
  CDS (1)..(738)
atgttagatttaacaggccgcaaagccctcgtaaccggcgcgaccggcggcattggtgaggaaatcgcccgccttctgcacaagcagggcgcaaccgtcggcctgcacggcacgcgcgttgaaaagctcgaggctctggcggcggaacttggcgaccgcgtcaagattttcccggctaaccttgccgaccgcgccgaggtcaaggctctcggcgaaaaggccgaagccgagctggaaggcgtcgacattctcgtcaacaatgccggcatcaccaaggacggcctcttcgtgcgcatgagcgacgaggactgggacaacgtcatcgaggtgaacctgacggcgatgttccgcctgacacgtgaactgacgcatccgatgatgcgccgccgtttcggccgtatcatcaacatcacctccatcgtcggcgtcaccggcaaccccggccaggccaattattgcgcctccaaggccggcatgatcggtttttcgaagtcgttggcgcaggaaatcgccacccgcaacgtcacggtcaactgcgtggcaccgggcttcatcgaaagcgcgatgaccggcaagctgaacgacaagcagaaagacgccattatgggcgccattcccatgaagcgcatgggcaccggcgccgaggttgcgtcggccgttctttatctggcttccaatgaggcagcctacatgaccggccagaccctgcacgtcaacggcggcatggcgatgatctga

SEQ ID NO: 7055 - protein, 245 aa, Agrobacterium tumefaciens
MLDLTGRKALVTGATGGIGEEIARLLHKQGATVGLHGTRVEKLEALAAELGDRVKIFPANLADRAEVKALGEKAEAELEGVDILVNNAGITKDGLFVRMSDEDWDNVIEVNLTAMFRLTRELTHPMMRRRFGRIINITSIVGVTGNPGQANYCASKAGMIGFSKSLAQEIATRNVTVNCVAPGFIESAMTGKLNDKQKDAIMGAIPMKRMGTGAEVASAVLYLASNEAAYMTGQTLHVNGGMAMI

SEQ ID NO: 7056 - DNA, 741 bp, Azospirillum brasilense
  CDS (1)..(741)
atgtctcagaagatcgcgctcgtcaccggtgccatgggcggtctcggcaccgccatctgccaggccctggccaaggacggttgcatcgtggcggcgaactgcctgccgaacttcgagccggccgccgcctggctgggccagcaggaagccctcggcttcaagttctacgtggcggaaggcgacgtttccgacttcgaaagctgcaaggcgatggtcgccaagatcgaggccgacctgggtccggtggacatcctggtgaacaacgccggcatcacccgcgacaagttcttcgcgaagatggacaaggcccagtgggatgcggtcatcgccaccaatctgagcagcctgttcaacgtcacccagcaggtgtcgccgaagatggccgagcgcggctggggccgcatcatcaacatctcgtcggtgaacggcgtgaagggccaggccggccagaccaactactcggccgccaaggccggcgtgatcggcttcaccaaggcgctggccgccgagctggcgaccaagggcgtcaccgtcaacgccatcgccccgggctacatcggcaccgacatggtcatggccatccgtgaggacatccgccaggcgatcaccgacagcgtcccgatgaagcgcctgggccgtccggacgagatcggcggcgcggtgtcctacctcgcgtcggagatcgccggctacgtcaccggctcgaccctgaacatcaacggcggcctgaactaccagtaa

SEQ ID NO: 7057 - protein, 246 aa, Azospirillum brasilense
MSQKIALVTGAMGGLGTAICQALAKDGCIVAANCLPNFEPAAAWLGQQEALGFKFYVAEGDVSDFESCKAMVAKIEADLGPVDILVNNAGITRDKFFAKMDKAQWDAVIATNLSSLFNVTQQVSPKMAERGWGRIINISSVNGVKGQAGQTNYSAAKAGVIGFTKALAAELATKGVTVNAIAPGYIGTDMVMAIREDIRQAITDSVPMKRLGRPDEIGGAVSYLASEIAGYVTGSTLNINGGLNYQ

SEQ ID NO: 7058 - DNA, 747 bp, Neisseria meningitidis
  CDS (1)..(747)
atgagcacacaagatttaaacggcaaaatcgctttggtaacaggcgcatcgcgcggtatcggtgcagcaattgccgacacgctggcggcagccggtgccaaagtcatcggtacggcgaccagtgagagcggtgcggcggcgattagcgagcggttggcgcaatggggcggcgaaggccgcgtattaaattccgccgaacctgaaaccatcgaaagcctgattgccgacatcgaaaaagcgttcggcaaactcgatattctggtcaacaacgccggcatcacccgcgacaacctcctgatgcgcatgaaagaagaagagtgggacgacatcatgcaggtcaacctcaaatccgtgttccgcgcttctaaagccgttttgcgcggtatgatgaaacaacgttccggccgcatcatcaacatcacatccgtcgtcggcgtgatgggcaatgccggtcaaaccaactatgccgcggcaaaagcaggcttaatcggtttctccaaatccatggcgcgcgaagtcggcagccggggcattaccgtcaactgcgtcgcccctggctttatcgataccgacatgacacgcgccctgccggaagaaacccgccaaacctttaccgcccaaaccgccttgggcagattcggcgacgcgcaagacatcgccgatgcggttctgttcctcgcttccgaccaagcaaaatacatcaccggccaaacgctgcacgtcaacggcggtatgctgatgccttaa

SEQ ID NO: 7059 - protein, 248 aa, Neisseria meningitidis
MSTQDLNGKIALVTGASRGIGAAIADTLAAAGAKVIGTATSESGAAAISERLAQWGGEGRVLNSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFSKSMAREVGSRGITVNCVAPGFIDTDMTRALPEETRQTFTAQTALGRFGDAQDIADAVLFLASDQAKYITGQTLHVNGGMLMP

SEQ ID NO: 7060 - DNA, 747 bp, Chlamydia muridarum, Chlamydia trachomatis MoPn
  CDS (1)..(747)
atgaatagcttattggtaaacaaagctgcaattgtaactggcggttctaggggaattggttttggcatagcaaaactattcgctgagcatggggctaatgttcaaatctggggaatcaatgaggaggctgggaaatctgctgcccaggatctttctgataaaaccggaagcaaggtgtcgtttgctcttgttgatgtcagtaaaaacgatatggtttctgctcaagttcaaaaatttttagcagaatatggaactattgatgttgttgttaataatgcaggcattactcgcgattctcttttaatgagaatgtctgaagaagagtggtcgtctgtaattgatacgaacttgggatctatatacaacgtttgttctgcagttataaggcctatgattaaggctaggtccggggcgattgttaatattagttctattgttgggttaagaggaagtcctgggcaaacaaattatgctgctgctaaagcaggaattattggatttagtaaagccttatctaaagaagttggaagtaaaaatattcgagttaactgtatagctccaggattcattgatactgatatgactaaggggttaagtgataatttaaaaaatgagtggcttaagggagttcctttaggacgagttggtactccggaagaaattgctatggctgctttgttcttggcttctaatcaatcttcatacattacaggacaggttttgagtgttgacgggggtatggcttaa

SEQ ID NO: 7061 - protein, 248 aa, Chlamydia muridarum, Chlamydia trachomatis MoPn
MNSLLVNKAAIVTGGSRGIGFGIAKLFAEHGANVQIWGINEEAGKSAAQDLSDKTGSKVSFALVDVSKNDMVSAQVQKFLAEYGTIDVVVNNAGITRDSLLMRMSEEEWSSVIDTNLGSIYNVCSAVIRPMIKARSGAIVNISSIVGLRGSPGQTNYAAAKAGIIGFSKALSKEVGSKNIRVNCIAPGFIDTDMTKGLSDNLKNEWLKGVPLGRVGTPEEIAMAALFLASNQSSYITGQVLSVDGGMA

SEQ ID NO: 7062 - DNA, 741 bp, Vibrio cholerae
  CDS (1)..(741)
atgagaaaaatcgctttgatcacaggatcgaaaggcgggattggttctgcaatttcaacccagttggtcagtgaaggttatcgagtcattgccacttactacacgggcaattaccaatgtgcgttagattggtttaatgaaaaacaatttaccgaggatcaagtgcgcctcttagagctagacgtcaccaataccgaagagtgtgctgagcgtttagccaaactgcttgaagaagaaggcaccattgatgtggtggtcaacaacgcaggtatcacgcgtgacagtgtgttcaaaaaaatgccccatcaagcatggaaagaggtcatagatactaacctcaatagcgtattcaatgtcacccagcctttgtttgccgctatgtgtgaaaaagggtttggtcgaatcatcaatatctcctcggttaatggtctcaaaggtcagtttggtcaaactaactattcggcagccaaagctgggatgattggtttttctaaagcattagctgcagaaggcgcacgatacggtgtgacggttaacgtgattgcacctggctatacgctgacgccaatggttgagcaaatgcgcgctgaagttttgcaatccattgtggatcaagtacccatgaaacgcttggctaagccggaagagatagccaatgccgtcagttacttagccagcgatgccgccgcctatatcacaggggaaaccttgtcggtgaacggcggcttatacatgcgctaa

SEQ ID NO: 7063 - protein, 246 aa, Vibrio cholerae
MRKIALITGSKGGIGSAISTQLVSEGYRVIATYYTGNYQCALDWFNEKQFTEDQVRLLELDVTNTEECAERLAKLLEEEGTIDVVVNNAGITRDSVFKKMPHQAWKEVIDTNLNSVFNVTQPLFAAMCEKGFGRIINISSVNGLKGQFGQTNYSAAKAGMIGFSKALAAEGARYGVTVNVIAPGYTLTPMVEQMRAEVLQSIVDQVPMKRLAKPEEIANAVSYLASDAAAYITGETLSVNGGLYMR

SEQ ID NO: 7064 - DNA, 744 bp, Mycobacterium tuberculosis
  CDS (1)..(744)
atgactgccacagccactgaaggggccaaacccccattcgtatcccgttcagtcctggttaccggaggaaaccgggggatcgggctggcgatcgcacagcggctggctgccgacggccacaaggtggccgtcacccaccgtggatccggagcgccaaaggggctgtttggcgtcgaatgtgacgtcaccgacagcgacgccgtcgatcgcgccttcacggcggtagaagagcaccagggtccggtcgaggtgctggtgtccaacgccggcctatccgcggacgcattcctcatgcggatgaccgaggaaaagttcgagaaggtcatcaacgccaacctcaccggggcgttccgggtggctcaacgggcatcgcgcagcatgcagcgcaacaaattcggtcgaatgatattcataggttcggtctccggcagctggggcatcggcaaccaggccaactacgcagcctccaaggccggagtgattggcatggcccgctcgatcgcccgcgagctgtcgaaggcaaacgtgaccgcgaatgtggtggccccgggctacatcgacaccgatatgacccgcgcgctggatgagcggattcagcagggggcgctgcaatttatcccagcgaagcgggtcggcacccccgccgaggtcgccggggtggtcagcttcctggcttccgaggatgcgagctatatctccggtgcggtcatcccggtcgacggcggcatgggtatgggccactga

SEQ ID NO: 7065 - protein, 247 aa, Mycobacterium tuberculosis
MTATATEGAKPPFVSRSVLVTGGNRGIGLAIAQRLAADGHKVAVTHRGSGAPKGLFGVECDVTDSDAVDRAFTAVEEHQGPVEVLVSNAGLSADAFLMRMTEEKFEKVINANLTGAFRVAQRASRSMQRNKFGRMIFIGSVSGSWGIGNQANYAASKAGVIGMARSIARELSKANVTANVVAPGYIDTDMTRALDERIQQGALQFIPAKRVGTPAEVAGVVSFLASEDASYISGAVIPVDGGMGMGH

SEQ ID NO: 7066 - DNA, 744 bp, Xylella fastidiosa
  CDS (1)..(744)
atgaacaaacccttacagggtgaggttgcgttagtgactggtgctagccgtggcatcggtgctgcagtggctgatcttttggctgatcatggggctaccgtgattggtacggcgacgtctgtttctggtgcgcagttgattggtgatcgtttggctctgctggctggtcatggtcgcgccctggatgtgaacgatactgctgcagttggtgcattggttggggagattgccgaacaattcggttcggtctcgattctggttaataatgctggtatcactcgagacaatctgttgatgcggatgaaggatgaggattgggagtcgattgtcgacactaatctgagcagtatttttcgtaccagcagggcggtggttcgcgacatgatgaaggcgcgcaagggccgtatcatcaacattgcttcggttgttggcgtgactggtaatgccggtcaggcaaactatgctgcggccaaagctggtgtgatcggattcacaaagtcactggctaaggaagttggcccacgtgggatcactgtcaacgtggtcgctccggggtttattgataccgacatgactcgtgtgctgtctgagggtgtacgcaatgatatccttaaccgcgtcccgcttggtcatctcggtgatccggtggatatcgcgcacgcggtggcttttctggctgccccagcagcacgctacatcactggtgagacattacatgtcaacggtggtatgtatatgccgtga

SEQ ID NO: 7067 - protein, 247 aa, Xylella fastidiosa
MNKPLQGEVALVTGASRGIGAAVADLLADHGATVIGTATSVSGAQLIGDRLALLAGHGRALDVNDTAAVGALVGEIAEQFGSVSILVNNAGITRDNLLMRMKDEDWESIVDTNLSSIFRTSRAVVRDMMKARKGRIINIASVVGVTGNAGQANYAAAKAGVIGFTKSLAKEVGPRGITVNVVAPGFIDTDMTRVLSEGVRNDILNRVPLGHLGDPVDIAHAVAFLAAPAARYITGETLHVNGGMYMP

SEQ ID NO: 7068 - DNA, 732 bp, Lactococcus lactis subsp. lactis
  CDS (1)..(732)
atggaaattaaaaataaaaatgtctttgtgactggttcaacacgtggaattggtaaagcaattgcgcttcaatttgctaaagcgggttctaatctaattattaatggtcgttcagcaatttcagaagaattattagctgaatttacagcctatggtgttaaagcagttggtatttctggtgatatttcaaaatcagaagatgcaaaacaaatggttgcagaagcgattgaaactcttggttcagtagatattttggtaaacaatgcaggaattactcgtgatggtttatctttgaagatgtcagaagaagattttgagtctgttcttaaaatcaacttgactggggctttcaatatgacacaggctgttttgaaaccgatgaccagagctcgttctggagcaattattaatatctcatcagttgttggacttatgggaaatgctgggcaagcaaattatgccgcttcaaaagcaggacttattggtttgacaaaatcaattgctagagaagttgcggcacgaaatgttcgtgtcaatgctgtggctccaggatttattgaatcagatatgactgaagttctttctgataaagttaaagatgcaatgaaggggcaaattccaatgaaacgttttggaatgcctgaagaaattgcaacagcaactcaattcttggctgaacaagaatatatgactggacaagtacttaccattgatggtggagtttcaatgtaa

SEQ ID NO: 7069 - protein, 243 aa, Lactococcus lactis subsp. lactis
MEIKNKNVFVTGSTRGIGKAIALQFAKAGSNLIINGRSAISEELLAEFTAYGVKAVGISGDISKSEDAKQMVAEAIETLGSVDILVNNAGITRDGLSLKMSEEDFESVLKINLTGAFNMTQAVLKPMTRARSGAIINISSVVGLMGNAGQANYAASKAGLIGLTKSIAREVAARNVRVNAVAPGFIESDMTEVLSDKVKDAMKGQIPMKRFGMPEEIATATQFLAEQEYMTGQVLTIDGGVSM

SEQ ID NO: 7070 - DNA, 723 bp, Caulobacter crescentus
  CDS (1)..(723)
atgacgagagttgcgttcgtgaccggcggcacccgcggcatcggtcgagccatctgcgagcggctgatcgctgacggccacaaggtggcggcggggtattccggcaatgaagccgccgccgaggcctgcgccaaggagctgggcgtgatggtcgtgaagggcaatgtcggcgtgttcgaggactgccaggcagccgtgaagaaggtcgaggccgagctcggcccgatcgacatcctggtcaacaacgccggcatcacccgcgacggcatgctgcacaagatgacctatgagcagtggtccgaagtgatccgggtcaatatggactcggccttcaacatgacccgtccggtgatcgagggcatgcgagaccgcagctggggccgcatcatcaacatcagctccatcaatggccagaagggccagatgggccagaccaactattcggccgccaaggccggcctgatcggcttcaccaaggccctggccctggagaacgccaagaagggcgtcaccgtcaacgtgatctgccccggctatatcgacaccgagatggtggcggccgttcccgagaacgttctggcgcagatcgtcgccggcattccggtcggtcgcctgggccgcggcgaggaaatcgccgacatggtctcgttcctggcgggcgagcgcgcgggcttcgtgaccggcgccaccctgaccctgaacggtggccagtacatggcctaa

SEQ ID NO: 7071 - protein, 240 aa, Caulobacter crescentus
MTRVAFVTGGTRGIGRAICERLIADGHKVAAGYSGNEAAAEACAKELGVMVVKGNVGVFEDCQAAVKKVEAELGPIDILVNNAGITRDGMLHKMTYEQWSEVIRVNMDSAFNMTRPVIEGMRDRSWGRIINISSINGQKGQMGQTNYSAAKAGLIGFTKALALENAKKGVTVNVICPGYIDTEMVAAVPENVLAQIVAGIPVGRLGRGEEIADMVSFLAGERAGFVTGATLTLNGGQYMA

SEQ ID NO: 7072 - DNA, 750 bp, Clostridium acetobutylicum
  CDS (1)..(750)
atggaaaagttattatccggtaaggttgctgtagttacaggtgcaggaagaggacttggaagagcaatagcattgaaattagcagctgaaggagctaaccttgttgtaaattatagaagtagtgaagctgaaactcaaaagcttataaaggaaattgaagagttaggttcaaaggctgtagcagtaaaagcagatataagtaaatacgatgaagcagaaactattataaaaaaggctttggatgaatatggaactgttgatatattagttaacaatgcaggaataacaaaggataaccttttgttaagaatgaaggaagaagattttgatagtgtaattaatgtaaacctaaaaggagcatttaactgtataaagcatacaagtcgtgtgatgcttaagaaaaaaagtggtaaaataataaatatatcatctgttataggattaataggaaatgcaggtcaagtaaattatgctgctgcaaaggcaggaattataggtatgacaaaatcagtagctaaagaacttgcaagtagaggaattacagttaatgctgtagcccctggaatcataaaaagcgatatgacagatgcacttacagataagcaaagagaaagtatagtggcagcagtaccacttaataaagtaggagaggcagaagatgttgctaatcttgttctatttttagcttcagatctttcttcttatataacaggtcaagttataaatgtagatggcggaatggtaatgtaa

SEQ ID NO: 7073 - protein, 249 aa, Clostridium acetobutylicum
MEKLLSGKVAVVTGAGRGLGRAIALKLAAEGANLVVNYRSSEAETQKLIKEIEELGSKAVAVKADISKYDEAETIIKKALDEYGTVDILVNNAGITKDNLLLRMKEEDFDSVINVNLKGAFNCIKHTSRVMLKKKSGKIINISSVIGLIGNAGQVNYAAAKAGIIGMTKSVAKELASRGITVNAVAPGIIKSDMTDALTDKQRESIVAAVPLNKVGEAEDVANLVLFLASDLSSYITGQVINVDGGMVM

SEQ ID NO: 7074 - DNA, 726 bp, Rickettsia conorii
  CDS (1)..(726)
atgtcagaacttacaattgtaacaggtggtactagaggaataggtaaagctaccgctttagaattaaaaaataagggtcttacggtagttgctaattttttcagcaattacgacactgctaaagaaatagaagaaaaatacggtataaaaaccaaacgctggaatattgcgaattttgaagaatgtagaaaagcagtaaaggaaattgaagaggagtttaaaaaaccggtaagtattcttgtaaataatgccggtattaccaaagataaaatgctacatagaacgagttatcaagattggaatgatgtgatgaacattaatctcaattcttgctttaatatgtccagtagcgtaatggagcagatacgaaaccaagattacggtcgtataataaatatcagttcaattaatgctcaagcaaggcagattgggcagactaattactctgctgctaaagctggaattatcagctttactaaggcccttgctcgtgaaactgcttctaaaaatatcaccattaactgtatagctccagggtatattgcaatcaaaatggtaggagcagtacccgaagacgtgcttgttaaaatcgttaatagtatccccaaaaaaagactaggacagccggaagaaatagctagagccgtggcatttttagttgatgaaaatgccggatttatcacaggtgagactatttctatcaacggcggccataatatgatttaa

SEQ ID NO: 7075 - protein, 241 aa, Rickettsia conorii
MSELTIVTGGTRGIGKATALELKNKGLTVVANFFSNYDTAKEIEEKYGIKTKRWNIANFEECRKAVKEIEEEFKKPVSILVNNAGITKDKMLHRTSYQDWNDVMNINLNSCFNMSSSVMEQIRNQDYGRIINISSINAQARQIGQTNYSAAKAGIISFTKALARETASKNITINCIAPGYIAIKMVGAVPEDVLVKIVNSIPKKRLGQPEEIARAVAFLVDENAGFITGETISINGGHNMI

SEQ ID NO: 7076 - DNA, 765 bp, Deinococcus radiodurans
  CDS (1)..(765)
atgacccacaacgaaatttctcccgctcccgcccgcgtcgccctcgttactggttcgagccggggtctgggccgggccatggccctgcgactcgcccaggacggcttcacggtggccgttcactatggccggggagaagccgaggcgcagcaggtcgccgcagacatccgggcggcgggcggcgcggcgcaggtctttggtgccgacctctcgcagcccgccaacgccggaacactcgtcgaggacgtgatcgccgcgctgggccgcctcgacgtgctggtgaacaacgccggcattacccgcgacggcctcgccattcgcatgaaggacgaggactgggacgccgtgctgcaaaccaacctgtcgagcgccttcgccgcctgccgcgccgccctcaagcacatgatgaagaatcgcagcgggcgcatcgtcaacgtttcgagcgtggtcgccctcgccgggaaccccggtcaggccaactacgtggcgagcaaggcgggcctcatcggcctgacccgcgccctcgccaaggaatacggcgggcgcggcatcaccgtcaacgcgattgcgccgggctttatcgagtcggacatgaccgcgaagctgcctgaggacactaaaaagcagtatcaggcgaatattccgctggcccgcttcgggcagcccgaagaagtcgccgcgctggtcgcctttctcgcctcggagggcgccgggtacatcactgggcagaccatcggggtggacggcggtatgaacccgaattga

SEQ ID NO: 7077 - protein, 254 aa, Deinococcus radiodurans
MTHNEISPAPARVALVTGSSRGLGRAMALRLAQDGFTVAVHYGRGEAEAQQVAADIRAAGGAAQVFGADLSQPANAGTLVEDVIAALGRLDVLVNNAGITRDGLAIRMKDEDWDAVLQTNLSSAFAACRAALKHMMKNRSGRIVNVSSVVALAGNPGQANYVASKAGLIGLTRALAKEYGGRGITVNAIAPGFIESDMTAKLPEDTKKQYQANIPLARFGQPEEVAALVAFLASEGAGYITGQTIGVDGGMNPN

SEQ ID NO: 7078 - DNA, 741 bp, Xylella fastidiosa
  CDS (1)..(741)
atgacccttcgcatcgcctacgtcaccagcggcatgggcagtatcggaactgcaatctgccagaagttggcacgcaacggccataccgtggtggctggctgtggccccaactcgcctcgcaaagctaactggctgcgtgagcaacgtgaacttggcttcgacttcatcgcctctgaaggcaatgctgccgattgggattcaacggtatccgcctttgccaaggtaaaagccgaagtcggcgagattgacgttttggtcaataacgccggtaacaaccgcgacatgctgttccggcaaatgggccgtgaagactggaacagtgtcatcagcagcaacctcaattcactgttcaatatcactaaacaagtcattgacgccatgaccgcgcgcaattggggacgtatcgtcaacattggttcggtgagcgcgcacaaaggtcaaataggccaagtgaactacgccactgcaaaggccgcaatgcacggcttcacgcgtgcacttgcacaagaagtcgctacccgcaacgtcaccgtaaataccatttccccagggtatatcgccagcgctgcaatcagcagtttccccccagacgtccttgaccgtctcgccaactcagtaccaatgcggcgcctgggcaaagccgaagaagtcgctgggctatgcgcttggctggtttcagatgaagctgcctacgtcacaggtgccgactacgcagttaacggtggtttacgcatggagtga

SEQ ID NO: 7079 - protein, 246 aa, Xylella fastidiosa
MTLRIAYVTSGMGSIGTAICQKLARNGHTVVAGCGPNSPRKANWLREQRELGFDFIASEGNAADWDSTVSAFAKVKAEVGEIDVLVNNAGNNRDMLFRQMGREDWNSVISSNLNSLFNITKQVIDAMTARNWGRIVNIGSVSAHKGQIGQVNYATAKAAMHGFTRALAQEVATRNVTVNTISPGYIASAAISSFPPDVLDRLANSVPMRRLGKAEEVAGLCAWLVSDEAAYVTGADYAVNGGLRME

SEQ ID NO: 7080 - DNA, 735 bp, Buchnera sp
  CDS (1)..(735)
atgaatatcaatagacaaaccgcatttataacaggggccaatcaaggtataggaaaagcaattgcaaaaaaattaataaaaaaaggaattcaagtaattggcacgtctactactgaagatggagtaaaaagaattaatgactatttggaggggaatggatttggttttgttttaaatttaaaaaacatagattctattacagaaaaaattcaagaaatttataaaaaaaaacactctattgatatactaattaataatgctggaataaaagaagataatttattagttaatatgaaaagcactgaatgggatgatgtaatcaaaactaatttatcatcagtatttcatcttgtaaaatctgttattcgatcaatgatcaaaaaaaggcaaggcagaattattaccattggttcagttatagcttatacaggtaacaaaggacaagtcaattatagtgcttcaaaatcaggactaattggatttcataaatcattagcactagaagtagcatcaaaaggtattactgttaatattgtctcacccggtttgattaaaacaaatttcactgaaaaattaaattcaatacaatatcaaaaatatttatctaatattccaatgaaaagattcggacaaaaagaagaagtagcagatgctgttatttttttagcttcaaaaaaagcatcatatattaccggacatacattacatgtaaatggcggcatgtatatgatataa

SEQ ID NO: 7081 - protein, 244 aa, Buchnera sp
MNINRQTAFITGANQGIGKAIAKKLIKKGIQVIGTSTTEDGVKRINDYLEGNGFGFVLNLKNIDSITEKIQEIYKKKHSIDILINNAGIKEDNLLVNMKSTEWDDVIKTNLSSVFHLVKSVIRSMIKKRQGRIITIGSVIAYTGNKGQVNYSASKSGLIGFHKSLALEVASKGITVNIVSPGLIKTNFTEKLNSIQYQKYLSNIPMKRFGQKEEVADAVIFLASKKASYITGHTLHVNGGMYMI

SEQ ID NO: 7082 - DNA, 732 bp, Streptococcus pneumoniae
  CDS (1)..(732)
atgaaactagaacataaaaatatctttattacaggttcgagtcgtggaattggtcttgccatcgcccacaagtttgctcaagcaggagccaacattgtcttaaacagtcgtggggcaatctcagaagaattgctcgctgagttttcaaactatggtatcaaggtggttcccatttcaggagatgtatcagattttgcagacgctaagcgtatgattgatcaagctattgcagaactgggttcagtagatgttttggtcaacaatgcagggattacccaagatactcttatgctcaagatgacagaagcagattttgaaaaagtgctcaaggtcaatctgactggtgcctttaatatgacacaatcagtcttgaaaccgatgatgaaagccagagaaggtgctatcattaatatgtctagtgttgttggtttgatggggaatattggtcaagctaattatgctgcttctaaggctggcttgattggctttaccaagtctgtggcacgcgaggtcgctagtcggaatatacgagtcaatgtgattgctccaggaatgattgagtctgatatgaccgctatcctgtcagataagattaaggaagctacactagctcagattccgatgaaagaatttgggcaggcagagcaggttgcagatttgacagtatttttagcaggccaagattatctaactggacaagtggttgccattgatggtggcttaagtatgtag

SEQ ID NO: 7083 - protein, 243 aa, Streptococcus pneumoniae
MKLEHKNIFITGSSRGIGLAIAHKFAQAGANIVLNSRGAISEELLAEFSNYGIKVVPISGDVSDFADAKRMIDQAIAELGSVDVLVNNAGITQDTLMLKMTEADFEKVLKVNLTGAFNMTQSVLKPMMKAREGAIINMSSVVGLMGNIGQANYAASKAGLIGFTKSVAREVASRNIRVNVIAPGMIESDMTAILSDKIKEATLAQIPMKEFGQAEQVADLTVFLAGQDYLTGQVVAIDGGLSM

SEQ ID NO: 7084 - DNA, 747 bp, Rickettsia conorii
  CDS (1)..(747)
atgatcaaacggaggaagaaaatgattgatttaacaggtaaaacttccttaattacgggagcttcaggaggcataggcggagctatagcgaggttactgcacaaactcggaagccatgtaattattagcggtagtaatgaggaaaaattacaatcccttggaaaggttgtaaaagataattatacgatagaagtatgtaatcttgccgataaggaagaatgtagaaatttaatatctaaagcatcaaagttagatattttagtatgtaatgccggtattactagcgatacgctagcaattagaatgaaagatgaagattttgacaaagttattgatattaatttaaaagcaaattttattttaaatcgtgaagcaataaaaaaaatgatacaaaacaggtatggacgtattattaacatatcttcaatagtaggaatttcaggtaaccccgggcaagctaattattgtgcttctaaagcaggtttaataggtatgaccaaatcgctctcttacgaagttgcaaccagaggcattacggttaacacagtagctccaggatttattaaatcagatatgaccgataaactaaatgaaaaacaaagagaagctatagtacaaaaaattccgttaggcacttatggtatgccggaagacgtggcacacgcagttgcatttttagcaagcgatcaggcatcatatattaccggtcaaactatacatgtaaacggtggtatgttaatggtataa

SEQ ID NO: 7085 - protein, 248 aa, Rickettsia conorii
MIKRRKKMIDLTGKTSLITGASGGIGGAIARLLHKLGSHVIISGSNEEKLQSLGKVVKDNYTIEVCNLADKEECRNLISKASKLDILVCNAGITSDTLAIRMKDEDFDKVIDINLKANFILNREAIKKMIQNRYGRIINISSIVGISGNPGQANYCASKAGLIGMTKSLSYEVATRGITVNTVAPGFIKSDMTDKLNEKQREAIVQKIPLGTYGMPEDVAHAVAFLASDQASYITGQTIHVNGGMLMV

SEQ ID NO: 7086 - DNA, 747 bp, Aquifex aeolicus
  CDS (1)..(747)
atggaaataaaactccagggcaaggtttccctcgtaacgggttccacaagaggaataggaagggcgatagcggaaaaactcgcatccgcggggagcaccgtcataataacgggtacttctggagaaagggcaaaggctgttgcggaggaaatcgcaaacaaatacggagtgaaggctcacggtgttgagatgaaccttttatcagaagaaagcattaacaaggcctttgaagaaatttacaaccttgtagacggtatagatatactcgtcaacaacgcgggaataacgagggacaagctctttttaaggatgagtcttctggactgggaagaagttctgaaggtaaacttaacgggaacttttttagtcacacagaactcgctgagaaagatgataaagcagagatggggaaggatagttaatatttcttccgttgtaggttttacgggtaacgttggacaggtaaattactccaccacaaaagctgggctgataggttttaccaaatcccttgcaaaggaactcgctccgaggaacgttcttgtgaacgcggtagctccgggatttatagaaacggacatgactgcggttttatccgaggaaattaagcagaagtataaggaacaaatccccctcgggcggttcggaagtcccgaggaggttgcaaacgtggttttattcctttgttctgagcttgcaagttatataacgggtgaagtaattcacgtaaacggaggaatgttttaa

SEQ ID NO: 7087 - protein, 248 aa, Aquifex aeolicus
MEIKLQGKVSLVTGSTRGIGRAIAEKLASAGSTVIITGTSGERAKAVAEEIANKYGVKAHGVEMNLLSEESINKAFEEIYNLVDGIDILVNNAGITRDKLFLRMSLLDWEEVLKVNLTGTFLVTQNSLRKMIKQRWGRIVNISSVVGFTGNVGQVNYSTTKAGLIGFTKSLAKELAPRNVLVNAVAPGFIETDMTAVLSEEIKQKYKEQIPLGRFGSPEEVANVVLFLCSELASYITGEVIHVNGGMF

SEQ ID NO: 7088 - DNA, 741 bp, Thermotoga maritima
  CDS (1)..(741)
atgaggcttgaagggaaagtgtgtctgatcacaggggctgcaagcgggatagggaaagccaccacgcttcttttcgcacaggaaggagctacggtgatcgctggcgatatctcgaaagaaaatctcgactctcttgtgaaagaggcagaaggacttccggggaaggttgatccctacgttttgaacgtgaccgacagggatcagataaaggaagttgtggaaaaagtcgttcaaaagtacggtcgaatcgatgttctggtgaacaacgcgggaataacaagggatgcgcttcttgtgaggatgaaagaagaagactgggatgcggtaataaacgtgaatctgaagggtgttttcaacgtgactcagatggtggtgccctacatgatcaaacagaggaacggttcgatcgtgaacgtctcctctgtcgttggaatatacgggaatcctggtcagacgaattacgcggcgtcgaaggcgggagtcataggaatgaccaagacgtgggcgaaggaactcgctggaagaaacatcagggtgaacgctgtggcacccggattcatagaaacccccatgaccgaaaaacttccagaaaaagcccgtgaaacggccctttccagaataccgctgggaaggtttgggaagccagaagaggtggcgcaggttatactcttcctcgcatcggacgagtcgagttacgtcaccggacaggtgataggaatagatgggggcctcgtgatctga

SEQ ID NO: 7089 - protein, 246 aa, Thermotoga maritima
MRLEGKVCLITGAASGIGKATTLLFAQEGATVIAGDISKENLDSLVKEAEGLPGKVDPYVLNVTDRDQIKEVVEKVVQKYGRIDVLVNNAGITRDALLVRMKEEDWDAVINVNLKGVFNVTQMVVPYMIKQRNGSIVNVSSVVGIYGNPGQTNYAASKAGVIGMTKTWAKELAGRNIRVNAVAPGFIETPMTEKLPEKARETALSRIPLGRFGKPEEVAQVILFLASDESSYVTGQVIGIDGGLVI

SEQ ID NO: 7090 - DNA, 741 bp, Bacillus halodurans
  CDS (1)..(741)
atgcgacttaacggaaaggtagcaatgattacaggagctggccgagggataggggcagcaacggctaaaaaatttgctagagaaggggcaaaagtgatcgtttgtgatgtgcgggaagaagaggtggcaaagacggtggccgaaattcaagacggaggtggtgaggcgttaggatcggtcgttgatgttacgcaacgcaaggatgtgaaaaacgttataaatcaagtgattgagcgatttgagacgctagatgtggtcgtgaacaatgcgggaatcacagccgatgcccagttaacgaacatgactgatgctcagtgggacgatgtgatcgatgttaacttaaagggggtgtttattgttacacaagaggtgacgaccattatgaaagagcagaaacgaggggtcattttaaacgcctcatccgttgtaggctcttacggaaactttggccagacgaattatgccgcttccaaatggggagtgaatgggatgacgaaaacgtgggcgaaagagctcggccgttataacattcgtgtcaatgctgtggcaccaggattcattctcacaccgatgacagaaaagatgccagaaaaagtattaaaggtgatggaagaaaaagcggtactcaaccgactaggcacagtagaggaagtggcgaacggctatgcctttcttgcatccgatgaagcgtcgtttattacaggaacgattttggccatcgatggcggtgtcgttatatag

SEQ ID NO: 7091 - protein, 246 aa, Bacillus halodurans
MRLNGKVAMITGAGRGIGAATAKKFAREGAKVIVCDVREEEVAKTVAEIQDGGGEALGSVVDVTQRKDVKNVINQVIERFETLDVVVNNAGITADAQLTNMTDAQWDDVIDVNLKGVFIVTQEVTTIMKEQKRGVILNASSVVGSYGNFGQTNYAASKWGVNGMTKTWAKELGRYNIRVNAVAPGFILTPMTEKMPEKVLKVMEEKAVLNRLGTVEEVANGYAFLASDEASFITGTILAIDGGVVI

SEQ ID NO: 7092 - DNA, 747 bp, Chlamydophila pneumoniae, Chlamydia pneumoniae
  CDS (1)..(747)
atggatataacattagtaggcaaaaaagttatagtaactggaggatctcgaggaattggactcgggatagttaagctttttcttgagaacggagcagatgtagaaatttggggattgaatgaggagcgaggtcaggctgttatagaaagtttaacaggcttgggtggcgaagtttcttttgctcgtgtggatgtgagtcataatggtggagtgaaagattgcgtgcagaaatttttagataagcacaacaaaatagatattttggtaaataatgcaggcattaccagggataatttgttgatgcgtatgtctgaggacgactggcaatcggtgattagcaccaacttgacttccttgtattatacatgttcctcagtgattcgccatatgattaaggcgcgttcaggatctattataaatgtggcttctattgttgctaagatcggtagtgcgggccagaccaactatgctgctgctaaagctgggattattgctttcacaaaatctttagctaaggaagtagctgcaagaaatattcgtgtcaactgccttgctccaggctttattgaaacagacatgacaagcgtgttgaatgacaatttaaaagctgagtggcttaagtcgatccctttaggtagggctggcactccagaagatgttgctcgtgtggcgttgtttttagcctcgcagttatcgagctatatgaccgcgcagacactggttgttgatgggggattgacttactaa

SEQ ID NO: 7093 - protein, 248 aa, Chlamydophila pneumoniae, Chlamydia pneumoniae
MDITLVGKKVIVTGGSRGIGLGIVKLFLENGADVEIWGLNEERGQAVIESLTGLGGEVSFARVDVSHNGGVKDCVQKFLDKHNKIDILVNNAGITRDNLLMRMSEDDWQSVISTNLTSLYYTCSSVIRHMIKARSGSIINVASIVAKIGSAGQTNYAAAKAGIIAFTKSLAKEVAARNIRVNCLAPGFIETDMTSVLNDNLKAEWLKSIPLGRAGTPEDVARVALFLASQLSSYMTAQTLVVDGGLTY

SEQ ID NO: 7094 - DNA, 762 bp, Mycobacterium leprae
  CDS (1)..(762)
atgactgacgccgctgccaaggtctcagcagcccctgggaggggtaaacccgcattcgtgtctcgttcaatactggtcactggcggaaaccgggggatcgggttggcggtggcgcgccgcctggtcgctgatgggcatcgggtggcggtgacccaccgggcgtccgtcgtccctgactggtttttcggcgtcgagtgcgacgtcaccgacaacgatgccatcggtgctgccttcaaagcagtcgaagagcaccaggggccggtggaggtgttggtggccaacgctggtatcacgtccgacatgctgatcatgcggatgagtgaggagcaattccagaaagtcatcgacgtcaacctgaccggtgtttttcgggtcgccaagctggcttcacgcaacatgatcaagcagcggttcggtcgctacatttttatgggatcggtcgtcgggctcagcggtgtacccggacaagcgaattacgccgcatccaagtcgggcctcatcggaatggcccggtcgttggcccgcgaactggggtcgcggtcgatcaccgccaacgtagtggcgcccggcttcatcgacaccgagatgacccgtgccatggactcgaaataccaggaagccgcgctgcaagcaattccgttgggccgcatcggcgcggtcgaggagatcgccggtgctgtcagtttcctggcatccgaggatgccggatacatctcgggcgcggtgatcccggtcgatggcggcctgggtatgggccactga

SEQ ID NO: 7095 - protein, 253 aa, Mycobacterium leprae
MTDAAAKVSAAPGRGKPAFVSRSILVTGGNRGIGLAVARRLVADGHRVAVTHRASVVPDWFFGVECDVTDNDAIGAAFKAVEEHQGPVEVLVANAGITSDMLIMRMSEEQFQKVIDVNLTGVFRVAKLASRNMIKQRFGRYIFMGSVVGLSGVPGQANYAASKSGLIGMARSLARELGSRSITANVVAPGFIDTEMTRAMDSKYQEAALQAIPLGRIGAVEEIAGAVSFLASEDAGYISGAVIPVDGGLGMGH

SEQ ID NO: 7096 - DNA, 741 bp, Alcaligenes eutrophus
  CDS (1)..(741)
atgactcagcgcattgcgtatgtgaccggcggcatgggtggtatcggaaccgccatttgccagcggctggccaaggatggctttcgtgtggtggccggttgcggccccaactcgccgcgccgcgaaaagtggctggagcagcagaaggccctgggcttcgatttcattgcctcggaaggcaatgtggctgactgggactcgaccaagaccgcattcgacaaggtcaagtccgaggtcggcgaggttgatgtgctgatcaacaacgccggtatcacccgcgacgtggtgttccgcaagatgacccgcgccgactgggatgcggtgatcgacaccaacctgacctcgctgttcaacgtcaccaagcaggtgatcgacggcatggccgaccgtggctggggccgcatcgtcaacatctcgtcggtgaacgggcagaagggccagttcggccagaccaactactccaccgccaaggccggcctgcatggcttcaccatggcactggcgcaggaagtggcgaccaagggcgtgaccgtcaacacggtctctccgggctatatcgccaccgacatggtcaaggcgatccgccaggacgtgctcgacaagatcgtcgcgacgatcccggtcaagcgcctgggcctgccggaagagatcgcctcgatctgcgcctggttgtcgtcggaggagtccggtttctcgaccggcgccgacttctcgctcaacggcggcctgcatatgggctga

SEQ ID NO: 7097 - protein, 246 aa, Alcaligenes eutrophus
MTQRIAYVTGGMGGIGTAICQRLAKDGFRVVAGCGPNSPRREKWLEQQKALGFDFIASEGNVADWDSTKTAFDKVKSEVGEVDVLINNAGITRDVVFRKMTRADWDAVIDTNLTSLFNVTKQVIDGMADRGWGRIVNISSVNGQKGQFGQTNYSTAKAGLHGFTMALAQEVATKGVTVNTVSPGYIATDMVKAIRQDVLDKIVATIPVKRLGLPEEIASICAWLSSEESGFSTGADFSLNGGLHMG

SEQ ID NO: 7098 - DNA, 1276 bp, Cuphea lanceolata
  CDS (35)..(997)
ggcatcccgatctctttccctcctccgcctcgccatggccaccgccaccgccgccggttgttccggcgctgtcgctctcaagtcgctcggcggccgcaggctgtgtattcctcagcagctctctcctgttctcgccggattcggatcgcacgccgccaaatccttccccatcctttcgacgaggtcgattgctacttccggtataagagcgcaggttgccactgctgagaaagtgagtgccggagcaggtcagtcggtggaatccccagtggttattgtcacgggagcatcccggggaattgggaaggcaattgcattgtcattgggaaaagcagggtgcaaggttttagtcaattatgcaagatcgtcgaaggaggccgaggaagtctctaaagagatagaagcatttggaggtcaggctcttacatttgggggagatgtgtccaaggaagaagatgtggaagcaatgattaagactgcggttgatgcgtggggaactgttgacatattggttaacaacgcaggaattactcgggatggattgttaatgaggatgaagaaatctcagtggcaggaagtgattgatttgaatctcaccggcgttttcctatgcacccaggcggcagctaaaatcatgatgaagaagaaaaagggaagaatcatcaacattgcgtcagtcgttggtttagttggtaacgctgggcaggccaactacagtgctgcgaaggctggggtcattggcttcacaaagactgtcgccagagaatatgccagtagaaatatcaatgttaacgctgttgcccccggattcatttcatctgacatgacttctaaacttggggatgatatcaacaagaaaatcctggagacaatcccattaggaaggtatggtcagcctgaagaagtagcgggtctcgtggagtttctggccatcaatcctgcatcaagttacgtcaccggacaggttttcacaattgatggaggcatgaccatgtaagaacccctcatctcctgcatctcggtatcaagcttcatattgagaaaagagttcaggaattgcaagttgggcctcctttttcccctattgaactgtagtttgtagctttggagtctcagaataataagcaaagaaggcaggcggtagtatgtttattgctacaatattgcttaagaaattgtcatgtgagcagacgtttgtgttttattggttggccaactagaaaaagaaataaatataaaacaggtttttttttaaaaaaaaaaaaaaaaaaaaaaa

SEQ ID NO: 7099 - protein, 320 aa, Cuphea lanceolata
MATATAAGCSGAVALKSLGGRRLCIPQQLSPVLAGFGSHAAKSFPILSTRSIATSGIRAQVATAEKVSAGAGQSVESPVVIVTGASRGIGKAIALSLGKAGCKVLVNYARSSKEAEEVSKEIEAFGGQALTFGGDVSKEEDVEAMIKTAVDAWGTVDILVNNAGITRDGLLMRMKKSQWQEVIDLNLTGVFLCTQAAAKIMMKKKKGRIINIASVVGLVGNAGQANYSAAKAGVIGFTKTVAREYASRNINVNAVAPGFISSDMTSKLGDDINKKILETIPLGRYGQPEEVAGLVEFLAINPASSYVTGQVFTIDGGMTM

SEQ ID NO: 7100 - DNA, 741 bp, Chromatium vinosum
  CDS (1)..(741)
atggctcgtatcgcactcgtcaccggcggcatcggcggcatcggcacttcgatctgcacacgcctggcaaaggatggctgcaccgtcgtggcgaactgccatccgtccgaggcggccgccgccgaagagtggaagcaggcccgtgccgccgaggggttcgacatcgccgtcttcaccgctgacgtgtcctcgttcgacgacagcgcgcgcatggttcgcgagatcacagagcaggtcggtcccatcgacatcctggtcaactgtgccggcatcacccgcgacaagaccttcaagaagatggagcaggcgcactgggaggccgtgatcaacgtcaacctcaacagcgtcttcaacgtcacccgtcaggtgtgggacgggatgctggagcgcggcttcgggcgtatcatcaacatctcgtcggtcaacggtcagcgcggccagttcggtcaggccaactattccgccgccaaggccggtatgcacggcttcaccatggctctggctcaggagggtgcgtccaagggcgtgaccgtcaacaccatctcgcccggctatgtcgagacggccatgaccctggcgatgaacgacgatgtgcgcaacagcatcatcagcggtattccgatgcgtcgcatggctcagcctaatgagatcgccgccgccatcgctttcctggccggcgacgagagcggttatatgacgggcgccaatctgccggtcaacggcggtctgttcatgcattga

SEQ ID NO: 7101 - protein, 246 aa, Chromatium vinosum
MARIALVTGGIGGIGTSICTRLAKDGCTVVANCHPSEAAAAEEWKQARAAEGFDIAVFTADVSSFDDSARMVREITEQVGPIDILVNCAGITRDKTFKKMEQAHWEAVINVNLNSVFNVTRQVWDGMLERGFGRIINISSVNGQRGQFGQANYSAAKAGMHGFTMALAQEGASKGVTVNTISPGYVETAMTLAMNDDVRNSIISGIPMRRMAQPNEIAAAIAFLAGDESGYMTGANLPVNGGLFMH

SEQ ID NO: 7102 - DNA, 723 bp, Synechocystis sp
  CDS (1)..(723)
atgttaagtcttggtttggaagataaagtaatcgtggtcaccggcggcaatcggggcatcggcgcggcgatcgtgaaattactccaggaaatgggggccaaagtagcttttaccgatttagctacggacgggggtaatactgaagccctgggggtggtggccaacgtcaccgatttggaatccatgacggcggcggcagcggaaatcaccgataagctgggccccgtttacggtgtggtggccaatgccggtatcaccaaagacaactttttcccaaaattaacccccgccgattgggatgcagtgttgaacgttaacttgaaaggggtagcctacagcattaagcctttcatcgaaggcatgtatgaacggaaagccggctccattgtggccattagttccatctccggggagcggggtaacgtcggtcaaactaactattccgccactaaagctggggtaattggcatgatgaaatccctggctcgggaaggggcccggtatggagtgcgggccaatgcagtagcccctggtttcattgacaccgaaatgactttggcgatccgggaagatattcgggaaaaaattaccaaggaaatccccttccgccgttttggtaaaccggaggaaattgcctgggcggtggcctttttactttcccccgtagccagtagctatgtcaccggcgaagtattacgggtaaatggggcccaccacacctaa

SEQ ID NO: 7103 - protein, 240 aa, Synechocystis sp
MLSLGLEDKVIVVTGGNRGIGAAIVKLLQEMGAKVAFTDLATDGGNTEALGVVANVTDLESMTAAAAEITDKLGPVYGVVANAGITKDNFFPKLTPADWDAVLNVNLKGVAYSIKPFIEGMYERKAGSIVAISSISGERGNVGQTNYSATKAGVIGMMKSLAREGARYGVRANAVAPGFIDTEMTLAIREDIREKITKEIPFRRFGKPEEIAWAVAFLLSPVASSYVTGEVLRVNGAHHT

SEQ ID NO: 7104 - DNA, 744 bp, Synechocystis sp
  CDS (1)..(744)
atgacggcattaacggcacaggtggcattggtaacgggggcatcccggggtattggtaaagcgacggctttggccctggccgccacgggcatgaaagtggtagtgaactatgctcaatccagtacggccgccgatgctgtggtagcggaaattattgccaacgggggagaggcgatcgccgtgcaggccaatgtggctaatgctgacgaagtggatcaactgattaaaaccacgctggataaatttagtcgcatcgatgtgttagtgaacaatgctggcattaccagggatacgctgttgttgagaatgaaactggaagattggcaagcggtcattgacttgaatttaaccggggtgtttctttgcaccaaagcggtgtctaagttaatgctcaagcaaaaaagtgggcgtatcattaacatcacttctgtagcgggcatgatggggaatccggggcaagctaactacagcgccgctaaggctggggtaattggttttactaaaaccgttgccaaagagttggccagtcggggggtaactgtcaatgccgtagctcctggtttcattgccacggatatgacggaaaatctcaatgcagagccaattttgcaatttattcccctggctcgctatggtcaaccggaggaagtggcgggcaccatccgttttttagccacagatccagcagcggcctatatcacgggacaaacatttaatgtggatggcggcatggtaatgttctaa

SEQ ID NO: 7105 - protein, 247 aa, Synechocystis sp
MTALTAQVALVTGASRGIGKATALALAATGMKVVVNYAQSSTAADAVVAEIIANGGEAIAVQANVANADEVDQLIKTTLDKFSRIDVLVNNAGITRDTLLLRMKLEDWQAVIDLNLTGVFLCTKAVSKLMLKQKSGRIINITSVAGMMGNPGQANYSAAKAGVIGFTKTVAKELASRGVTVNAVAPGFIATDMTENLNAEPILQFIPLARYGQPEEVAGTIRFLATDPAAAYITGQTFNVDGGMVMF

SEQ ID NO: 7106 - DNA, 744 bp, Pseudomonas aeruginosa
  CDS (1)..(744)
atgagtctgcaaggtaaggtcgcattggtaaccggcgccagccgtggcatcggccaggcgattgcgctggaactggggcgcctgggtgccgtggtcatcggcaccgcgaccagcgcgtccggcgccgagaagatcgccgaaaccctcaaggccaatggcgtcgagggtgcgggcctggtcctggacgtttccagcgacgaatccgtagccgcgaccctggagcacatccagcagcatctcggccaaccgctgatcgtggtcaataacgccggcatcacccgcgataatctgctggtgcgcatgaaagacgacgagtggttcgatgtggtcaacaccaacctgaacagtctctaccgtctgtcgaaagccgttctgcgcggtatgaccaaggcccgctgggggcgcatcatcaacatcggttccgtggtcggcgccatgggcaatgccgggcaaaccaactatgccgcggcgaaggccggcctggagggcttcacccgtgcgctggcccgggaagtcggttcgcgtgccattaccgtgaatgcggtggcgccgggcttcatcgacaccgacatgacccgcgagctgccggaagcccagcgcgaagcgctgctgggccagattccgctgggtcgcctggggcaggcggaagagatcgccaaggtggtcggcttcctcgcttcggacggcgcagcctatgtgaccggggccaccgtgccggtcaatggtgggatgtacatgagctga

SEQ ID NO: 7107 - protein, 247 aa, Pseudomonas aeruginosa
MSLQGKVALVTGASRGIGQAIALELGRLGAVVIGTATSASGAEKIAETLKANGVEGAGLVLDVSSDESVAATLEHIQQHLGQPLIVVNNAGITRDNLLVRMKDDEWFDVVNTNLNSLYRLSKAVLRGMTKARWGRIINIGSVVGAMGNAGQTNYAAAKAGLEGFTRALAREVGSRAITVNAVAPGFIDTDMTRELPEAQREALLGQIPLGRLGQAEEIAKVVGFLASDGAAYVTGATVPVNGGMYMS

SEQ ID NO: 7108 - DNA, 735 bp, Vibrio harveyi
  CDS (1)..(735)
atgaatctagaaggtaagatcgctctagtgacaggcgcaagccgtggcattggtcgtgcgattgctgaacttcttgttgaacgcggtgcaacggtaatcggtactgcgacttctgaaggcggcgcagcggcgatcagtgagtacctaggtgaaaacggtaaaggtctagcacttaacgtaactgacgttgagtctatcgaagcaacactaaaaaccatcaatgatgagtgtggtgcaatcgatattctagtaaacaacgctggtatcacgcgcgataacttgctaatgcgtatgaaagatgacgagtggaacgacatcatcaatacaaacctaacgccaatctaccgcatgtctaaagcggttctacgtggcatgatgaaaaaacgcgctggtcgcatcatcaacgtaggttctgttgttggtactatgggtaacgctggtcaaacaaactatgcagcagcaaaagcgggtgtgattggtttcactaaatcaatggctcgtgaagtggcttctcgtggtgtaacagtgaacacggttgctccaggtttcatcgaaactgacatgactaaggcgctaaatgacgaccaacgtgcagcaacgttgtcgaacgtgccagcaggtcgtctaggtgaccctcgtgaaattgcatcagcagttgtattccttgcttcacctgaagcggcttacattactggtgaaactttgcatgtaaatggtggcatgtacatggtttaa

SEQ ID NO: 7109 - protein, 244 aa, Vibrio harveyi
MNLEGKIALVTGASRGIGRAIAELLVERGATVIGTATSEGGAAAISEYLGENGKGLALNVTDVESIEATLKTINDECGAIDILVNNAGITRDNLLMRMKDDEWNDIINTNLTPIYRMSKAVLRGMMKKRAGRIINVGSVVGTMGNAGQTNYAAAKAGVIGFTKSMAREVASRGVTVNTVAPGFIETDMTKALNDDQRAATLSNVPAGRLGDPREIASAVVFLASPEAAYITGETLHVNGGMYMV

SEQ ID NO: 7110 - DNA, 747 bp, Caenorhabditis elegans
atgagtgctttgctgggaggacgaattgctgtggttaccggtggtgcatccggcatcggcaaggccatctcgcagacgttggccaagcatggagctcgtgtcgtagttgccgatttggattccggcaacgctgcagccactgcaaaggctcttccagctagccagagccattcctcgtttgcctgtgacgtgtcaaatgcagacagtgtgaaggggctcagtgagcatgtaaaatcgctgggaacaccgtcgattttggtaaattgtgcagggatcacaaaggattctacacttctaaaaatgaagcaggagcaatgggacagtgtcattaaggtcaaccttaccggagtcttccatgtatcccaagcatttgtcaaagcatcagttgacaacaacaaccacccattatcaattatcaatgtttcatcaattgtcggcaaaatgggaaatttcggccaaaccaactacgcagccaccaaggccggagtcatcgggttcacaaaatctgcagcgaaagagttggcgaaaaagaacgtacgtgtgaacgcagtgctcccaggcttcatcaagaccccaatgacagaggcaatgccaccgactgtgttggccgaaatctgtaagggaattccaatgggccggatgggtgaagccgaggaaatcgccaactccgtcttgtaccttgcctctgatctctcctcatatgtgactggtgccactttggaagttaccggtggatttagtatgtag

SEQ ID NO: 7111 - protein, 255 aa, Caenorhabditis elegans
MNVKVTHNVKRAKTKKSQFSGGASGIGKAISQTLAKHGARVVVADLDSGNAAATAKALPASQSHSSFACDVSNADSVKGLSEHVKSLGTPSILVNCAGITKDSTLLKMKQEQWDSVIKVNLTGVFHVSQAFVKASVDNNNHPLSIINVSSIVGKMGNFGQTNYAATKAGVIGFTKSAAKELAKKNVRVNAVLPGFIKTPMTEAMPPTVLAEICKGIPMGRMGEAEEIANSVLYLASDLSSYVTGATLEVTGGFSM

SEQ ID NO: 7112 - DNA, 891 bp, Caenorhabditis elegans
  CDS (1)..(891)
atgaaaatgcgcgaaatcgaggagaacgctttcgaattcaaaagtggcgctctctgcgtacacgacggtgtttgcacacattgcataccgtaccacccgggaatgtctacgtctcttcgtctcacacagtctctccattttttaggtaaatctacaatgctttcatcgaaattggcaattgtcactggcggtggatcaggaatcggacaagcaatttgcaagaaattcgcagcttctggagcccgtctcatcgttgcagacctcaaaaaatcggcagcagaagccacagcaggcaatcttcctggaaatgggcattcggcctttgagattgatgtcagcgatccagaacacgtggctcgtctacaagaattcataaaatcttccggagaatcgccatctgtgctcgtgaattgtgcaggcatcaccaaggacgctaccctgttgaaaatgagccagaatcagtggcaggatgtgatgaatgtcaatttgaatagtgtttttctgatgtctcagatgattgctcgtgaatctgtggccgccggatctccgctctccattgtaaacgtgtcgtcgatcgtcggaaaaatcggaaatttcggccaaactaactacgctgccactaaatctggagtgattggttttacgaaatcggcagccagggagcttgccacaaagaacatccgcgtgaatgctgtgctccccggcttcatcagaacaccaatgacagaggctatgcctccgaaggtccttgatgcaatggtctcgatggttccacaacggagactcggtgagactgaggagatcgcgaacgccgtgttgttcctggcatcggatatgtcttcatatgtcactggaaccacgttggaagttactggaggacttggaatgtag

SEQ ID NO: 7113 - protein, 296 aa, Caenorhabditis elegans
MKMREIEENAFEFKSGALCVHDGVCTHCIPYHPGMSTSLRLTQSLHFLGKSTMLSSKLAIVTGGGSGIGQAICKKFAASGARLIVADLKKSAAEATAGNLPGNGHSAFEIDVSDPEHVARLQEFIKSSGESPSVLVNCAGITKDATLLKMSQNQWQDVMNVNLNSVFLMSQMIARESVAAGSPLSIVNVSSIVGKIGNFGQTNYAATKSGVIGFTKSAARELATKNIRVNAVLPGFIRTPMTEAMPPKVLDAMVSMVPQRRLGETEEIANAVLFLASDMSSYVTGTTLEVTGGLGM

SEQ ID NO: 7114 - DNA, 705 bp, Streptomyces coelicolor
  CDS (1)..(705)
atgagccgctcggttctcgtcaccggaggaaaccggggcatcggcctcgccatcgcccgcgctttcgccgacgccggcgacaaggtcgcgatcacgtaccgctcgggtgagccgccggagggcttcctggccgtcaagtgcgacatcaccgacaccgagcaggtggagcaggcctacaaggagatcgaggagacgcacggtcccgtcgaggtcctgatcgccaacgccggcgtcaccaaggaccagctcctgatgcgcatgtcggaggaggacttcacctccgtcgtcgaaaccaacctcaccggcaccttccgcgtggtcaagcgtgccaaccgcgccatgctgcgcgccaagaagggccgcgtcgtcctcatctcgtcggtggtcggactgctcggctccgcggggcaggcgaactacgccgcctccaaggccggtctggtcggcttcgcgcgctccctcgcccgtgagctggggtcgcgcaacatcaccttcaacgtcgtcgcgccgggcttcgtcgacaccgacatgaccaaggtgctcaccgacgagcagcgggcgaacatcgtgtcgcaggtgccgctggggcggtacgcgcggcccgaggagatcgccgcgacggtgcggttcctcgcctcggacgacgcctcgtacatcactggagccgtcattcccgttgacggcggactgggaatgggtcactga

SEQ ID NO: 7115 - protein, 234 aa, Streptomyces coelicolor
MSRSVLVTGGNRGIGLAIARAFADAGDKVAITYRSGEPPEGFLAVKCDITDTEQVEQAYKEIEETHGPVEVLIANAGVTKDQLLMRMSEEDFTSVVETNLTGTFRVVKRANRAMLRAKKGRVVLISSVVGLLGSAGQANYAASKAGLVGFARSLARELGSRNITFNVVAPGFVDTDMTKVLTDEQRANIVSQVPLGRYARPEEIAATVRFLASDDASYITGAVIPVDGGLGMGH

SEQ ID NO: 7116 - DNA, 747 bp, Pseudomonas sp
  CDS (1)..(747)
atggagtcgcgtagtcgtattgcagtggtaaccggtggtatgggtggcattggcacatcgatcagccaacgtctgtacaaggaaggcttcaaggtcattgtcggctgcagtgccaattccagccgcaaggatgactggatggcaacacagcttgcagctggctatcaattcgaatgcgtcgaaaccgacatcaccgattgggaatcgacccgcaaggcctttgagatggtacgggaacacttcgggccgatcgacgtactggtcaacaatgctggcatcactcgtgacgcgtccttccgcaagctcaccccggaagactggaacacggtgatcgggaccaacctgaacagtttgttcaacacctccaagcaagtcattgaaggcatgctctccaagggctgggggcggatcatcaacatctcttcgatcaacggccagcgtggccagttcggtcagaccaactactccgccgccaaagccggcatccatggtttcaccatggcactggcccgggaagtttccggcaagggcgtgaccgtcaacaccgtctccccaggctacatccagaccgacatgactgcggcaatccgcaaagacattctggacggcatgattgccggcattccggtcggccgtcttggccaacccgaagagatcgcctcaatcgtggcctggctggcctccgatgagtccgcctacagcaccggtgccgacttctcggtaaacggcggcatgaacatgcagtaa

SEQ ID NO: 7117 - protein, 248 aa, Pseudomonas sp
MESRSRIAVVTGGMGGIGTSISQRLYKEGFKVIVGCSANSSRKDDWMATQLAAGYQFECVETDITDWESTRKAFEMVREHFGPIDVLVNNAGITRDASFRKLTPEDWNTVIGTNLNSLFNTSKQVIEGMLSKGWGRIINISSINGQRGQFGQTNYSAAKAGIHGFTMALAREVSGKGVTVNTVSPGYIQTDMTAAIRKDILDGMIAGIPVGRLGQPEEIASIVAWLASDESAYSTGADFSVNGGMNMQ

SEQ ID NO: 7118 - DNA, 735 bp, Moritella marina
  CDS (1)..(735)
atgagtttttcaagtaaaactgtacttgttacaggtgcaagccgtggtattggccgtgcaatcgcggaacattttgctaaattaggtgccacagttattggtactgcaacatctgcacaaggtgctgagcgtattggcgcatatttaggtgatgctggctttggcttagagctgaacgtgacaagccaagattcagttgatgcactttatgcagagatcaaaacgcaagttggtcacattgatattctagtaaataacgctggtattacagctgataacatcttcttgcgcatgaaagaagatgaatggtgtaatgttatcgatacgaacttgacctcattataccgtttatgtaagccttgcttacgtggcatgatgaagcaacgccatggtcgtattattaatattggctctgttgttggtacaactggtaatggtggtcaagcgaactatgctgctgctaaatcaggtttgctaggttttactaagtcgcttgcaagcgaagttgcatctcgcggtatcactgttaatgccgttgcacctggttttatcgaaactgatatgacagcagaattaacagaagaacaaaaacaaacaattttagctcaagtaccaaccagtcgtcttggtagtactactgagatagctgaaacagttggatttttagcatctgatggtgcaagctatattacgggtgaaaccatccatgtaaatggcggcatgtacatggcttag

SEQ ID NO: 7119 - protein, 244 aa, Moritella marina
MSFSSKTVLVTGASRGIGRAIAEHFAKLGATVIGTATSAQGAERIGAYLGDAGFGLELNVTSQDSVDALYAEIKTQVGHIDILVNNAGITADNIFLRMKEDEWCNVIDTNLTSLYRLCKPCLRGMMKQRHGRIINIGSVVGTTGNGGQANYAAAKSGLLGFTKSLASEVASRGITVNAVAPGFIETDMTAELTEEQKQTILAQVPTSRLGSTTEIAETVGFLASDGASYITGETIHVNGGMYMA

SEQ ID NO: 7120 - DNA, 738 bp, Alcaligenes latus
  CDS (1)..(738)
atggcacagaaactggcttacgtgaccggcggcatgggcggcatcggcacctcgatgtgccagcgcctgcacaaggacggcttcaaggtgatcgccggctgcggtccgagccgcgaccaccagaagtggatcgatgaacaggccgcgctgggctataccttctacgcctccgtgggcaacgtggccgactgggactccaccgtggccgccttcgagaaggtcaaggccgagcacggcaccgtggacgtgctggtgaacaacgccggcatcacgcgtgacgggcagttccgcaagatgagcaaggccgattggcaggccgtgatgtcgaccaacctcgacagcatgttcaacgtcaccaagcaggtgatcgagggcatgctggacaagggctggggccggatcatcaacatctcctcggtcaacggcgagaagggccagttcggccagaccaactactccgccgccaaggccggcatgcacggcttctcgatggcgctggcgcaggaagtggcggccaagggcgtgacggtgaacaccgtgagcccgggctacatcgccacggacatggtcaaggccatccgccaggacgtgctggacaagatcatcgccaccattcccatccgtcgcctgggtacgccggaggagatcgcctccatcgtcgcctggctggccggcgaggagtcgggcttcaccaccggtgccgacttcagctgcaacggcggcctgcacatgggctga

SEQ ID NO: 7121 - protein, 245 aa, Alcaligenes latus
MAQKLAYVTGGMGGIGTSMCQRLHKDGFKVIAGCGPSRDHQKWIDEQAALGYTFYASVGNVADWDSTVAAFEKVKAEHGTVDVLVNNAGITRDGQFRKMSKADWQAVMSTNLDSMFNVTKQVIEGMLDKGWGRIINISSVNGEKGQFGQTNYSAAKAGMHGFSMALAQEVAAKGVTVNTVSPGYIATDMVKAIRQDVLDKIIATIPIRRLGTPEEIASIVAWLAGEESGFTTGADFSCNGGLHMG

SEQ ID NO: 7122 - DNA, 908 bp, Alcaligenes sp
  CDS (104)..(841)
ggatatgtcaaaaaggaaagggcttcagtgttttccttcacggcagcgtccaatttcttcggtagagtgggccctgagccaatcactaacaaggagaaatcacatgagccagaaagtcgcgtatgtcaccggtggcatgggaggcatcggtaccgccatttgccagcgcctgcacaaggaaggtttcaaggtcatcgcgggttgcggcccgacacgggaccacgccaagtgctggccgagcaaaaggccctgggctacacgttttatgcatccgtcggtaacgtgggtgattgggattccacccgtggaagctttcggcaagaccaaggcagagcacggcaccatcgacgtgctggtgaacaacgccggtatcacgcgcgaccgcatgttcctcaagatgtcgcgcgaagactgggatgccgtgatcgaaaccaacctcaacagcatgttcaacgtcaccaagcaagtggtgtcggacatggtggaaaagggctggggccgcatcatcaacatcagctcggtcaacggcgaaaaaggtcaggcaggtcaaaccaactattccgcagccaaggcaggcatgcacgggttctccatggccctggcgcaagagctggccaccaagggcgttaccgtcaatacggtcagccccggctacatcggcacagatatggtcaaggcgatccgcccggatgtgctggagaagatcgttgccaccgtccccgtcaaggccttgggcgaaccgagcgagattgcctcgatcatcgcctggctggcctcggaagaaaatgggtacgccacaggtgcagacttctcggtcaatggtggcctgcacatgggctaaaagtggtgcatatctcttgagccaacaaaaaacgcattggcggggttttttgttgggctttgcaagg

SEQ ID NO: 7123 - protein, 245 aa, Alcaligenes sp
MSQKVAYVTGGMGGIGTAICQRLHKEGFKVIAGCGPTRDHAKCWPSKRPWATRFMHPSVTWVIGIPPVEAFGKTKAEHGTIDVLVNNAGITRDRMFLKMSREDWDAVIETNLNSMFNVTKQVVSDMVEKGWGRIINISSVNGEKGQAGQTNYSAAKAGMHGFSMALAQELATKGVTVNTVSPGYIGTDMVKAIRPDVLEKIVATVPVKALGEPSEIASIIAWLASEENGYATGADFSVNGGLHMG

SEQ ID NO: 7124 - DNA, 747 bp, Caenorhabditis elegans; identical to SEQ ID NO: 7110
  CDS (1)..(747)

SEQ ID NO: 7125 - protein, 248 aa, Caenorhabditis elegans
MSALLGGRIAVVTGGASGIGKAISQTLAKHGARVVVADLDSGNAAATAKALPASQSHSSFACDVSNADSVKGLSEHVKSLGTPSILVNCAGITKDSTLLKMKQEQWDSVIKVNLTGVFHVSQAFVKASVDNNNHPLSIINVSSIVGKMGNFGQTNYAATKAGVIGFTKSAAKELAKKNVRVNAVLPGFIKTPMTEAMPPTVLAEICKGIPMGRMGEAEEIANSVLYLASDLSSYVTGATLEVTGGFSM

SEQ ID NO: 7126 - DNA, 744 bp, Wolinella succinogenes
  CDS (1)..(744)
atgaaattcagcggaaaaaatgtcctcatcacgggctctagccgaggaatcggagccgatattgcacgagttttggccgaaatgggcctcaaagtctggatcaattaccgaagccaaagctccctagccgatgagctcaaagcagagattgaggccaagggggggcaagcggcagttatctcttttgatgccaccgatgaagaggctttcatcagtggaattaagaccatcattgatgctgatggagagctcgcttacctcgtcaacaacgcaggaatcaccaacgacaaactcgccattcgaatgaagaccgaagagtttcgctccgtgattgaggccaacctcacttcggcttttatcggaagccgcgaagcccttaagagcatgagcaagcaacgctttggaagcgtggttaatatctcctctatcgttggagagaggggaaatgcagggcagaccaactactcagccagcaaaggaggcatgatcgccatgaccaaatcctttgcctttgagggcgctcctagaaatgtccgattcaactgcgtcaccccaggattcatccaaacggatatgacgcatgggctcaaagaggaggtcaaagaggcctacatcaaaaatattcctctagggcgttttggcgattctaaagagatcgctcatgccgttgcctatcttttgagcgactactccagctacatcactggcgagattctcaaggttaatggcggtctttatatgtag

SEQ ID NO: 7127 - protein, 247 aa, Wolinella succinogenes
MKFSGKNVLITGSSRGIGADIARVLAEMGLKVWINYRSQSSLADELKAEIEAKGGQAAVISFDATDEEAFISGIKTIIDADGELAYLVNNAGITNDKLAIRMKTEEFRSVIEANLTSAFIGSREALKSMSKQRFGSVVNISSIVGERGNAGQTNYSASKGGMIAMTKSFAFEGAPRNVRFNCVTPGFIQTDMTHGLKEEVKEAYIKNIPLGRFGDSKEIAHAVAYLLSDYSSYITGEILKVNGGLYM

SEQ ID NO: 7128 - DNA, 747 bp, Porphyromonas gingivalis
  CDS (1)..(747)
atgaaattattggagaacaaggtagctctcattacgggagccggacgcggtatcggccgtgccatagcttataagtatgcaacggaaggtgccgatgtggctattactgatctgaatatcgatgagggcgtacaggctttcgtagaagaactcaaagggctcggagtacgtgcagcggcatacgcttccaatgcagcggatttcgatgcagcacatacagtggtggaacagatcaaggctgacttcggtcggatcgatattttggtgaacaatgccggtattactcgcgatggccttatgatgcgtatgaccgagcaacaatgggatgccgtgatcaacgttaatctgaagtcagcgttcaacatgatccatgccgtgactcccatcatgatgggacagcgcaccggcagtatcatcaatatggcttctgtggtaggtgtatcaggcaatgcaggacaatccaactactcagcttctaaagccggtatgatcggtttggccaagagtgtcgccaaagagctgggctcacgtggcgtgcgtgccaatgcgattgcaccgggttttatcatcaccgatatgactgccgtgcttagcgaagaagtgaagaagcaatgggcggcacagatacctctgcgtcgtggtggtacgcccgaagatgtggctaacgtagctaccttccttggcagtgacctctcttcgtacgtgacgggacaggtagtccacgtttgtggcggtatgaatatgtaa

SEQ ID NO: 7129 - protein, 248 aa, Porphyromonas gingivalis
MKLLENKVALITGAGRGIGRAIAYKYATEGADVAITDLNIDEGVQAFVEELKGLGVRAAAYASNAADFDAAHTVVEQIKADFGRIDILVNNAGITRDGLMMRMTEQQWDAVINVNLKSAFNMIHAVTPIMMGQRTGSIINMASVVGVSGNAGQSNYSASKAGMIGLAKSVAKELGSRGVRANAIAPGFIITDMTAVLSEEVKKQWAAQIPLRRGGTPEDVANVATFLGSDLSSYVTGQVVHVCGGMNM

SEQ ID NO: 7130 - DNA, 765 bp, Chromobacterium violaceum
  CDS (1)..(765)
atgccgctcgccttgcgcaaggcggcgctggtgaccggggcggggcggggcataggccgcgcgatcgcgctggagctggccggccgcaagctgccggtcttcgtcaactatcgcagcgacgccaaggcggccgaggatgcttgcgcggcgatccgggccggcggcggcgaggcctatccggttggcgccgacgtgtccgaccgcgacgcggtggcggcgatgttcgccgacatccgccagcgcggcttctgggtgcagactctggtcaacaacgccggcatcgtccgcgacggcctgttggcgatgatgccggccgacgactggagcgcggtgctgggcagcaatctggacggcagcttccactgcgcgcgcgccgcgctgcagaccatgatgagccgcaagagcgggcagatcgtcaacatcgcctcggtcggcggcatgcgggcccaggtcggccaggccaattacgcggcggccaaggccggcctcttggcgctgacccgcgggctggcgcgcgaggtcggccgctacggcatacgcgtcaacgcggtggcgccgggtttcatcgacaccgacatgttggcgcagatgaaggcgtcggacaagggcgcggccttgctggaggacgcgcgcgccaggcagatcccgctggcgcgcttcggcaggccggaggaggtggcgcagaccgtcggcttcctgtgctcgggcgcggccagctatatcaccggccatgtgctggtcgtcgacggagggctgtgtgcctga

SEQ ID NO: 7131 - protein, 254 aa, Chromobacterium violaceum
MPLALRKAALVTGAGRGIGRAIALELAGRKLPVFVNYRSDAKAAEDACAAIRAGGGEAYPVGADVSDRDAVAAMFADIRQRGFWVQTLVNNAGIVRDGLLAMMPADDWSAVLGSNLDGSFHCARAALQTMMSRKSGQIVNIASVGGMRAQVGQANYAAAKAGLLALTRGLAREVGRYGIRVNAVAPGFIDTDMLAQMKASDKGAALLEDARARQIPLARFGRPEEVAQTVGFLCSGAASYITGHVLVVDGGLCA

SEQ ID NO: 7132 - DNA, 741 bp, Chromobacterium violaceum
  CDS (1)..(741)
atgcgtttgaaagggaaagtatccatcatcaccggctcggccagcggcatcggcaaggcgacggcggagaagttcgtcaaggagggcgccatcgtcgcggtgtgcgacctgaacccggacgcggtcaaaaccgtcgtcgacgaactgaaagccctgggcggagaagcttacggctacaaggtggatgtgactgacaagggccagatcgccgagatggtggccgacctgaagaaccgttgcggccgcatcgacgtgctggtcaacaacgccggcatcgtccaggatgcccagctgatcaagatgagcgaagaccagttcgacaaggtgatcgacatcaacctgaagggcgtttacaactgtgcccgcgccgtggtggatactatggtggagcagggcggcggcgtgatcctcaacgcctcgtcggtggtgggcgtttacggcaatttcggccagaccaactacgcggcggccaagttcggcgtgatcggcttcgtcaagacctgggccaaggaattgggcaagaagggcatccgcgccaacgcggtgtgtccgggcttcgtcgccacccccatcctgaaggccatgccggaaaaagtgctgcaggcgatggaagacaaggtgccgatgcgccggatggccgatccggccgagatcgccaacgtctacgccttcctggcgtcggacgaggccagctacatcaacggcgccgccatcgaggtgaccggcggtttgacgctgtaa

SEQ ID NO: 7133 - protein, 246 aa, Chromobacterium violaceum
MRLKGKVSIITGSASGIGKATAEKFVKEGAIVAVCDLNPDAVKTVVDELKALGGEAYGYKVDVTDKGQIAEMVADLKNRCGRIDVLVNNAGIVQDAQLIKMSEDQFDKVIDINLKGVYNCARAVVDTMVEQGGGVILNASSVVGVYGNFGQTNYAAAKFGVIGFVKTWAKELGKKGIRANAVCPGFVATPILKAMPEKVLQAMEDKVPMRRMADPAEIANVYAFLASDEASYINGAAIEVTGGLTL

SEQ ID NO: 7134 - DNA, 738 bp, Chromobacterium violaceum
  CDS (1)..(738)
atgagtctgcaaggcaaagtggcgctggtgaccggcgcctcgcgcggcataggcgcggcgatcgccgacgcgctggccgccgagggcgccgtcgtcatcggcaccgccacgtcggaatccggcgcggccgccatccatgagcgcctgtccgccacgggcggcgcgggccgcgtgctgaacgtcaccgaggagggcgccgtcgacgcgctgatcgaatcggtggagaaggacttcggcgcggtcgcgattctggtcaacaacgccggcatcacccgcgacggcttgttgatgcggatgaaggacgaggactgggacgccatcatggacaccaatctgaaatcggtgttcaagacctccaaggccgtgatgcgcggcatgatgaaggcccgcagcggccgcatcatcaatatcgcttccgtggtcggcgcgatgggcaatgccggccaggccaactacgcggccgccaaggcgggcatcatcggcttcaccaagtcgatggcgcgcgaggtcggcagccgcaacatcaccgtcaactgcgtggcgccgggcttcatcgacaccgacatgacccgcgcgctgccggaagcgcagcgcgaggcgctggtgggccaaatttccctaggccgcctgggcgaagccaaggacatcgccgatgccgtggtattcctggcatcggaccgcgcggcttatattacgggccagactttgcacgtgaacggcggcatgctgatgccttaa

SEQ ID NO: 7135 - protein, 245 aa, Chromobacterium violaceum
MSLQGKVALVTGASRGIGAAIADALAAEGAVVIGTATSESGAAAIHERLSATGGAGRVLNVTEEGAVDALIESVEKDFGAVAILVNNAGITRDGLLMRMKDEDWDAIMDTNLKSVFKTSKAVMRGMMKARSGRIINIASVVGAMGNAGQANYAAAKAGIIGFTKSMAREVGSRNITVNCVAPGFIDTDMTRALPEAQREALVGQISLGRLGEAKDIADAVVFLASDRAAYITGQTLHVNGGMLMP

SEQ ID NO: 7136 - DNA, 741 bp, Vibrio vulnificus
  CDS (1)..(741)
atgaaaaaagtcgctttgatcactggatcaaaaggcgggattggttctgcaatttcttcccaacttgttgaaaatggttaccgtttaattgctacttattacacgggaaatcatcaatgtgcgttagattggtttaatgaaaaaggctttaccgaagatcaggtccgcttatttgaactggatgtgacgaatacagaagagtgtgccgaccgcttgagtaagttactggaagaagaggggacgatcgacgtcgtcgtcaataatgccggtattactcgtgatggggtgtttaagaaaatgcccccgcaatcttggtttgatgtcattaatactaacctcaacagtgtgttcaatgtgactcaaccgctctttgccgccatgtgcgaaaaagggggtggtcgagtgatcaatatttcttctgtaaatggccttaaaggtcagtttggtcaagctaactattctgcggctaaagctggcatgatcggcttttccaaagccctcgcttacgaaggtgcccgcagtggtgtgacggtcaatgtcgttgctccaggttacaccgctacgccgatggtcgagcaaatgcgcgatgaagtgctcgaaggcatcaaatctcaaattcctatgcaaagactggcaacaccagaagaaatcgccaaagcggttgctttcttggtgagcgatgcaggcgcatacattactggtgaaacgctgtcggtaaacggcggcttatacatgcattaa

SEQ ID NO: 7137 - protein, 246 aa, Vibrio vulnificus
MKKVALITGSKGGIGSAISSQLVENGYRLIATYYTGNHQCALDWFNEKGFTEDQVRLFELDVTNTEECADRLSKLLEEEGTIDVVVNNAGITRDGVFKKMPPQSWFDVINTNLNSVFNVTQPLFAAMCEKGGGRVINISSVNGLKGQFGQANYSAAKAGMIGFSKALAYEGARSGVTVNVVAPGYTATPMVEQMRDEVLEGIKSQIPMQRLATPEEIAKAVAFLVSDAGAYITGETLSVNGGLYMH

SEQ ID NO: 7138 - DNA, 735 bp, Photorhabdus luminescens
  CDS (1)..(735)
atgagattagatggaaagattgcattagtaacaggcgctagccgtgggatcggccgtgcaactgctgagctattagcagagcgtggagcctatatcattggtacagcaacaagcgataaaggcgctgaagtcattagtgcttacctcggtgaaaaaggtaaaggttttgtactgaatgtcactgatccggaatcgattgaacagcttatgtctaccatccgaacagagcatggcgggcttgacattttagtgaacaatgcgggtatcaccggtgataatctggtgatgcgcataaaggatgatgagtggcagcatgttattgacactaatctttcatctgttttccgtatgacaaaagcggcaatgcgcttcatgataaaaaaacgttatggtcgtatcatctctattggttctgttgttggatcgatggggaacgctgggcaggcaagctatgcagcggcgaaagcagggcttgttggtttcagtaagacattggctcgcgaagtgatttcccgtggtattactgttaacgttgtcgcgccagggcttattgaaactgatatgctaagagcgttgccagaggagcagttggcgaacttttcgaatgatatccccgctaaacggcttggggatgtaaaagaaattgctagtgctgtggctttcttcgcttctgatgaagcggcttacatcacaggcgaaacattacatgtcaatggcggcatgtatatgaactaa

SEQ ID NO: 7139 - protein, 244 aa, Photorhabdus luminescens
MRLDGKIALVTGASRGIGRATAELLAERGAYIIGTATSDKGAEVISAYLGEKGKGFVLNVTDPESIEQLMSTIRTEHGGLDILVNNAGITGDNLVMRIKDDEWQHVIDTNLSSVFRMTKAAMRFMIKKRYGRIISIGSVVGSMGNAGQASYAAAKAGLVGFSKTLAREVISRGITVNVVAPGLIETDMLRALPEEQLANFSNDIPAKRLGDVKEIASAVAFFASDEAAYITGETLHVNGGMYMN

SEQ ID NO: 7140 - DNA, 747 bp, Gloeobacter violaceus
  CDS (1)..(747)
atgacgggattgctcacaggcaaagttgccctggtcaccggcgccggccgcggcatcggccgcgcctgcgcccttgccctcgcctcggagggagccgccgtggccgtcaactacagccgctccgaagaggccgcccagcaagtggtggcggcaattgaagcggccggggggcaggctgtcgccctcaaggcggatgtggccgaccccgagcaggtggagcgcctgtttgcagacttgctcgccaagtacggacggctcgacgccctggtcaacaacgccgggattacccgcgacggtctaatactgcgcatgtcgctcgaagactggaacgatgtggtatccctcaacctcaccggcaccttcttgtgcctgaaggcggcaagccggatcatgctcaagcagcgctccgggcgggtggtgaatatctcttcgacctcgggagtggccggcaacgccggtcaggccaactacagcgccgccaaggccggggtgttgggcctcacccgctccgccgcccgcgaactgggatcgcggggaatcaccgtcaacgcggtagcccccggcttcattgccaccgatatgaccagtgccctggaactggaaccgatcctcgctcaggtgccgctcaggcgcgtcggtcaacctgaggaagtagccgggctggtgcggtttttgtgcgccgacccggccgccgcctacatcacaggccaggtgattacgatcgacggcggcatggtgatggcctga

SEQ ID NO: 7141 - protein, 248 aa, Gloeobacter violaceus
MTGLLTGKVALVTGAGRGIGRACALALASEGAAVAVNYSRSEEAAQQVVAAIEAAGGQAVALKADVADPEQVERLFADLLAKYGRLDALVNNAGITRDGLILRMSLEDWNDVVSLNLTGTFLCLKAASRIMLKQRSGRVVNISSTSGVAGNAGQANYSAAKAGVLGLTRSAARELGSRGITVNAVAPGFIATDMTSALELEPILAQVPLRRVGQPEEVAGLVRFLCADPAAAYITGQVITIDGGMVMA

SEQ ID NO: 7142 - DNA, 741 bp, Chromobacterium violaceum
  CDS (1)..(741)
atgacgaaaaggattgcgttagttaccggtggcatgggcggtatcggcaccgccatctgcaaagccttggctgaagcggggcatatcgtggtaaccacgtacagcaaaccgggccgcgaagcgtcctggcatgccgacatgaagggactgggtttcagcgacatccacagctacctgtgcgacgtcacggacttcgccgcctgccaggatgtggctgcccgcatcgccaaggacgtcggccaggtcgatatcctggtcaacaatgcaggcatcacccgcgacgccagcttcaggaaacagagcaaggacgactgggacgccgtgatccgcaccaacctggactcggtattcaacatgaccaagcccgtgctggacaatatgctggaaacgggctttggccgcatcatcaacatttcgtccatcaatggccagaagggccaattcggccaaacgaactactccgcggccaaggctggcatgcacggcttcaccatggcgctggctcaggaagtggccaagaagggcgtgaccgtcaacaccatctctcccggctacatcgccaccgaaatggtgatggcggtgccggaagatgtgcgcaacaagatcatcgcccagatcccggtcggccgcctgggccgcccggaggagatcgccgcactggtgaccttcctctgctccgacaacgccggcttcatcaccggcagcaatatcgccatgaacggcggccagcacatgatgtaa

SEQ ID NO: 7143 - protein, 246 aa, Chromobacterium violaceum
MTKRIALVTGGMGGIGTAICKALAEAGHIVVTTYSKPGREASWHADMKGLGFSDIHSYLCDVTDFAACQDVAARIAKDVGQVDILVNNAGITRDASFRKQSKDDWDAVIRTNLDSVFNMTKPVLDNMLETGFGRIINISSINGQKGQFGQTNYSAAKAGMHGFTMALAQEVAKKGVTVNTISPGYIATEMVMAVPEDVRNKIIAQIPVGRLGRPEEIAALVTFLCSDNAGFITGSNIAMNGGQHMM

SEQ ID NO: 7144 - DNA, 936 bp, Plasmodium yoelii yoelii
  CDS (1)..(936): n means a or g or c or t/u, r means g or a
atgaatatgttgtataaattattattattttttttttttatgcgagcattggaatgctataggataccaaatatccaaaatctgaataaggttaatacaaataagtacctacgatcaaaccgtgatttaaatttatcgggacataataaagaaaacaactattattgtggggaaaataaagtagctttagtaacaggagcaggaaggggtataggacgatccattgcgaaaacgttagctaaatctgtttcacatgttctatgtataagtaagacacagttttttttttttttttttttttttttttngcaraaatcgtgtgacagtgtttccgatgaaataaattcccttgggtataaagcaactggatatgctgctgatgtttcaaataaagaagaaataaccgaattaattaataaattattaacagatcataaaagtatagatatactagttaataatgcaggaataacgagagataatgtgtttttgcgtatgaaaaatgaagaatgggaagacgtaataaaaacgaatttaaattcactattttatgtaacacaccctataactaaaaaaatgattagcaataaatatggaagaattattaatatgtctagtatagtaggaattacaggaaattttggacaaacaaattattctgcatccaaagcaggggtaatcggatttacaaaaagtttagccaaagaattagcatcgagaaatataactgttaatgcaatagctcctggttttatatcaagtgatatgactgataaaataagtgatgatataaaacaaaatattatttcgaatattccggctggaagaatgggaacacccgaagagattgcaaatatggtaggatatctatcttcagaaattgcaggatatataaatggaaaagtatttataattgatggtggattatcaagttaa

SEQ ID NO: 7145 - protein, 311 aa, Plasmodium yoelii yoelii
  misc_feature (103)..(103): Xaa can be any amino acid
MNMLYKLLLFFFFMRALECYRIPNIQNLNKVNTNKYLRSNRDLNLSGHNKENNYYCGENKVALVTGAGRGIGRSIAKTLAKSVSHVLCISKTQFFFFFFFFFXQKSCDSVSDEINSLGYKATGYAADVSNKEEITELINKLLTDHKSIDILVNNAGITRDNVFLRMKNEEWEDVIKTNLNSLFYVTHPITKKMISNKYGRIINMSSIVGITGNFGQTNYSASKAGVIGFTKSLAKELASRNITVNAIAPGFISSDMTDKISDDIKQNIISNIPAGRMGTPEEIANMVGYLSSEIAGYINGKVFIIDGGLSS

SEQ ID NO: 7146 - DNA, 1188 bp, Rattus norvegicus
  CDS (106)..(816)
gcgggtcggttgttcaaagagcttgttgaattgtttttccagttgttgtgcctttattataagttctgtgtcttagggatccatcttgccggtccgaggtccaagatggacaaagtctgtgcggtttttggaggctcccggggcatcggcaaggctgtagcccagctaatggcccagaagggttaccgcctggcgatcgtcgccagaaacttggaagtggccaaagccactgcgagcgagctcggcggaatccacttggcatttaggtgcaacattgccaaagaaggagatgttcacagtacatttgaagagatggagaaacatttaggtccagtaaatttcttggtaaatgcagctggtattaacagagacagtcttttagtaagaacaaaaactgaagatatgctgtctcagcttcataccaacctcttgggcaccatgctgacctgcagagccgctatgaggacaatgattcagcagggcgggtctattgttaatgtcgggagtattattggtttaaaaggcaatgtgggccaggccgcatatagtgccaccaaaggagggcttatcgggttttcacgctcgcttgctaaagaggttgcccggaagaaaatcagagtgaatgtggttgcaccaggatttattcacacggatatgacaaaacacttgaaagaagaacatttcaagaaaaacatccctcttgggaggtttggagaagctcttgaggtggcacatgccgttgtgtttcttttagagtcaccatacatcacaggacatgttcttatcgtggatggaggattacagctcactgcctaattagagatgatattactgtaatggtgatctggatcaagcacacattttcctattaattagacaatcatatctatatgggtgacatttgctaatggaaacaaattagctaatggatactacaaatgattccttccatctttgtatgaacatgtctcaaaacaaagtgtgactagttgtaatctaaaaggtgtgaagtctctgtctttacaggcagcagcagttttagtgcatggacattctgtaagggctacacatcagtattaatttctacatttttgccttggaagtagaaaattctgttgtctaattgtgatatacctgtatcaagccggatgttaaagacttcagccttctaaaaaaaaaaaaaaaaaa

SEQ ID NO: 7147 - protein, 236 aa, Rattus norvegicus
MDKVCAVFGGSRGIGKAVAQLMAQKGYRLAIVARNLEVAKATASELGGIHLAFRCNIAKEGDVHSTFEEMEKHLGPVNFLVNAAGINRDSLLVRTKTEDMLSQLHTNLLGTMLTCRAAMRTMIQQGGSIVNVGSIIGLKGNVGQAAYSATKGGLIGFSRSLAKEVARKKIRVNVVAPGFIHTDMTKHLKEEHFKKNIPLGRFGEALEVAHAVVFLLESPYITGHVLIVDGGLQLTA

SEQ ID NO: 7148 - DNA, 759 bp, Rhodopirellula baltica
  CDS (1)..(759)
atggatctctctctgtcggttgatttgaaagatcaagtcgccatcgtcaccggtgccagccaaggcctcggacgcgctgtcgccgtcgcactgggacaaaacggagcccatgtggtctgcgtcgctcgcaatgcagagaagctggccgccaccgtcgccgaaatcgaagcggccggcggaaaaggcgaagcactgccatgcgacgtcaccgatcgcaaagcggccgcggaagccatcgagggaactcacaaaaagcacggtcgtctggatatcctggtcaacaacgccgggatcactcgcgacaaactgatgcgtggcatgtccgacgaagaatgggattccgtcatcgccaccaacctgacaagttgcttcgtgtgctgccgatcggccgccggagtgatgcggcggagcaagtacggccgaatcatcaacatggccagtatctcgggcctgatcggcaaccccggtcaagccaactactcggccagcaaagcgggcatgattggaatgacgcgaacgatgagcaaagagctcgtctcacgaggcgtgaccgtcaacgcggttgcccccggtttcatcgcgagcgaaatgacggcggaacttggcgaagtcgttttggaagaagtcaagaaacgaatccctgccaagcgagttggacaacccgaggacgtcgccgcggcggtattgttcttggccagtcgcgatgccagctacatttcagggcaaaccatcgtcgttgacggtggaatggtcggctaa

SEQ ID NO: 7149 - protein, 252 aa, Rhodopirellula baltica
MDLSLSVDLKDQVAIVTGASQGLGRAVAVALGQNGAHVVCVARNAEKLAATVAEIEAAGGKGEALPCDVTDRKAAAEAIEGTHKKHGRLDILVNNAGITRDKLMRGMSDEEWDSVIATNLTSCFVCCRSAAGVMRRSKYGRIINMASISGLIGNPGQANYSASKAGMIGMTRTMSKELVSRGVTVNAVAPGFIASEMTAELGEVVLEEVKKRIPAKRVGQPEDVAAAVLFLASRDASYISGQTIVVDGGMVG

SEQ ID NO: 7150 - DNA, 753 bp, Synechococcus sp
  CDS (1)..(753)
atgctcagctccgcctccctcgacggtcagaccgcattggtgacaggaggcggacgtggcatcggcaaagccatcgccctggccctcgccgaagccggtgctgaggtggtggtgaactacgccaattccgctggcgccgccgacgaggtggtggccagcatcaacgctgccggtgggaaggcctacgccctgaaggccaacgtctccatcgaagaggaggtggacggactgatcaaggcagtgctggagcgcagcggccgcctggacgttctggtgaacaacgccggcatcaccagagacggcttgctgatgcggatgaagaccagcgactggcaagcggtgatcgacctgaacctcagcggagtgtttttgtgcagccgcgctgtcgcacggccgatgttgaagcagaaaagcggccgcatcatcaacatcacctccgtggtggggctgatggggaatgccggtcaggccaattacgccgctgccaaggccggtgtgatcggcctgaccaaaagcaccgccaaggaactggccagccggggcatcaccgttaatgccgtcgcccctggcttcatcgccacggacatgaccaaggatctggacgccgacgccatcctcaaagacattcccctgggccagttcggcacccaggaacaagtggccggagccgtgcgctttcttgcggcggatccagctgctgcctacatcaccggtcaggtgctgcaggtggatggcggcatggtgatggcctga

SEQ ID NO: 7151 - protein, 250 aa, Synechococcus sp
MLSSASLDGQTALVTGGGRGIGKAIALALAEAGAEVVVNYANSAGAADEVVASINAAGGKAYALKANVSIEEEVDGLIKAVLERSGRLDVLVNNAGITRDGLLMRMKTSDWQAVIDLNLSGVFLCSRAVARPMLKQKSGRIINITSVVGLMGNAGQANYAAAKAGVIGLTKSTAKELASRGITVNAVAPGFIATDMTKDLDADAILKDIPLGQFGTQEQVAGAVRFLAADPAAAYITGQVLQVDGGMVMA

SEQ ID NO: 7152 - DNA, 750 bp, Prochlorococcus marinus subsp
  CDS (1)..(750)
atgtcaaatacagaatctttaacaggtaaagttgctttaattacaggggctagcaggggcattggtaaagaaattgccttagaacttagtaatttaggtgcaaaagtcataataaattattcttcgtctgatgaaaaagctgaagaagttgtaaatctaattaaagagtctggaggcaaagttcataaattaaaatttgatgtttcaaaagaagaatctgttagtaaggcttttgaagaaatcataaagataaatggtgctatagatattcttgtaaataatgctggcataacaagagatgggctcttaatgcgaatgaaatcagaacaatgggatgacgttctaaatacaaacttaaaaggggtttttctttgtacaaaatatgcttcaaaatttatgataaaaaaaagaagcggaaagataattaatatctcatctattgtcggaataattggaaatcctggacaagcaaattattctgccgcaaaagcaggtgttattggctttacaaaaacctgtgcaaaagaatttgcttcaagagggataaatgttaatgctatagctccaggttttatagaaacagaaatgactgaaaaactaaataacgaagagattatcaaagccataccattaggaaagctaggtagttgttcacagatagcaaacttagtttcattcttagtctcgagtaatgctggaagctatataacaggacaaacaataagtattgatgggggcatgagtatttaa

SEQ ID NO: 7153 - protein, 249 aa, Prochlorococcus marinus subsp
MSNTESLTGKVALITGASRGIGKEIALELSNLGAKVIINYSSSDEKAEEVVNLIKESGGKVHKLKFDVSKEESVSKAFEEIIKINGAIDILVNNAGITRDGLLMRMKSEQWDDVLNTNLKGVFLCTKYASKFMIKKRSGKIINISSIVGIIGNPGQANYSAAKAGVIGFTKTCAKEFASRGINVNAIAPGFIETEMTEKLNNEEIIKAIPLGKLGSCSQIANLVSFLVSSNAGSYITGQTISIDGGMSI

SEQ ID NO: 7154 - DNA, 753 bp, Prochlorococcus marinus
  CDS (1)..(753)
atgacctctcctcgtcccctaactggccaaaccgccctgatcacaggagccagtcgtgggatcggtcgtgctgtagcccttgccctcgctgaagcaggcgcagaagtagtcgtgaactactcaagctcagctgatgcagcagaagaagttgttcaagcgatcaccagcaacggtggctctgcctatgccatcaaagccaatgtggcagaagaagatgccgtagaccaactgatcaaaaccgtgcttgaacgcagcagcagactggatattttgatcaacaatgcaggcataactcgcgatggcctgttgatgcgaatgaaaacggaagactggcaagccgtggtcaatctcaacctcacaggtgtatttctatgcactcgggctgttgctcgcacgatgcttaagcaaaaaagcggcagaattatcaatatcacctccgtggtgggcctgatgggcaatgcaggccaagccaattacgcagcagccaaagctggagtggtgggcctcacgaaaagtacagccaaggaagttgccagccggggaatcactgtcaatgcagtagccccaggtttcatcacaacagacatgacaaaagagttggattcagaaccgattcttgccgctatcccattgggatcttttggcaccccagagcaagtcgctggagctgtgcgcttcttggtagccgaccctgcagcggcttacatcactggacaagtgctacaagttgatggcggcatgctgatgggctga

SEQ ID NO: 7155 - protein, 250 aa, Prochlorococcus marinus
MTSPRPLTGQTALITGASRGIGRAVALALAEAGAEVVVNYSSSADAAEEVVQAITSNGGSAYAIKANVAEEDAVDQLIKTVLERSSRLDILINNAGITRDGLLMRMKTEDWQAVVNLNLTGVFLCTRAVARTMLKQKSGRIINITSVVGLMGNAGQANYAAAKAGVVGLTKSTAKEVASRGITVNAVAPGFITTDMTKELDSEPILAAIPLGSFGTPEQVAGAVRFLVADPAAAYITGQVLQVDGGMLMG

SEQ ID NO: 7156 - DNA, 753 bp, Prochlorococcus marinus
  CDS (1)..(753)
atgacttcttcatcacttcttattggccaaactgcaattgtcacaggggcaagcagaggaatagggaaagctattgccttgaaccttgctcaggcaggcgcagaagttgtagtgaactatgcaaattcagcaaccaaagcagaagaagtagtctccttaatcaaaagcactggagggaaagcatatgcattgcaagcaaatgtggcagacgagagttctgtaaatgaattggtagatactgtattagaaaaaagtgatcatatagatattttgataaacaacgcgggtataaccaaagatggtctattaatgaggatgaaaactgaagattggcaatcagtattaaatctaaacctcactggtgttttcctgtgcactaaagcagtttcaagatcaatgcttaaacaaagaaaagggcgcatcatcaatatcacttcagttgtaggattaatgggtaatgcaggacaagcaaattacgcttctgcaaaagcaggggtaattggcttcacaaagagtgctgcaaaagaatttgctagtagaggtatcacagtaaatgctgttgcacctggctttatagaaacagatatgacaaaagagttagatgcagaaccaatactttcagcgatcccattagggcattttgggagtactgagcatgttgctgggacagttcgttttctagctgcagatccagcctcttcttatataacagggcaagttcttcaagttgatggtggaatggttatgagctaa

SEQ ID NO: 7157 - protein, 250 aa, Prochlorococcus marinus
MTSSSLLIGQTAIVTGASRGIGKAIALNLAQAGAEVVVNYANSATKAEEVVSLIKSTGGKAYALQANVADESSVNELVDTVLEKSDHIDILINNAGITKDGLLMRMKTEDWQSVLNLNLTGVFLCTKAVSRSMLKQRKGRIINITSVVGLMGNAGQANYASAKAGVIGFTKSAAKEFASRGITVNAVAPGFIETDMTKELDAEPILSAIPLGHFGSTEHVAGTVRFLAADPASSYITGQVLQVDGGMVMS

SEQ ID NO: 7158 - DNA, 744 bp, Helicobacter hepaticus
  CDS (1)..(744)
atgaaatttaatggagaaaatgtgcttattacaggtgcaagcaaaggaattggggcgcaaattgccaaaactttggcaagttatggacttaaagtatggataaattaccgctcaaagcctgaacttgcccaaaaggtaaaagaggaaatagaatcaagcggtggtaaagcagcagtgattaaatttgatgcaagcatagaagaagagttcatagctggtttaaaagttattacacaaagtgatgagaaattagcctatcttgtgaataatgcaggaattacaaatgacaaacttgcattgcgtatgagcgtagaagattttgaaaacgtaatcgatgcaaatttgaaatcgtgttttattggttgcagagaagctttgaaaataatgagcaaacaacgttttgggagtgttgtaaatatcgcctcaatcattggtgagcgtggcaatatgggacaaacaaattatgcagcgagtaaaggtggaatgattgcaatgagtaaatcttttgcctatgagggcgcaccgcgaaatgttcgctttaactgcgttacacccggttttatacaaagcgatatgactgatgaactcaaacccgaagttgtagaaagctatatgaaaaatatccctcttgcacgctttggacaggcaagtgatgtagcccaagcagtggcatttttgctttcagaatcttcaagctatattacaggtgaggtattaaaggtcaatggtgggctttatatgtaa

SEQ ID NO: 7159 - protein, 247 aa, Helicobacter hepaticus
MKFNGENVLITGASKGIGAQIAKTLASYGLKVWINYRSKPELAQKVKEEIESSGGKAAVIKFDASIEEEFIAGLKVITQSDEKLAYLVNNAGITNDKLALRMSVEDFENVIDANLKSCFIGCREALKIMSKQRFGSVVNIASIIGERGNMGQTNYAASKGGMIAMSKSFAYEGAPRNVRFNCVTPGFIQSDMTDELKPEVVESYMKNIPLARFGQASDVAQAVAFLLSESSSYITGEVLKVNGGLYM

SEQ ID NO: 7160 - DNA, 735 bp, Candidatus Blochmannia floridanus
  CDS (1)..(735)
atgacttttaagggaaaaattgtattagtgacgggagcgcgtagtggaattggtcaagctatttctgaacaatttattaaatatggggctatagtaataggtactgctactgattatataggagtaagagatattaatgtacgtttcggtaaccaaggtaaaggtatgcaattaaatgttacgaatcagcattcaattgattgttgtatacaggaagtacgttcggagtttggagatattaatatattagtaaataatgctggtattgttcaggataatattttattacatatgatggaaaatgaatggcaatcagtgatagatgtaaatttaactgcagtatatcgtatgtctaaagctgtaatcaaaccaatgatgaaaaatcgttacggtagaattattaatataggttctataataggtatgactggaaatgttggtcaagtaaattattcagcatctaaatcgggattaattgggttaaccagatcattagctagagaggtggcgtctagaggtattacagtaaatttggtaacaccaggttttatttgtactaatatgacaaaaaaattaaccgataaacaaaaaaaaaatattttatctaaaattccaattgctcgttttggagagcctcaagatgttgcaaatgcagtgatattttttgcatctgataattcagaatatattacgggtcagaccatacatattaatggaggtatgtatatggggtaa

SEQ ID NO: 7161 - protein, 244 aa, Candidatus Blochmannia floridanus
MTFKGKIVLVTGARSGIGQAISEQFIKYGAIVIGTATDYIGVRDINVRFGNQGKGMQLNVTNQHSIDCCIQEVRSEFGDINILVNNAGIVQDNILLHMMENEWQSVIDVNLTAVYRMSKAVIKPMMKNRYGRIINIGSIIGMTGNVGQVNYSASKSGLIGLTRSLAREVASRGITVNLVTPGFICTNMTKKLTDKQKKNILSKIPIARFGEPQDVANAVIFFASDNSEYITGQTIHINGGMYMG

SEQ ID NO: 7162 - DNA, 753 bp, Bordetella parapertussis
  CDS (1)..(753)
atggaaaatacctccacggaactgcagggcaagatcgcgctggtgaccggcgcgacgcgcggcatcggccgcgccatagcccaggaactggcggcgcgcggcgccacggtggtcggtacggccacgtccgaggcgggcgcccaggccatcaccgaggcgctggccgcccagggcgggcggggcgtggtgctggacgtgaccgatgcccaggcctgcgaggcgctgatcgagcagcttggcaaggatggcggcggcccgcacatcctggtcaacaacgccggcatcacgcgcgacacgctggccatgcgcatgaaggacgacgactggtcggccgtcatcgataccaacctggcggcggtcttccgcctgtcgcgcgccgtgctgcgcggcatgatgaaggcgcgttggggccggatcatcaatatcacgtcggtggtgggcgcaagcggcaacgctggccaggccaactacgccgccgccaaggccggcgtggcgggcatggcgcgggcgctggcgcgcgagctcggcagccgcaacatcaccgtcaactgcgtggcgcccggctttatcgataccgatatgacgcgtatcctgggcgaagaccagacggcggcgctgctgcagcagattccgctgggccgcctgggcgcgcccgccgacatcgcccatgcggtcgcctttctggccgggccgcaggcgggttacattaccggtaccacgctgcacgtcaacggcggcatgtatatgcaatag

SEQ ID NO: 7163 - protein, 250 aa, Bordetella parapertussis
MENTSTELQGKIALVTGATRGIGRAIAQELAARGATVVGTATSEAGAQAITEALAAQGGRGVVLDVTDAQACEALIEQLGKDGGGPHILVNNAGITRDTLAMRMKDDDWSAVIDTNLAAVFRLSRAVLRGMMKARWGRIINITSVVGASGNAGQANYAAAKAGVAGMARALARELGSRNITVNCVAPGFIDTDMTRILGEDQTAALLQQIPLGRLGAPADIAHAVAFLAGPQAGYITGTTLHVNGGMYMQ

SEQ ID NO: 7164 - DNA, 738 bp, Bordetella parapertussis
  CDS (1)..(738)
atgagcggaaaattggcatatgtgacgggcggcatgggcggtatcggtaccgcgatctgccagcggttggccaaggacggcttccgggtggtggcggggtgcggccccagccgcaactatcagcagtggctcgacgagcaggcggcccagggctatacgttctacgcatcggtgggcaacgtgtccgaatgggagtccaccgtcaaggctttcgagcgcgtcacggccgacctgggccaggtcgacgtgctggtcaacaacgccggcatcacgcgtgacagcctgttccgcaagatgtcggtggacgactggcgcgcggtgatcgacaccaacctgaacagcctgttcaacgtgaccaagcaggtgctcgacgggatggtggagcgccaatgggggcgcatcgtcaacatcagctcggtcaacggccagaaagggcagttcggccagaccaactactcgaccgccaaggcgggcatccatggtttcaccatggccctggcccaggaggtcgccagcaagggcattaccgtcaacaccatttcgccgggctacatcgggaccgacatggtgcgggccatccgtcccgacgtgctggagaaaatcgtcgcgacgattccggtgcgccggctgggtacgcccgaggaaatcgcgtccatgacgtcctggctggcgtcggacgagtcgggttttgccacgggcgcggatttctcgctcaatggcggcctgcacatgggttga

SEQ ID NO: 7165 - protein, 245 aa, Bordetella parapertussis
MSGKLAYVTGGMGGIGTAICQRLAKDGFRVVAGCGPSRNYQQWLDEQAAQGYTFYASVGNVSEWESTVKAFERVTADLGQVDVLVNNAGITRDSLFRKMSVDDWRAVIDTNLNSLFNVTKQVLDGMVERQWGRIVNISSVNGQKGQFGQTNYSTAKAGIHGFTMALAQEVASKGITVNTISPGYIGTDMVRAIRPDVLEKIVATIPVRRLGTPEEIASMTSWLASDESGFATGADFSLNGGLHMG

SEQ ID NO: 7166 - DNA, 747 bp, Bordetella parapertussis
  CDS (1)..(747)
atgaagaacgaacgattgcaggggcgggtggcgctggtcacgggcggcgcgggtggcataggcctggcggtgtgtcgacgcttgcaggccgaaggcgcgcgcatcgtggtgggcgacattggcgaggagcgcgtgcttgccgcggcggcgtcgctgggcgagggggcgcttggcgtattcctggacgtggcggaccgtcagagttgggccgccgccaagcgggcggtggatgcgcagggctggcaggtggacattgtggtcaatgtggccggcatcgtgcgcgatcgttcgctggccaagatgtcggacgccgaatggagcgccgtcatcgacgtgaatctgcgcggtacctggctgggctgccagagcgcctttgcgtggatcggcgaacgcggctgggggcgcatcatcaatgtggcgtccaccgccattttcggcgcctatggccaggccaattattccgccgccaaggccggcatcgtggggttgacgcgaaccgcggcgctggaaggggccaagcgcggcatcctggtcaacgccgtggcgccaggtatcgtcgaaaccgcgatcctggccgatgtccccgaccaggtccgcgaaggctggctggcccggatgccgctcaagcgtacggcgcggcctgaagaaatcgccgctgtcattgcctttctcgcctctgacgatgcgagctatatgaccgggcagaccctcgtcgtcgacggcggggcaaccacgggcgactactga

SEQ ID NO: 7167 - protein, 248 aa, Bordetella parapertussis
MKNERLQGRVALVTGGAGGIGLAVCRRLQAEGARIVVGDIGEERVLAAAASLGEGALGVFLDVADRQSWAAAKRAVDAQGWQVDIVVNVAGIVRDRSLAKMSDAEWSAVIDVNLRGTWLGCQSAFAWIGERGWGRIINVASTAIFGAYGQANYSAAKAGIVGLTRTAALEGAKRGILVNAVAPGIVETAILADVPDQVREGWLARMPLKRTARPEEIAAVIAFLASDDASYMTGQTLVVDGGATTGDY

SEQ ID NO: 7168 - DNA, 747 bp, Bordetella bronchiseptica
  CDS (1)..(747)
atggatctgggtctgaaaggcaaggtcgccatcgtgaccggcggcggcagcggcatcggcgcatcgatatgcgcgcacctggcccgcgagggcgtggcggtggtcgtggccgacatcaacctggaggccgcccaggcccaggcggccgccctcgcgggcgagggcgccagcgcccaggcatgccaggtggacgtcaccgacgaagcctcggtgcgcacgctgtacgatcaggccgccacctggttcggcggcgtcgatatcctggtcaacaacgccggcttcacgcgcgacatgcgcatcgccaagatgggcatgcaggactgggacagcgtggtcgacgtcatcctgaagggcgcgtttctgtgcactcgcgaagcggtgcgccatttcgccgagaagaactggggcaggatcatcaacatttcctcgcgcgcccacctcggcaacgccgggcaggccaactactccgccgccaaggccgggctgatcggcttcacgcgcgccatggcgctggaacacggccgcttcaatgtcacggtcaacgccgtcgcccccggcatcatcgataccgaagcggtcaagcgcctgccgcactacgagaaaatccgcgacgcggccaaggccaccacgcccatcccgcgcatcggccaccccgacgatgtggccagcgtcgtcaccttcctcgcctcggaaccggccggctacgtgaccggggacgtcgtccatgtcaccggcgggcgctactga

SEQ ID NO: 7169 - protein, 248 aa, Bordetella bronchiseptica
MDLGLKGKVAIVTGGGSGIGASICAHLAREGVAVVVADINLEAAQAQAAALAGEGASAQACQVDVTDEASVRTLYDQAATWFGGVDILVNNAGFTRDMRIAKMGMQDWDSVVDVILKGAFLCTREAVRHFAEKNWGRIINISSRAHLGNAGQANYSAAKAGLIGFTRAMALEHGRFNVTVNAVAPGIIDTEAVKRLPHYEKIRDAAKATTPIPRIGHPDDVASVVTFLASEPAGYVTGDVVHVTGGRY

SEQ ID NO: 7170 - DNA, 750 bp, Bordetella bronchiseptica
  CDS (1)..(750)
atggaactgggcatacggaatcaggttgcgttcgtcacgggcgcgggcaatggcataggctgggcctgcgcccaggtcctggcgcgcgagggttgccgggtggtcgtggcggatatcgatgcgcacgccgccgggcgcgccgcgcaggccatcgagcaggcgggcggcagcgccttggcgctgaccctggatgtgggacggccgcaggccgtgcgcgacgccgtggcgaccgtgctcgcccattggggcgccatcgagatcctgctcaataacgccggcttctcgcgcgacagcgcgatcggggcgatgagcgacgcgcaatggaccgatgtgctgacggtcaatctgtccggcgcgttccactgcatccgggagatcgcgccgcacatggtggcgcgcaaattcggccgcatcgtgaacatggcctcgcgcgcgcacttcggcgacatcaacaaggccaactattccgcggccaaggccggcgtcatcggcatgaccaaggccctggcgctggagctgggcgagcacggcatcacggtcaatgccgtggcgcccggcatcatccagacggcgcgcgtgcggaacctgccgcagttcgccggcatcgaatcgcgctcgctgggcgccatgccgatcaaacgcatcggccggcccgaggaggtcgccgacgccgtcgcgttcctggcctcggccagggccgctttcatcaccggggaagtcctgcatatcagcggcggccgctatggctga

SEQ ID NO: 7171 - protein, 249 aa, Bordetella bronchiseptica
MELGIRNQVAFVTGAGNGIGWACAQVLAREGCRVVVADIDAHAAGRAAQAIEQAGGSALALTLDVGRPQAVRDAVATVLAHWGAIEILLNNAGFSRDSAIGAMSDAQWTDVLTVNLSGAFHCIREIAPHMVARKFGRIVNMASRAHFGDINKANYSAAKAGVIGMTKALALELGEHGITVNAVAPGIIQTARVRNLPQFAGIESRSLGAMPIKRIGRPEEVADAVAFLASARAAFITGEVLHISGGRYG

SEQ ID NO: 7172 - DNA, 750 bp, Bordetella bronchiseptica
  CDS (1)..(750)
atggatctgggtctgactggcaaagtagccattgttacgggttcggcacgcggcctgggcgccgccacggcgcggcgattggccgaggaaggcgccaaggtcgtcatcaccgacatcaacgccgaactggcgcaggagacggcccggcgcatgcaggacgacggcctggccgcccattgcatcatcggggatgtgaccaaggccgccgacgtgcagcgcctggtcgaggagacggtggcgcatttcggcggcgtgcatatcctggtgaacaacgccggcgcgccgcgcgacaagtatctcgtgaagatgagcgaggacgactgggacttcgtgatggcggtcatgctcaagggcgccttcctggcggccaaggcggtgatgccgcatttcatcgagcagggctggggccgcgtcatcaacataagctcccgcgcccacctgggcaatccgacccaggccaattactcggccgccaaggccggcctgatcggcctggccaaggcgctgtccaaggaagaggggcgctacggcattacctgcaattgcgtggcccccggcttcatggaaaccgagatggtccaggccttgtcgacctacgagaccatcaaggaacaggccgtggcggcccagccgatcaagcgcgtgggcaagcccgatgacatcgccgacgcggtggccttcctggccagcgagcgcgccggcttcatcagcggcgaagtgctgcacgtgacgggcggacgctacggttga

SEQ ID NO: 7173 - protein, 249 aa, Bordetella bronchiseptica
MDLGLTGKVAIVTGSARGLGAATARRLAEEGAKVVITDINAELAQETARRMQDDGLAAHCIIGDVTKAADVQRLVEETVAHFGGVHILVNNAGAPRDKYLVKMSEDDWDFVMAVMLKGAFLAAKAVMPHFIEQGWGRVINISSRAHLGNPTQANYSAAKAGLIGLAKALSKEEGRYGITCNCVAPGFMETEMVQALSTYETIKEQAVAAQPIKRVGKPDDIADAVAFLASERAGFISGEVLHVTGGRYG

SEQ ID NO: 7174 - DNA, 957 bp, Oryza sativa
  CDS (1)..(957)
atggcgacctccgcgaccgcaggggcagcagcagcagtggcctccccggcggtggccccgcgcggcgccgccgtcgcggcggtggcgcggcgagggttcgtctcgttcggcgcggcggcggccgcgcgctcgcgcgcggtgcggtccggcggcttctccggcgtgcagacccatgttgcagctgttgagcaagcacttgtgcaagatgctacaaagttggaagctccagttgttattgtgaccggtgcctccagggggattggaaaggcgactgcattggctcttggaaaagctgggtgcaaggtcctggtgaactatgcccgatcctcaaaagaggctgaagaagtctccaaagagatcgaagcatgtggtggtcaggctattaccttcgggggagatgtttcaaaagaagccgatgtggattctatgatgaaagcagctcttgataaatggggaacaattgatgtgctggtaaacaatgcaggaattacccgagacacattattaatgaggatgaagaaatcacaatggcaagacgtaattgacctgaatcttactggtgttttcctctgtacacaagctgctacaaaaataatgatgaagaagaaaaagggaaaaatcatcaacatagcatcagttgttggtcttgttggtaatattggccaagctaattacagtgctgccaaggctggggttattggtttgacgaaaacagtagctagggaatatgcaagcagaaatatcaatgtgaatgcaattgcacctggtttcattgcatctgacatgactgctgaacttggagaggatcttgagaagaaaatcttgtcaaccatcccattagggagatatggcaaaccagaggaggttgctggcttggttgagtttttggctctcaatcctgcggccaactacatcacgggacaggttcttaccatcgatggagggatggtgatgtag

SEQ ID NO: 7175 - protein, 318 aa, Oryza sativa
MATSATAGAAAAVASPAVAPRGAAVAAVARRGFVSFGAAAAARSRAVRSGGFSGVQTHVAAVEQALVQDATKLEAPVVIVTGASRGIGKATALALGKAGCKVLVNYARSSKEAEEVSKEIEACGGQAITFGGDVSKEADVDSMMKAALDKWGTIDVLVNNAGITRDTLLMRMKKSQWQDVIDLNLTGVFLCTQAATKIMMKKKKGKIINIASVVGLVGNIGQANYSAAKAGVIGLTKTVAREYASRNINVNAIAPGFIASDMTAELGEDLEKKILSTIPLGRYGKPEEVAGLVEFLALNPAANYITGQVLTIDGGMVM

SEQ ID NO: 7176 - DNA, 741 bp, Bacillus cereus
  CDS (1)..(741)
atgttaaaagggaaggtagcattagtaactggcgcttcacgtggaattggtcgcgcgattgcgattgatttagcgaaacaaggggcaaatgtagtagtaaattatgctggtaatgaacaaaaagcaaatgaagtagtagatgaaattaaaaaattaggttctgatgcaattgcggtaagagcagatgttgcaaatgctgatgatgttacaaatatggtgaaacaaacagtagatacatttggacaagttgatattcttgtaaataatgctggtgtaacgaaagataatttattaatgcgtatgaaagaagaagaatgggatacagttattaatacaaacttaaaaggtgtattcttatgtacaaaagcagtatctcgttatatgatgcgtcaacgtcacggtagaattataaacatcgcttcggttgttggtgttataggaaacccaggacaagctaactatgttgctgctaaagcgggtgttattggattaacaaaaacatctgcaaaagagttagcaagtcgaaatattacagtgaatgcaattgcgccgggctttattgcgactgatatgacggatgtactagatgagaatattaaagccgaaatgttaaaagttattccagctgctcaatttggtgaagcgaaagatatcgcgaatgctgtaacgttttttgcttctgatcaaagcaaatatgttacaggtcaaacgttaaatgttgatggcggtatggtaatgtaa

SEQ ID NO: 7177 - protein, 246 aa, Bacillus cereus
MLKGKVALVTGASRGIGRAIAIDLAKQGANVVVNYAGNEQKANEVVDEIKKLGSDAIAVRADVANADDVTNMVKQTVDTFGQVDILVNNAGVTKDNLLMRMKEEEWDTVINTNLKGVFLCTKAVSRYMMRQRHGRIINIASVVGVIGNPGQANYVAAKAGVIGLTKTSAKELASRNITVNAIAPGFIATDMTDVLDENIKAEMLKVIPAAQFGEAKDIANAVTFFASDQSKYVTGQTLNVDGGMVM

SEQ ID NO: 7178 - DNA, 744 bp, Bacillus cereus
  CDS (1)..(744)
atggttcaattaaatggaaaagtagcaatcgtaacaggtggagcaaaaggaattggaaaagcaattacagtagcattagcacaagagggagcgaaagtagttattaactataatagcagtaaagaagcagctgaaaatttagtaaatgaattaggaaaagacggacatgacgtttatgcagtgcaagcggatgtttctaaagtagaagatgcaaaccgacttgtagaagaagctgtgaatcattttggtaaagttgatattcttgttaataatgctggtattacaagagaccgtacattcaaaaagttaaatcgtgaagattgggagcgcgtaattgacgtgaatttaagcagcgtatttaatacgacaagtgcggttcttccatacataacggaagcagaagaaggaagaattattagcatttcttctattattggtcaagcaggtggatttggccaaacaaactactcagcagcaaaagcggggatgttaggatttacaaaatcattagcgttagaacttgcaaaaacaaatgtcactgtaaatgctatttgcccaggatttattgatactgaaatggtagcagaagtaccagaagaagtacgtcaaaaaatcgttgcaaaaatcccgaaaaaacgttttggtcaagctgatgaaattgcaaaaggtgtagtatacctatgccgtgacggtgcgtatatcacaggtcaacaattaaacattaacggcggattatatatgtaa

SEQ ID NO: 7179 - protein, 247 aa, Bacillus cereus
MVQLNGKVAIVTGGAKGIGKAITVALAQEGAKVVINYNSSKEAAENLVNELGKDGHDVYAVQADVSKVEDANRLVEEAVNHFGKVDILVNNAGITRDRTFKKLNREDWERVIDVNLSSVFNTTSAVLPYITEAEEGRIISISSIIGQAGGFGQTNYSAAKAGMLGFTKSLALELAKTNVTVNAICPGFIDTEMVAEVPEEVRQKIVAKIPKKRFGQADEIAKGVVYLCRDGAYITGQQLNINGGLYM

SEQ ID NO: 7180 - DNA, 741 bp, Bacillus anthracis
  CDS (1)..(741)
atggagtttttaaacgggaaaacagctgttgtaacaggagctgcacagggaattggaaaagagattgcaagggtgtatgcaaaactaggggcgaaagtattaattagcgatgtaaatgaagagaagttacaaaaaacgacacgtgagttattggatgaaggatatgaagtgagcttatatcgatgtgatgtgagtaatcaaaatgaagcgaagtcgttaattgaatatgcggttcaaaaattcggtacattacatattttggtgaataacgctggaattacaagagatgccatgttacataaaatggagaagtcttcttgggaacaagtactgcaagtaaacttaaccggtgttttttattgcatgcaaccagcacttctttatatgagacaacaaggatatggaagaattattaatatttcttctataagtagagaggggaatattgggcaggcaaattatgctgcaacgaaagctggagttgtcggtttaacgaaaacggcagcgaaagaagttggaagtttcggtattacgtgtaatgcaatttgcccaggatttatggatacagatacgacaaaaacgataccagataaagtgaaagaaaagatggtcggcgcgattccagttggtagaattggaacgccagaagatattgcgaacgcagctgcctttttagcatcagaatatgcatcctatattacaggagaagtattaaatgtgagcggaggactgcaagtttaa

SEQ ID NO: 7181 - protein, 246 aa, Bacillus anthracis
MEFLNGKTAVVTGAAQGIGKEIARVYAKLGAKVLISDVNEEKLQKTTRELLDEGYEVSLYRCDVSNQNEAKSLIEYAVQKFGTLHILVNNAGITRDAMLHKMEKSSWEQVLQVNLTGVFYCMQPALLYMRQQGYGRIINISSISREGNIGQANYAATKAGVVGLTKTAAKEVGSFGITCNAICPGFMDTDTTKTIPDKVKEKMVGAIPVGRIGTPEDIANAAAFLASEYASYITGEVLNVSGGLQV

SEQ ID NO: 7182 - DNA, 747 bp, Chlamydophila caviae
  CDS (1)..(747)
atgaataatgtattgttggggaaaaaagcgatcgttacaggaggatctaggggtataggatttgccatagctaagctttttattgagcaaggtgctgatattgaaatatggggaataaatgatgagggtggcaaaaaagccgctgaagagttatccagaataggacggccagcgacttttgctaaggttgatgttagtaataacgaatctgtaaaagatgctgctcagaattttatttcagcacatggtagtgttgatattttagtgaataacgcaggaattactcgagataatcttttgatgcgtatgtctgaagaagaatggtcttctgttattaatacgaatttaaattctttgtattacgtgtgttcggccgtaattcgttctatgattaaagctcgttctggttccataatcaacattagttctattgttggtttaatgggtagtccaggacaaactaactatgccgctgcaaaagctggtattatagggtttagtagagctttagctaaggaagttgccgcaagaaatgttcgagtgaactgtatagctccaggatgtatcgataccgatatgactaaggtgttaaatgataatttaaaaacagaatggttaaaaaatgttcctatgggaagaatgggttccccagaagaaattgccaatgcggcgctatttcttgcctcccccctatcttcttatgtaacatctcaggttctgagtgttgatggaggcatggcgtactaa

SEQ ID NO: 7183 - protein, 248 aa, Chlamydophila caviae
MNNVLLGKKAIVTGGSRGIGFAIAKLFIEQGADIEIWGINDEGGKKAAEELSRIGRPATFAKVDVSNNESVKDAAQNFISAHGSVDILVNNAGITRDNLLMRMSEEEWSSVINTNLNSLYYVCSAVIRSMIKARSGSIINISSIVGLMGSPGQTNYAAAKAGIIGFSRALAKEVAARNVRVNCIAPGCIDTDMTKVLNDNLKTEWLKNVPMGRMGSPEEIANAALFLASPLSSYVTSQVLSVDGGMAY

SEQ ID NO: 7184 - DNA, 738 bp, Enterococcus faecalis
  CDS (1)..(738)
atggaattaacaggaaaaaacgtatttattactggaagcactcgtgggattggcaaagcagttgcgttggcttttgcgaaagagggcgccaatattgttttaaacggtcggagtgagattacgccagaacaacgacaagaaattgaagcctttggggtaaaatgtattggcctttctggagatatttccgattttgatgcagcgggtgagatgattcaagcaaccgttgaccaattaggctcgattgatattctggtgaataacgctgggattacgaatgataaattattattacgaatgacaaaagaggattttaatgcctgtttagatattaacttggtaggaacttttaacatgacccagcaagcggttaaacgtatgatgaaacaacgaagtggccggattattaatatggctagcgtttctggtttaatgggaaatgttggtcaagcaaactacgctgcgagtaaagcgggtgttgttggttttactaaatcggtggcgcgagaagttgcgccgcgtggtattacctgcaatgcgattgcaccaggatttatccaaaccgaaatgacggatgttttatcggaaaaagttaaaacacaaatgaatgcgcaaattcccttacaaacgtttgggcaagtcgaagatgtcgcagctacagcgatattcttagctaaaagtccctatattactgggcaagtcgtgaatgttgatggcggcttagtcatgcacggataa

SEQ ID NO: 7185 - protein, 245 aa, Enterococcus faecalis
MELTGKNVFITGSTRGIGKAVALAFAKEGANIVLNGRSEITPEQRQEIEAFGVKCIGLSGDISDFDAAGEMIQATVDQLGSIDILVNNAGITNDKLLLRMTKEDFNACLDINLVGTFNMTQQAVKRMMKQRSGRIINMASVSGLMGNVGQANYAASKAGVVGFTKSVAREVAPRGITCNAIAPGFIQTEMTDVLSEKVKTQMNAQIPLQTFGQVEDVAATAIFLAKSPYITGQVVNVDGGLVMHG

SEQ ID NO: 7186 - DNA, 750 bp, Coxiella burnetii
  CDS (1)..(750)
atgcctacactgctcaaaggaaaaaccgccctcgtaacgggcgcttctcggggcatcggcgcttccattgcggccgaactcgggcgccagggagctatcgttcttggaacggccaccacggaggcgggggcaaagaagattacccagatgctgatggaagaaaaagtggagggaaaaggctatgctctcgatatttgtgatcaagaaaggatgaaagcaattctatccgatattcaaggtgattttgacgcgccatcgatcttggtcaacaatgcggggataacacgggataatatccttctgcgaatgagatccgaacagtgggacgaggtcatcaatacgaacctcaacggcgtttttcatctcacgaaagcttgcctaaaatcgatggtaaaggctcgctcgggacgaattattaatataagttcagtagtggcgacaatgggcaatgcgggtcaagccaactatgtggctgccaaagcgggacttgttgggtttaccaaagtcgttgctatggaatatgcggcctacggaatcaccgctaattgtatcgctcccggctttattgaaacggaaatgacaggcgcattatccgaacagcaacgagaagcgatactggcccgagtgccaatgaaacgcatgggtcagcctaatgaaatcgctcaggcggcggcttttttggcctctgacaacgcggcgtatattacgggggagacattgcatatcaacggtggaatgtgtatggtatag

SEQ ID NO: 7187 - protein, 249 aa, Coxiella burnetii
MPTLLKGKTALVTGASRGIGASIAAELGRQGAIVLGTATTEAGAKKITQMLMEEKVEGKGYALDICDQERMKAILSDIQGDFDAPSILVNNAGITRDNILLRMRSEQWDEVINTNLNGVFHLTKACLKSMVKARSGRIINISSVVATMGNAGQANYVAAKAGLVGFTKVVAMEYAAYGITANCIAPGFIETEMTGALSEQQREAILARVPMKRMGQPNEIAQAAAFLASDNAAYITGETLHINGGMCMV

SEQ ID NO: 7188 - DNA, 762 bp, Streptomyces avermitilis
  CDS (1)..(762)
atgtccaccactgagcagcgcgtcgcggtcgtcaccggtgccgcgcgcggcatcggcgccgccactgccgtacgactggccgccgagggccgcgccgtcgcggtgatcgacctcgacgaggccgcgtgcaaggacaccgtggagaagatcaccgccgccggtggcaaggccatcgcggtcggctgtgacgtgtccgacgaggcccaggtcgaggccgcggtcgcgcggatcgccgaggagctcggggcgccgacgatcctggtgaacaacgcgggcgtgctccgcgacaacctgctgttcaagatgagcgcgtccgactgggacacggtcatgaacgtgcatctgcgcggcgccttcctgatggccaaggcctgtcagaagcacatggtggacgcgaagttcggccggatcgtcaacctgtcctcctcctccgcgctgggcaaccgcggccaggccaactactccaccgccaaggccggtctccagggcctcaccaagaccctcgccatcgagctcggcaagttcggcgtcaccgcgaacgccgtcgcgcccggcttcatcgtcaccgacatgaccgccgccaccgccgcccgcgtcggcatgggcttcgaggagttccaggccgcggccgccacccagatcccggtgcagcgtgtgggccagccggcggacatcgccaacgccatcgccttcttcacgggcgaggaggccgggttcgtctccggccaggtgatgtacgtcgccggcggaccgctcaactag

SEQ ID NO: 7189 - protein, 253 aa, Streptomyces avermitilis
MSTTEQRVAVVTGAARGIGAATAVRLAAEGRAVAVIDLDEAACKDTVEKITAAGGKAIAVGCDVSDEAQVEAAVARIAEELGAPTILVNNAGVLRDNLLFKMSASDWDTVMNVHLRGAFLMAKACQKHMVDAKFGRIVNLSSSSALGNRGQANYSTAKAGLQGLTKTLAIELGKFGVTANAVAPGFIVTDMTAATAARVGMGFEEFQAAAATQIPVQRVGQPADIANAIAFFTGEEAGFVSGQVMYVAGGPLN

SEQ ID NO: 7190 - DNA, 720 bp, Streptomyces avermitilis
  CDS (1)..(720)
atgagccgctcggttctcgtcaccggaggcaaccggggcatcggcctcgccatcgcccgcgcgttcgccgaggccggcgacaaggtcgcgatcacataccggtcgggtgagccgccggccaccctcacggacttgggctgtctcgccgtcaagtgcgacatcacggacaccgagcaggtggagcaggcctacaaggagatcgaggaccagcacggccccgtcgaggtcctcgtcgccaacgccggcgtcaccaaggaccagctcctgatgcgcatgtccgaggaggacttcacgtccgtcctcgacaccaacctcaccggcaccttccgcgtggtcaagcgtgccaaccgcggcatgctgcgcgccaagaagggccgcgtcgtgctcatctcgtcggtcgtcggcctcctcggctccgcgggccaggcgaactacgccgcgtccaaggccggcctggtcggcttcgcgcgctccctcgcccgcgagctgggctcacgcaacatcaccttcaacgtcgtcgcgcccggtttcgtcgacaccgacatgaccaaggtgctcaccgaggagcagcgcaagggcatcgtcggccaggtgccgctcggccggtacgcgcagcccgaggagatcgccgcggcggtgcggttcctcgcctccgacgacgcctcgtacatcactggagccgtcattcccgttgacggcggactgggaatgggtcactga

SEQ ID NO: 7191 - protein, 239 aa, Streptomyces avermitilis
MSRSVLVTGGNRGIGLAIARAFAEAGDKVAITYRSGEPPATLTDLGCLAVKCDITDTEQVEQAYKEIEDQHGPVEVLVANAGVTKDQLLMRMSEEDFTSVLDTNLTGTFRVVKRANRGMLRAKKGRVVLISSVVGLLGSAGQANYAASKAGLVGFARSLARELGSRNITFNVVAPGFVDTDMTKVLTEEQRKGIVGQVPLGRYAQPEEIAAAVRFLASDDASYITGAVIPVDGGLGMGH

SEQ ID NO: 7192 - DNA, 744 bp, Nitrosomonas europaea
  CDS (1)..(744)
atgctactggaacataaaatcgcactggtaacgggcgcaagccgtggaatcggcaaagctatcgcacttgagctgggaaagcatggcgctaccgtcatcggaaccgccacttccgaaactggagccggccatatcagtcagtatctcagcgaagctcgcatttcggggatggggctgatcatggatgtcagcaacatcgagcatatcaagagtggtattgagaccatacaacaatcactgggagatgttgcaatactgatcaacaacgccggtatcacacgagacaacctgctggcccgcatgaaggacgatgaatgggataacgttatccagaccgatttgaaatccgtgttctgtctcagtcgtgccgtactgcgcaccatgatgaaagcacgcagcggtcggatcatcaatatctcatcagtagtgggcgcaaccggaaatcctggacaaaccaactatgcagcggccaaggctgggatgatcggtttcagcaagtcactcgcaaaagaaattggcagcagaaacatcactgtgaactgtgtagctccaggctttatcgataccgatatgacccgttctctttcgccagatcaacaacaatcactgattcagcatatccctctcggaagattcgggcgccctgaagatgtcgctgcggctgtcgtttttctggcttctccggcagcagactatatcactggagccacacttcacgtcaatggcggaatgtatatggagtga

SEQ ID NO: 7193 - protein, 247 aa, Nitrosomonas europaea
MLLEHKIALVTGASRGIGKAIALELGKHGATVIGTATSETGAGHISQYLSEARISGMGLIMDVSNIEHIKSGIETIQQSLGDVAILINNAGITRDNLLARMKDDEWDNVIQTDLKSVFCLSRAVLRTMMKARSGRIINISSVVGATGNPGQTNYAAAKAGMIGFSKSLAKEIGSRNITVNCVAPGFIDTDMTRSLSPDQQQSLIQHIPLGRFGRPEDVAAAVVFLASPAADYITGATLHVNGGMYME

SEQ ID NO: 7194 - DNA, 717 bp, Tropheryma whipplei
  CDS (1)..(717)
atgtctagcaagagaacagtttttataaccgggggaaaccgggggataggtcgcgcaattgctgaaaagttcaagagcttcaactacaatgtcgcgattggagtaaggcaacctgaagctttcaaggatgctggctgccttgcagttgagtgcgatgtaaccgtctctagctcacttacaaaagctttcaaagaggtagaagagagattcggttttgttgatgtggcgattgcaaatgctggaattatcagggacacacttgttctacggatgaaagaggatgattttcaacatatccttgataccaatctgacaggcgcgtggaggcttgccaaacttgcgagtagatcgatgatgcgaaataagtttggtcgcatagtttttatatcaagtgtttctgctgggatgggtggtattggtcagacaaattattcagcatctaaggctggaatgataggccttgctagagctttaacccgtgagcttgcaagttttggcattactgtgaatgttgtagctcccggaatagtgcagacggatatggtatcgtcaatccctgacaatttgagagaggaattgatacaaagggtgccaatacgtcgaattggtctgccagaggaagttgctaatgctgttttttggctttccagtgatgaggcaagttatgtatccggagttgtattgcctgtggacggtggcttatcaatgggtttttaa

SEQ ID NO: 7195 - protein, 238 aa, Tropheryma whipplei
MSSKRTVFITGGNRGIGRAIAEKFKSFNYNVAIGVRQPEAFKDAGCLAVECDVTVSSSLTKAFKEVEERFGFVDVAIANAGIIRDTLVLRMKEDDFQHILDTNLTGAWRLAKLASRSMMRNKFGRIVFISSVSAGMGGIGQTNYSASKAGMIGLARALTRELASFGITVNVVAPGIVQTDMVSSIPDNLREELIQRVPIRRIGLPEEVANAVFWLSSDEASYVSGVVLPVDGGLSMGF

SEQ ID NO: 7196 - DNA, 915 bp, Plasmodium falciparum
  CDS (1)..(915)
atgatcaaaatgagtgttctacatagattttatctatttttcttgtttacaaagttcttccattgttataaaatttcttatgtattaaaaaatgcaaagctagctcccaaccatgcaattaaaaatattaattcattaaatttattgtctgaaaataagaaggaaaactatcattattgtggggaaaataaagttgctttagtaacaggtgcaggaagaggaataggtagagagatcgctaaaatgttggcaaaatcagtatctcatgttatatgtataagtagaacgcaaaaatcatgtgatagtgttgttgatgaaataaaatcatttggttatgaatcatcaggttatgcaggtgatgtatctaaaaaagaagaaataagtgaagtgattaataaaattttgacagaacataaaaatgtagatatattagttaataatgctggaataactagagataatctttttctaaggatgaaaaatgatgaatgggaagatgtgttaaggacaaatttaaattctctattttatataacacaacctatatcaaaaagaatgattaataatagatatggtcgaataattaatatatcaagtatagtagggttaacaggaaatgtaggacaagcaaattattcttcatcgaaagctggtgttattggttttacaaaaagcttagcaaaagaattagcttcaagaaatataactgtaaatgccatagcccctggatttatatctagtgatatgacagataaaattagcgaacaaataaagaagaacataatttcaaacattcctgctggacgaatgggaacaccagaagaagtagctaatttagcttgttttttatcatcagataagtctggttatattaatggtcgagttttcgtaatagacggtggactatcaccttaa

SEQ ID NO: 7197 - protein, 304 aa, Plasmodium falciparum
MIKMSVLHRFYLFFLFTKFFHCYKISYVLKNAKLAPNHAIKNINSLNLLSENKKENYHYCGENKVALVTGAGRGIGREIAKMLAKSVSHVICISRTQKSCDSVVDEIKSFGYESSGYAGDVSKKEEISEVINKILTEHKNVDILVNNAGITRDNLFLRMKNDEWEDVLRTNLNSLFYITQPISKRMINNRYGRIINISSIVGLTGNVGQANYSSSKAGVIGFTKSLAKELASRNITVNAIAPGFISSDMTDKISEQIKKNIISNIPAGRMGTPEEVANLACFLSSDKSGYINGRVFVIDGGLSP

SEQ ID NO: 7198 - DNA, 744 bp, Xylella fastidiosa
  CDS (1)..(744)
atgaacaaacccttacagggtgaggttgcgttagtgactggtgctagccgtggcatcggcgctgcagtggctgatcttttggctgatcatggggctaccgtgattggtacggcaacgtctgcttctggtgcgcagttaattggtgatcgtttggccttgctgggtggtcatggtcgcgctctggatgtgaccgatactgctgcagttggtgcattggtagaggagattgctgaacaattcggttcggtttcgattctggttaataatgctggtatcacacgagacaatctgttgatgcggatgaaggatgaggattgggagtccattgttgacactaatctgagcagtatttttcgtaccagcagggcggtggttcgcaacatgatgaaggcgcgcaagggccgtatcatcaacattgcttcggttgttggcgtgactggtaatgccggtcaggcaaactatgctgcggccaaagctggtgtgattgggtttaccaagtcactggctaaggaagttggcccacgtgggatcactgtcaatgtggtcgctccggggtttatcgataccgacatgactcgtgtgctgtctgagggtgtacgcaatgatatccttaaccacgtcccgcttggtcatttaggtgatccggtggatattgcgaacgcggtcgcttttctggctgccccagcagcacgctacattactggtgagacattacatgtcaacggtggtatgtatatgccgtga

SEQ ID NO: 7199 - protein, 247 aa, Xylella fastidiosa
MNKPLQGEVALVTGASRGIGAAVADLLADHGATVIGTATSASGAQLIGDRLALLGGHGRALDVTDTAAVGALVEEIAEQFGSVSILVNNAGITRDNLLMRMKDEDWESIVDTNLSSIFRTSRAVVRNMMKARKGRIINIASVVGVTGNAGQANYAAAKAGVIGFTKSLAKEVGPRGITVNVVAPGFIDTDMTRVLSEGVRNDILNHVPLGHLGDPVDIANAVAFLAAPAARYITGETLHVNGGMYMP

SEQ ID NO: 7200 - DNA, 720 bp, Vibrio parahaemolyticus
  CDS (1)..(720)
atgaaatcggaaaaagtagcagtagtcactggtgcggcacgtggtattggccaagctatttgtgagcaattactggaggatggattccacgtcgtcgggctagacatatcgcctgtggaatggagccactcggcgcagctaagcagttatcaagtcaatttgtgcgatgccgctgctgttagcgaagtggtagacagtattgtagagcagcatggaagaatcgatgcgctggttaataacgcgggtattactcgcgatgcattgctgccagacatgctagaacaagattgggacagcgtaatcgatgtgaacttaaaggctgtgttcttacttactcaacgcgtcgcgccagtaatgctagagcagggcacaggtagcattgtcagcatttcttctatcgtgggtacggatggcaacattgggcaaagtaactacggcgcgagtaaaggtggcgtgatcgcgatgagcaaaggttgggcgaaagagctatcgagaaaaggcgctcaaatccgagtgaactgtgttgcccctggttttatcactaccgacatgacgaagaacctgccagaaaaagtcattcaaatgatggaaagtaaaacgcccctaggacgcatgggctcggtgcaagatatcgccaatggcgttgcgtttctggtctctgataaaagtgcgtttataaccggacaagtgctcaagattgatggcggtttggtgctttaa

SEQ ID NO: 7201 - protein, 239 aa, Vibrio parahaemolyticus
MKSEKVAVVTGAARGIGQAICEQLLEDGFHVVGLDISPVEWSHSAQLSSYQVNLCDAAAVSEVVDSIVEQHGRIDALVNNAGITRDALLPDMLEQDWDSVIDVNLKAVFLLTQRVAPVMLEQGTGSIVSISSIVGTDGNIGQSNYGASKGGVIAMSKGWAKELSRKGAQIRVNCVAPGFITTDMTKNLPEKVIQMMESKTPLGRMGSVQDIANGVAFLVSDKSAFITGQVLKIDGGLVL

SEQ ID NO: 7202 - DNA, 741 bp, Vibrio parahaemolyticus
  CDS (1)..(741)
atgaagaaagtcgctttgatcactggatcaaaaggcggaattggttctgctatttcctctcaattagtcaatgacggttaccgtgtaatcgctacttatttcacaggtaactacgaatgtgcgctggagtggttcaacagtaaagggtttaccaaagatcaggttcgcctttttgagttggacgtaacaaacacagctgagtgtgcagagaagttagcgcaattgcttgaggaagaaggaaccattgatgttgttgtcaacaacgcaggtatcacacgcgatggcgtgtttaaaaagatgactgcgcaagcttggaatgatgtcatcaataccaacctcaatagtctattcaacgttacgcaacccctattcgcagcaatgtgcgaaaaaggtggtggtcgtgtcatcaatatctcttcagtcaatggtctaaaagggcagtttggtcaagcaaactactcggcggcgaaagctgggatgattggtttctctaaagccttggcatacgaaggcgctcgctcgggtgtgacggtcaatgttatcgctccggggtacacaggtacgccaatggttgagcaaatgaagccagaagtgttggaatccatcacgaaccaaatcccaatgaaacgccttgcgacaccagaagaaattgcagcatcagtgagcttcttggtcagcgatgccggcgcctatatcaccggtgagactttgtcggtgaacggcggcctatacatgcactaa

SEQ ID NO: 7203 - protein, 246 aa, Vibrio parahaemolyticus
MKKVALITGSKGGIGSAISSQLVNDGYRVIATYFTGNYECALEWFNSKGFTKDQVRLFELDVTNTAECAEKLAQLLEEEGTIDVVVNNAGITRDGVFKKMTAQAWNDVINTNLNSLFNVTQPLFAAMCEKGGGRVINISSVNGLKGQFGQANYSAAKAGMIGFSKALAYEGARSGVTVNVIAPGYTGTPMVEQMKPEVLESITNQIPMKRLATPEEIAASVSFLVSDAGAYITGETLSVNGGLYMH

SEQ ID NO: 7204 - DNA, 726 bp, Vibrio parahaemolyticus
  CDS (1)..(726)
atgacccgacaagtcctcgttacaggtgccagcaaaggcatcggtaaagccattgccgttcagttagccaaagatggtttccaaatcattgtccattacatgggcgatcaacaaggcgcgcaagacaccctagacaccatcgaacagcatgggggtagcggtcgtcttatccaattcgacatcagtgaccgcgcagattgccgagagaaactagaggccgatatcgccgaacacggcgcttactatggcgtcgtgaacaacgctggcatcacaaaagataccgctttccctgcgatgaccgaagaagaatgggatggcgtgattcataccaacctagatagcttctacaacgttcttcacccttgtgttatgccaatggtgcaaaagcgtaaaggtggtcgaattgttacccttgcatcagtatctggcctgatggggaaccgtggtcaaaccaactacagcgcagcaaaagcgggcgtaattggtgcaacaaaatcactcgcacttgaactggcaaaacgcaaaatcaccgttaactgcgttgcaccgggacttatcgacacaggcatggtagacgaacacgtaaaagaacacgcgatgccgcaaattcctttgcgccgcatgggagaaccagaagaagtcgctggtttagtcagttaccttatgtctgacatcgcaggctatgtaactcgccaagtcatttcggtaaacggaggcctagtatga

SEQ ID NO: 7205 - protein, 241 aa, Vibrio parahaemolyticus
MTRQVLVTGASKGIGKAIAVQLAKDGFQIIVHYMGDQQGAQDTLDTIEQHGGSGRLIQFDISDRADCREKLEADIAEHGAYYGVVNNAGITKDTAFPAMTEEEWDGVIHTNLDSFYNVLHPCVMPMVQKRKGGRIVTLASVSGLMGNRGQTNYSAAKAGVIGATKSLALELAKRKITVNCVAPGLIDTGMVDEHVKEHAMPQIPLRRMGEPEEVAGLVSYLMSDIAGYVTRQVISVNGGLV

SEQ ID NO: 7206 - DNA, 744 bp, Pseudomonas syringae
  CDS (1)..(744)
atgagccttcaaggtaaagttgcactggtaaccggtgccagtcgcggtattggtcaagccattgcgcttgagttgggacgcaatggtgcggtcgttgtaggcactgcgacctccgagtccggcgccgagcgcatcagcgcaacgttcaaggaaagcggcatcgaaggctttggcctgatgctggatgtctgcgatgcagagtctgtgagttctgttctgtcgaccattcaggagcgcgtaggcgcaccgttgattctggtcaataatgccggtatcacccgtgataacctggtgatgcgcatgaaagatgacgaatggtacgatgtcgtcaataccaacctgaacagccttttccgtctttccaagggtgttctgcgcggcatgaccaaagcgcgttggggacgaattatcagcattggttcggttgtgggtgccatgggcaacgccggtcaagtaaactatgcttccgcgaaggccgggctggaaggtttcagcagggccttggcccgtgaagtcgggtcgcgtgcagtgaccgtgaactcggttgcaccaggtttcatcgacaccgacatgacgcgtgagctgccagaggctcagcgtgaatcactgattacccagatacccctgggccgtctggggcaggcagaagagattgcgcacgtagtcgcttttcttgcttccgaaggcgcaggttacgttaccggggctacaatcccggtcaacggcggcatgtacatgagctga

SEQ ID NO: 7207 - protein, 247 aa, Pseudomonas syringae
MSLQGKVALVTGASRGIGQAIALELGRNGAVVVGTATSESGAERISATFKESGIEGFGLMLDVCDAESVSSVLSTIQERVGAPLILVNNAGITRDNLVMRMKDDEWYDVVNTNLNSLFRLSKGVLRGMTKARWGRIISIGSVVGAMGNAGQVNYASAKAGLEGFSRALAREVGSRAVTVNSVAPGFIDTDMTRELPEAQRESLITQIPLGRLGQAEEIAHVVAFLASEGAGYVTGATIPVNGGMYMS

SEQ ID NO: 7208 - DNA, 741 bp, Pseudomonas putida
  CDS (1)..(741)
atgagcctgcaaggtaaagttgcactggttaccggcgccagccgtggcattggccaggccatcgccctcgagctgggccgccagggcgcgaccgtgatcggtaccgccacgtcggcgtccggtgccgagcgcatcgctgccaccctgaaagaacacggcattaccggcactggcatggagctgaacgtgaccagcgccgaatcggttgaagccgtactggccgccattggcgagcagttcggcgcgccggccatcttggtcaacaatgccggtatcacccgcgacaacctcatgctgcgcatgaaagacgacgagtggtttgatgtcatcgacaccaacctgaacagcctctaccgtctgtccaagggcgtgctgcgtggcatgaccaaggcgcgttggggtcgtatcatcagcatcggctcggtcgttggtgccatgggtaacgcaggtcaggccaactacgcggctgccaaggccggtctggaaggtttcagccgcgccctggcgcgtgaagtgggttcgcgtggtatcaccgtcaactcggtgaccccaggcttcatcgataccgacatgacccgcgagctgccagaagctcagcgcgaagccctgcagacccagattccgctgggccgcctgggccaggctgacgaaattgccaaggtggtttcgttcctggcatccgacggcgccgcctacgtgaccggcgctaccgtgccggtcaacggcgggatgtacatgtaa

SEQ ID NO: 7209 - protein, 246 aa, Pseudomonas putida
MSLQGKVALVTGASRGIGQAIALELGRQGATVIGTATSASGAERIAATLKEHGITGTGMELNVTSAESVEAVLAAIGEQFGAPAILVNNAGITRDNLMLRMKDDEWFDVIDTNLNSLYRLSKGVLRGMTKARWGRIISIGSVVGAMGNAGQANYAAAKAGLEGFSRALAREVGSRGITVNSVTPGFIDTDMTRELPEAQREALQTQIPLGRLGQADEIAKVVSFLASDGAAYVTGATVPVNGGMYM

SEQ ID NO: 7210 - DNA, 729 bp, Lactobacillus plantarum
  CDS (1)..(729)
atgagcgtggatgaagtgattttagtcactggagctgctaagggtattggtttggcaacagtcaaacggttggcagctcagggggccagcgttattttaaacgttcatcatgaaattgaagcggccgattggcaagcattaacggctgaatatccaaggttgacgcaattagttggtgatgtgagcgatgatcaaacggcggctgatttaattgagaccgtgatgacaaattttggtcgcttggatggactcgtgaataacgctggtgtgacccatgatcagttattaacgcggctacacgcggaagatttcatgagtgtgattcaaacaaatttattgggcacatttaatatgaccaaatacgctttaaaagtcatgcagcgacagcgacaaggcgccatcgttaatgttgctagtgtggtcgggttacatggcaatatcggccaggcgaactatgcggctagtaaggctggaattattggtttaactaaaacgacggcaaaggaagcggctcggcgccaagtgcggtgtaatgcggtggccccaggaatgattacgacggccatgacggcacaattgaatgaccgtgtaacggcggctgccttaagtgatattccactcaaacgctttgggacgcccgacgaaattgcccaagcaattgactttttattgcaccaaccgtacttaacgggacaagtgctaacagttgacggtggcatgacgatataa

SEQ ID NO: 7211 - protein, 242 aa, Lactobacillus plantarum
MSVDEVILVTGAAKGIGLATVKRLAAQGASVILNVHHEIEAADWQALTAEYPRLTQLVGDVSDDQTAADLIETVMTNFGRLDGLVNNAGVTHDQLLTRLHAEDFMSVIQTNLLGTFNMTKYALKVMQRQRQGAIVNVASVVGLHGNIGQANYAASKAGIIGLTKTTAKEAARRQVRCNAVAPGMITTAMTAQLNDRVTAAALSDIPLKRFGTPDEIAQAIDFLLHQPYLTGQVLTVDGGMTI

SEQ ID NO: 7212 - DNA, 750 bp, Clostridium tetani
  CDS (1)..(750)
atgaagaataaatttttaaatggaaaagtagcattaataacaggagcttctagaggtattggaagaggaattgcaattgaattagcagataagggagcttgtgttattgtaaattatagaaaagatttaaaaggagcagaagaaacaaaaaagacaatagaagaaagaggtggatattgtagaataattaaatgtgatgtaagttcatatgaagatactaaactaatgattgaaaagataattagagattttgggaaaatagacattcttataaataatgctggtatatccaagattggattgtttatagatatggaggaagaggattgggataatataataaatacaaatttaaagggtgtttttaattgttctagaaatgttctaccttatatgattggtgaaaaaaatggagttataataaatatatcttctatgtggggaagcgttggagcttcttgcgaggtaatttattccgcttcaaagggaggagtagattcctttactaaagctttagcaaaagaagtagggccatccaacataagagtaaatgcaatttcaccaggagttataaacacttcaatgaatgagtggatgagttgtgaggaaaaggatagcttaaaagatgaaattccattatgtagatttggtgaatgtgaagatataggtaaggctgtagtatttttatgtagcgataacgcaaagtacataacaggtcaaatcttaacaatagacggtgggatgatataa

SEQ ID NO: 7213 - protein, 249 aa, Clostridium tetani
MKNKFLNGKVALITGASRGIGRGIAIELADKGACVIVNYRKDLKGAEETKKTIEERGGYCRIIKCDVSSYEDTKLMIEKIIRDFGKIDILINNAGISKIGLFIDMEEEDWDNIINTNLKGVFNCSRNVLPYMIGEKNGVIINISSMWGSVGASCEVIYSASKGGVDSFTKALAKEVGPSNIRVNAISPGVINTSMNEWMSCEEKDSLKDEIPLCRFGECEDIGKAVVFLCSDNAKYITGQILTIDGGMI

SEQ ID NO: 7214 - DNA, 756 bp, Clostridium tetani
  CDS (1)..(756)
atgatatcttataagactttagaaaataaaacagcaattattacaggtggaagtagaggaatcggtaaatctatagctataaaattaggtaagttaggcgcatctatagttttaaattatagaaataatacggatgctttgaaaaataccataagagaattagaagatttaaatataaatgtaattgcagtgcaaggagatataagtaattacaaagaatgtgaaaagataataaaagcagcattagataaatttaatggaatagatattttagttaacaatgctggaataacagcagataatcttattctaagaatgaaagaagaagaatttgataaagttatagaaacaaatttaaaaggaactttcaattgcgtaaaacattgtattccaacaatgataaaaagaagatatgggaaaataataaacatatcatctgtagtaggagtagcaggaaatgtaggtcaatgcaattatgccgcagctaaagcaggagtgattggatttactaaatctttagctaaagaattagcctcaagatctataaatgtaaatgctattgcaccaggttttatagaaactgatatgacaaatgcattgtcagacaaggtaaaagaaaatgttatatctaatattcctcttaaaagagttgggaaagccgaagatgtagcagaattagtagcttttttagcatcagatagttcatcctatattacagggcaagttataaatgtagacgggggaatggttatttaa

SEQ ID NO: 7215 - protein, 251 aa, Clostridium tetani
MISYKTLENKTAIITGGSRGIGKSIAIKLGKLGASIVLNYRNNTDALKNTIRELEDLNINVIAVQGDISNYKECEKIIKAALDKFNGIDILVNNAGITADNLILRMKEEEFDKVIETNLKGTFNCVKHCIPTMIKRRYGKIINISSVVGVAGNVGQCNYAAAKAGVIGFTKSLAKELASRSINVNAIAPGFIETDMTNALSDKVKENVISNIPLKRVGKAEDVAELVAFLASDSSSYITGQVINVDGGMVI

SEQ ID NO: 7216 - DNA, 738 bp, Bradyrhizobium japonicum
  CDS (1)..(738)
atgttcgatctgactggcaaaaaggcgctcgtcaccggcgcgaccggcggtatcggcggcgcaatcgcgcaggcgctgcacgcgcagggcgccacggtcgcgatatcaggaacgcggaaggaagtgctggatgagcttgccggcaagctcggcgagcgcaccttcgtgctgccctgcaatctctccaaggccgacgaggtcgaggcgctggtgcctgcggcggaagccgcgatgggccaggtcgacatcctcgtcgccaatgccggcatcacgcgcgacaatctcttcgtccagctccgcgacgaggactgggacgaggtcatcaacgtcaatttgacctcgaccttccgcctggcgcgcgccgccaccaaattgatgatgcgcaagcgcttcggccgcatcatcgccatcacctcggtggtcggcgtcaccggcaatcccgggcagggcaactacacggcgtcgaaggcaggcttgatcggcatgatcaagacgctgggtgccgaatacgccaagcgcggcgtcaccgccaactgcatcgcgcccggcttcatcaagacgccgatgacggacgcgctcaatgacaagcagcgcgagacgattctgaccaaggttccggccgcccggctggggacgcccgaggacatcgcggcggccgccgtctacctgagttcaaacgaagcggcctacgtcaccgggcaaaccatccatgtcaacggcggcatggccatgatctga

SEQ ID NO: 7217 - protein, 245 aa, Bradyrhizobium japonicum
MFDLTGKKALVTGATGGIGGAIAQALHAQGATVAISGTRKEVLDELAGKLGERTFVLPCNLSKADEVEALVPAAEAAMGQVDILVANAGITRDNLFVQLRDEDWDEVINVNLTSTFRLARAATKLMMRKRFGRIIAITSVVGVTGNPGQGNYTASKAGLIGMIKTLGAEYAKRGVTANCIAPGFIKTPMTDALNDKQRETILTKVPAARLGTPEDIAAAAVYLSSNEAAYVTGQTIHVNGGMAMI

SEQ ID NO: 7218 - DNA, 726 bp, Bradyrhizobium japonicum
  CDS (1)..(726)
atgtccagagttgcggtggtgaccggcggaacgcgcggtatcggcgaggcgatttcgatcgcgctcaaggcggccggctacaaggtagcggcgagctatgccggtaacgacgaggcggctgcgaagttcaagagccagaccggcatcaacgtctacaaatgggacgtctcgaactacgacgcctgtgccgcgggtctcaaacaggtcgaggctgaccttggtccggtggacgtgctggtcaacaatgccggcatcaccaaggacggcatgttccacaagatgacgccggagcaatggtacgcggtcatcaacaccaatttgaactcgctgttcaacatgacgcggccagtgtgggaaggcatgcgcgagcgcaagttcggccgggtgatttgcatctcctcgatcaatggtcagaagggccagatgggccaggtcaattattccgccgccaaggcaggtgatatcggcttcgtgaaggcgctggctcaggaaggggctcgcgccggcatcaccgtcaacacgatctgccccggctatatcgcgaccgagatggtcaaggcgatcaatccggagatcgtagccaagaacatcctgccccagattccggtcggtcgcctcggcgaaccacacgagatcgcgcgcacggtcgtgttcctcgcctccgacgatgccggcttcatcacgggatcgacgatctcggcgaatggcggccagcacatgatctga

SEQ ID NO: 7219 - protein, 241 aa, Bradyrhizobium japonicum
MSRVAVVTGGTRGIGEAISIALKAAGYKVAASYAGNDEAAAKFKSQTGINVYKWDVSNYDACAAGLKQVEADLGPVDVLVNNAGITKDGMFHKMTPEQWYAVINTNLNSLFNMTRPVWEGMRERKFGRVICISSINGQKGQMGQVNYSAAKAGDIGFVKALAQEGARAGITVNTICPGYIATEMVKAINPEIVAKNILPQIPVGRLGEPHEIARTVVFLASDDAGFITGSTISANGGQHMI

SEQ ID NO: 7220 - DNA, 747 bp, Bacteroides thetaiotaomicron
  CDS (1)..(747)
atgggattattagacggaaaaacagccattgtaaccggtgccgcccgtggtattggcaaggctatcgctctgaagtttgctgccgaaggtgcaaacattgcatttactgacctggtcattgacgaaaatgcagaaaaaacaagggtagaactggaagcaatgggtgtgaaagccaaaggttatgcttctaacgctgctaactttgaagatactgcaaaggtcgtagaagaaatccataaggacttcggacgtatcgatattctggtgaacaatgccggtatcactcgtgacggtctgatgatgcgtatgagcgaacaacaatgggatatggtaatcaatgtgaacctgaagtctgcatttaacttcatccacgcttgtacacctgttatgatgcgtcagaaagctggtagcattatcaacatggcatctgtagtgggtgttcacggtaatgcgggacaggctaactatgctgcttccaaagccggcatgattgcattggccaagtctatcgcacaagaactgggctctcgtggcatccgtgccaacgccattgctccgggattcatcctgacagatatgactgctgctctttctgacgaagtgagagctgaatgggcaaagaaaattcctttgcgtcgtggcggtactcctgaagatgtggcaaacatcgctaccttcctggcatcagatatgtcttcttacgtatcaggtcaggtgattcaggtagatggtggtatgaatatgtaa

SEQ ID NO: 7221 - protein, 248 aa, Bacteroides thetaiotaomicron
MGLLDGKTAIVTGAARGIGKAIALKFAAEGANIAFTDLVIDENAEKTRVELEAMGVKAKGYASNAANFEDTAKVVEEIHKDFGRIDILVNNAGITRDGLMMRMSEQQWDMVINVNLKSAFNFIHACTPVMMRQKAGSIINMASVVGVHGNAGQANYAASKAGMIALAKSIAQELGSRGIRANAIAPGFILTDMTAALSDEVRAEWAKKIPLRRGGTPEDVANIATFLASDMSSYVSGQVIQVDGGMNM

SEQ ID NO: 7222 - DNA, 735 bp, Wigglesworthia glossinidia brevipalpis
  CDS (1)..(735)
atgaattttaataaaaaaatttcattagtgacaggagctaatagaggaattggaaaatcaatagcaaaagaactattaaaaagaaattctattgttattggaacatctacttctaaagaaggagtggatataataaacaattatgtaaaaaagcaaggaaaaggaattgtattaaatttattagataaaaattcaatcaaattatgcatagaaaaaataaaaaaaaatttcggagatgtagatatacttataaacaatgcaggaactaataaagatgaattgttaatcagaatgaaagaaaatagtttaaatcatgtaataaatataaatcttatatctgtttttataatatctaaaatagttataaaaggaatgataaaaaaaagatacggaagaattattaacattggatcagtatctggattcacaggtaatataggtcaaacaaattattctgcgtctaaatctggattaacaggattcaccaaatctttggctagagaagttgcaaaaaaaggaattacggttaatatggtatctccgggatttattaaaacagatatgacaaaatctttatctgaaaataacaaaaaaaatatattatctaatataccagtaaacagatttggatctacaaaagacgtagcaaatgcagttattttttttgcttctgatttatcatcttatattaccggagaaactatgcacgttaatggcggaatatatatgaaataa

SEQ ID NO: 7223 - protein, 244 aa, Wigglesworthia glossinidia brevipalpis
MNFNKKISLVTGANRGIGKSIAKELLKRNSIVIGTSTSKEGVDIINNYVKKQGKGIVLNLLDKNSIKLCIEKIKKNFGDVDILINNAGTNKDELLIRMKENSLNHVININLISVFIISKIVIKGMIKKRYGRIINIGSVSGFTGNIGQTNYSASKSGLTGFTKSLAREVAKKGITVNMVSPGFIKTDMTKSLSENNKKNILSNIPVNRFGSTKDVANAVIFFASDLSSYITGETMHVNGGIYMK

SEQ ID NO: 7224 - DNA, 747 bp, Vibrio vulnificus
  CDS (1)..(747)
atgactgacttattaaacctaagcggtaaagttgcgttagtaacgggcgcgagccgtggtatcggtcgcgcaatcgcagaaactctggttgcacgtggcgcgacagtaattggtaccgcgacttcagaaaacggcgcagcggcaatttcagaatacctaggcgaaaatggcaaaggctttgctctgaatgtgacggatgctgaatcggttgaaagcgtactaaaagcgattaatgatgaattcggcgctgtcgacatcttgattaataatgcaggtatcacacgcgataatctgcttatgcgtatgaaagatgacgagtggaacgacatcatggacactaacctaacgtctattttccgtctttctaaagcagtgatgcgtggcatgatgaaaaaacgtgatggccgcatcatcaacgttggttctgttgttggcacaatgggtaacgcaggccaagcaaactacgcggctgcgaaagcgggtgttattggtttcacaaaatcattggctcgtgaagttgcatctcgtggtgtaacggtcaatactgtagcgccaggtttcattgagacagatatgactcgtgctctaaatgatgagcaacgtgcgaccactttggcgaatgttccagcaggtcgtcttggtgatcctcgtgaaattgcggaagctgtggtatttttggcgtcgccagctgctgcttacatcactggcgaaacactgcacgtcaacggcggaatgtatatggtctaa

SEQ ID NO: 7225 - protein, 248 aa, Vibrio vulnificus
MTDLLNLSGKVALVTGASRGIGRAIAETLVARGATVIGTATSENGAAAISEYLGENGKGFALNVTDAESVESVLKAINDEFGAVDILINNAGITRDNLLMRMKDDEWNDIMDTNLTSIFRLSKAVMRGMMKKRDGRIINVGSVVGTMGNAGQANYAAAKAGVIGFTKSLAREVASRGVTVNTVAPGFIETDMTRALNDEQRATTLANVPAGRLGDPREIAEAVVFLASPAAAYITGETLHVNGGMYMV

SEQ ID NO: 7226 - DNA, 726 bp, Vibrio vulnificus
  CDS (1)..(726)
atgacccgtcaagtgttagtcacaggggccagtaaaggcatcggcaaagccatcgccattcaattagcgaaagatggctttaccatcgtcgttcactacatgggcgataagcaaggtgccgagcaaacattggccatgattgaacaaaacggtggcagtggccgtttaattcagtttgatattagccatcgtcaacaatgtcgtgagcgtattgaagccgacatcgcagagcacggcgcatactacggcgtggtcaataacgcgggtatcaccaaagacaccgctttcccagcgatgaccgaagcagaatgggatggcgtaattcacaccaacctcgacagtttttataacgtcttacacccttgcgtgatgccgatggtgcaaaaacgcaaaggtggacgcattgttactttggcctccgtctccggattaatgggcaatcgaggtcaaaccaactacgccgctgccaaagcgggggtgattggcgcaaccaaatcattggctctcgagctggcgaaacgcaaaatcaccgtgaactgtgtcgcccctgggctgattgatacaggcatggtggatgagcatgtcaaagagcacgctttacctcaagtaccgctacgccgcatgggtgagccggaagaagtggctggcttagtcagttatttgatgtctgacattgcaggttatgtcactcgccaagtgatttcggttaatggaggcctaatatga

SEQ ID NO: 7227 - protein, 241 aa, Vibrio vulnificus
MTRQVLVTGASKGIGKAIAIQLAKDGFTIVVHYMGDKQGAEQTLAMIEQNGGSGRLIQFDISHRQQCRERIEADIAEHGAYYGVVNNAGITKDTAFPAMTEAEWDGVIHTNLDSFYNVLHPCVMPMVQKRKGGRIVTLASVSGLMGNRGQTNYAAAKAGVIGATKSLALELAKRKITVNCVAPGLIDTGMVDEHVKEHALPQVPLRRMGEPEEVAGLVSYLMSDIAGYVTRQVISVNGGLI

SEQ ID NO: 7228 - DNA, 738 bp, Synechococcus elongatus
  CDS (1)..(738)
atgagcgaaacagccgttgccattgtcactggtgcctcacgggggattggtcgagcgatcgccctcgaactggcgaaggaaggagccactgtagttgtcaactacgcccgttctgctgaggcggcccttgaagtagtgcagaggattgaacagcaagggggaacagcgatcgcgatcgctgccgatgtgtctgttcctgagcaggtcgatactctcgtggccaaaaccgtagaaacctatggccgtgtggatgtactggtcaacaatgccggtattacccgcgacaccctactgctgcgtatgagccttgaggactggcaggcggtgattaacctgaacctgaccggggttttcctgtgtacccgtgccgtgagtaaactgatgctgaagcaaaagcggggacgaattatcaacattgcgtcggtggcagggcaaatgggcaaccccggccaagccaactacagtgctgccaaagctggtgtgattgggtttagcaaaaccgtggccaaagaattagccagtcgaggcatcaccgtcaatgccgttgcccccggctttattgccactgagatgacagctgaactcaaagcagaggacattcttaaattcattcccctaggacggtatggcgaacccacagaagtggcggggatggtgcgctttttagccttggatccggcagccgcctacattacggggcaagtcttcaacgtggatggtggtatggtgatggcctag

SEQ ID NO: 7229 - protein, 245 aa, Synechococcus elongatus
MSETAVAIVTGASRGIGRAIALELAKEGATVVVNYARSAEAALEVVQRIEQQGGTAIAIAADVSVPEQVDTLVAKTVETYGRVDVLVNNAGITRDTLLLRMSLEDWQAVINLNLTGVFLCTRAVSKLMLKQKRGRIINIASVAGQMGNPGQANYSAAKAGVIGFSKTVAKELASRGITVNAVAPGFIATEMTAELKAEDILKFIPLGRYGEPTEVAGMVRFLALDPAAAYITGQVFNVDGGMVMA

SEQ ID NO: 7230 - DNA, 735 bp, Streptococcus mutans
  CDS (1)..(735)
atggaaatcaaaaataaaaatgtttttatcacaggttcaactcgtggtattggtctagctattgctcataaatttgctcaggcgggagctaatattgtattaaatggtcgctcagaaatttctcaggacctagtagctgaatttaaagattatggtgtcaaagtagcgacaatttcaggtgatgtctctcattttgaagatgctaaacgtatggttgatgaagctactgaagcattgggaagcgttgatatcttggttaataatgctggaattactaatgataagctgatgttgaagatgacagaagaggactttgaaagggttcttaagatcaatttgacaggtagctttaacatgactaaagctgttttgaaaccaatgaccaaagctcgccaaggtgctatcattaatatgtctagtgttgttggacttgctggaaacgttggtcaggctaattacgcagcttctaaagctggtttgattggctttaccaaggcagttgctcgtgaagttgcggctagaaatatacgtgttaacgctattgcaccaggttttattgaatctgatatgactgaacgtattccaaataagatgaaagacgctatgttaaatcaaattccaatgaaaacatttggaaagactgaaaatgttgctgaagttgctatgtttttagctcaacaagattatctgacaggtcaagttattgctattgatggcggcatgaccatgcaatga

SEQ ID NO: 7231 - protein, 244 aa, Streptococcus mutans
MEIKNKNVFITGSTRGIGLAIAHKFAQAGANIVLNGRSEISQDLVAEFKDYGVKVATISGDVSHFEDAKRMVDEATEALGSVDILVNNAGITNDKLMLKMTEEDFERVLKINLTGSFNMTKAVLKPMTKARQGAIINMSSVVGLAGNVGQANYAASKAGLIGFTKAVAREVAARNIRVNAIAPGFIESDMTERIPNKMKDAMLNQIPMKTFGKTENVAEVAMFLAQQDYLTGQVIAIDGGMTMQ

SEQ ID NO: 7232 - DNA, 735 bp, Streptococcus agalactiae
  CDS (1)..(735)
atgcaattaaaagataagaacatttttattacgggttcaagtagaggaatcggccttgcaattgcccatcaatttgcacaattaggtgctaatattgttttaaatggacgttctgaaatatcagaagacttaatagctgaatttgctgattatggtgtaaaagttattgctatttcaggagatgtttcttcttttgaagatgctaatcgcatgattaaagaagctattgcaagtctaggtagcgtggatgtgctcgttaacaacgctggtattactaatgataaattgatgcttaaaatgactgttgaagattttgagagcgttcttaaaattaatttaacaggtgcatttaatatgacacaatcagtcttgaaaccgatgacaaaagcgcgtcaaggtgctattattaatatctctagcgtcgttggattaactggaaatgtagggcaagctaattacgcagcctctaaagcaggtttaattggctttacaaaatcagttgccagagaagtagcagcacgaggcattcgtgtcaatgccattgctccaggctttatcgaatctgatatgacagatgttatcccagaaaaaatgcaagaagctattttagctcaaattccaatgaaacgtattggaaaaggtaaagaagtagcgcaggtagcgtctttcttagcagaacaagaataccttacaggacaagttattgccattgatggcggtatgacgatgcaatga

SEQ ID NO: 7233 - protein, 244 aa, Streptococcus agalactiae
MQLKDKNIFITGSSRGIGLAIAHQFAQLGANIVLNGRSEISEDLIAEFADYGVKVIAISGDVSSFEDANRMIKEAIASLGSVDVLVNNAGITNDKLMLKMTVEDFESVLKINLTGAFNMTQSVLKPMTKARQGAIINISSVVGLTGNVGQANYAASKAGLIGFTKSVAREVAARGIRVNAIAPGFIESDMTDVIPEKMQEAILAQIPMKRIGKGKEVAQVASFLAEQEYLTGQVIAIDGGMTMQ

SEQ ID NO: 7234 - DNA, 747 bp, Shewanella oneidensis
  CDS (1)..(747)
atgagtatcaatctgagtttagcgggcaaagttgccttagtgacaggtgcgagccgtggtattggccgcgcgattgccgaaaccttagtcgaagcgggtgcggttgtaataggaactgccacaagtgagaagggcgccgcagcaatccaagaatatctgggtgacaaaggttttggtttagtgcttaatgttaccgatagtcaatccgtcaccgatttattcgactcgatcaaagaaaaagcgggagatgttgatattctagtcaataacgcgggtatcacccgtgataacttgctgatgcgaatgaaagatgatgaatggaacgatatcattgataccaacctgacgtcattgttcagactatcaaaacctgtgatgcgtaccatgatgaaaaagcgctttggccggatcatcaatatcggttcagtggtaggcactatgggcaatgcaggtcaagttaactactcggcagcaaaggcgggtttgatcggatttacaaaatctcttgcaagagaggttgcatctcgtcaaattacagttaatgctatcgctcctggatttatccagaccgatatgactgatgagctgaccgaagatcagcaaaaagctatcatgtctcaggtaccgatggaacgattagggcaagcgcaagaaattgccaatgcagtgctctttttggcgtcggattctgccgcatatatcacaggcgagactttgcatgtgaatggcggaatgtacatggtttaa

SEQ ID NO: 7235 - protein, 248 aa, Shewanella oneidensis
MSINLSLAGKVALVTGASRGIGRAIAETLVEAGAVVIGTATSEKGAAAIQEYLGDKGFGLVLNVTDSQSVTDLFDSIKEKAGDVDILVNNAGITRDNLLMRMKDDEWNDIIDTNLTSLFRLSKPVMRTMMKKRFGRIINIGSVVGTMGNAGQVNYSAAKAGLIGFTKSLAREVASRQITVNAIAPGFIQTDMTDELTEDQQKAIMSQVPMERLGQAQEIANAVLFLASDSAAYITGETLHVNGGMYMV

SEQ ID NO: 7236 - DNA, 741 bp, Oceanobacillus iheyensis
  CDS (1)..(741)
atgctacaagggaaaaatgcgatcgtaacaggagcttctcgaggtataggtagatctattgcacttgaacttgcaaaacaaggtgcaaatgttgtagtgaattatgcgggaagtgaagataaagcagaagaggtagttcaagaagcgataagtcttggtgttcgttcgttcaaattccaggcaaatatctcaaatgagtcagaagtaaaggaaatgatgaagtccgttacaaatgaatttggtactattgatattcttgtgaacaatgctgggataacaaaagataatctcttgatgcggatgaaagaagatgaatttgatcaagtagtacaaacaaatttaaaaggtacattcttatgtacgaaagcagttacacggcaaatgatgaaacaaaaatctggaagaattatcaatgtggcttctatcgtaggggtgagcggtaatccaggacaagcaaattatgtagctgcaaaagcaggagtaattggtttaacaaaaacatctgcaaaagaattagcttctagaaatattttagtaaatgcagtagctccaggttttatttctacggatatgacggatcaattaagtaaagaacaacaagattcactcctaagtcttgtgccattagagcgttttggtaaaccggaagatgtagcgagagtagttcgtttcttagcaacagaagatgccaattatattacaggtcaaacaatccatattgacggtggtatggtgatgtaa

SEQ ID NO: 7237 - protein, 246 aa, Oceanobacillus iheyensis
MLQGKNAIVTGASRGIGRSIALELAKQGANVVVNYAGSEDKAEEVVQEAISLGVRSFKFQANISNESEVKEMMKSVTNEFGTIDILVNNAGITKDNLLMRMKEDEFDQVVQTNLKGTFLCTKAVTRQMMKQKSGRIINVASIVGVSGNPGQANYVAAKAGVIGLTKTSAKELASRNILVNAVAPGFISTDMTDQLSKEQQDSLLSLVPLERFGKPEDVARVVRFLATEDANYITGQTIHIDGGMVM

SEQ ID NO: 7238 - DNA, 765 bp, Oceanobacillus iheyensis
  CDS (1)..(765)
atgacaaataggttttctggaaaagtagctttaattaccggtggtagtagaggaattgggaaggctattgcttcattattcgcagaagaaggagcaaaagtagcaattattgatgttaacgaagaagctttatcacagtcagcaaaagaatttacagaaaaaggctataccgtttattcaaaggttgcagatgttgtaaatgcagaagaagtagagttggcggtaaaggaaatcaatgacgcatttggctcaattgatattcttgtaaataatgcgggagtaattagagacaatttgttatttaaaatgacagacaatgattggcagcaagtgatggatgtccatttaaaaggagcttttcatgcaactcgagcagttcaacagtatatggtagagcaaaagtatggacgcattattaatatttcatcaacatcagcccttgggaatagaggtcaggcgaactatgctacggcaaaagctggattacaaggactgacgaaaacattatccattgaattagggaaatttggtataactgcaaatgctgttgcgcctggctttattgaaacggatatgacgaaagcaactgctgctagagttggtattccatttgatgattttgtaaaaggaagtgtgagtcaaattccagtgggaagaagtggaaagccagaggatattgcgaatgcagtggcattttttgcggatgaaaaatcatcatttgtgagtggtcaggtaatctatgttgcgggcggaccaaaagcataa

SEQ ID NO: 7239 - protein, 254 aa, Oceanobacillus iheyensis
MTNRFSGKVALITGGSRGIGKAIASLFAEEGAKVAIIDVNEEALSQSAKEFTEKGYTVYSKVADVVNAEEVELAVKEINDAFGSIDILVNNAGVIRDNLLFKMTDNDWQQVMDVHLKGAFHATRAVQQYMVEQKYGRIINISSTSALGNRGQANYATAKAGLQGLTKTLSIELGKFGITANAVAPGFIETDMTKATAARVGIPFDDFVKGSVSQIPVGRSGKPEDIANAVAFFADEKSSFVSGQVIYVAGGPKA

SEQ ID NO: 7240 - DNA, 765 bp, Leptospira interrogans
  CDS (1)..(765)
atgatcgatttaaaaggaaaaaacgccgtagttaccggagccgctcgtgggatcggaaagtcaacggctttaactcttgcaaaagcaggagcaaatttagtaatcgcggacttaaacgaagaatctagtaaagcgaccgcagatgaaatttcaaaacagactggtgtaaaggcgattggaatcggaacgaacgtctcggatgtagattctgcagcaaaggcaattcaagcgtgtgtagatgaatttggatctgtagacatccttgtaaataacgcaggtattacaaaagacactcttcttatgagaatgaaaaaggagcagtgggatgctgtaattgctgtaaatctcaccgggaccttcaattgtacacaggccgctattaagtttatgatgaaaaatccaaatggaggatctattatcaatctatcatccattgctggggtaaacggaaacataggacagacaaattattctgcatctaaagcaggagtcattggttttacaaaagcggttgcattggaaatggcttctcgcaaggttcgttgtaatgcaattgcacccggctttatcgctactgaaatgacggacgcgattcctgaaaagattaggactgctatggttgcggcgattcctttaaaaagggcgggacaaccggaagatattgctaacacaatcgcatttttggcttccgatatttcttcttttatcactggtcaagtgattgaagtgaatggtggaggtttcttaccaggagcaaccgcctaa

SEQ ID NO: 7241 - protein, 254 aa, Leptospira interrogans
MIDLKGKNAVVTGAARGIGKSTALTLAKAGANLVIADLNEESSKATADEISKQTGVKAIGIGTNVSDVDSAAKAIQACVDEFGSVDILVNNAGITKDTLLMRMKKEQWDAVIAVNLTGTFNCTQAAIKFMMKNPNGGSIINLSSIAGVNGNIGQTNYSASKAGVIGFTKAVALEMASRKVRCNAIAPGFIATEMTDAIPEKIRTAMVAAIPLKRAGQPEDIANTIAFLASDISSFITGQVIEVNGGGFLPGATA

SEQ ID NO: 7242 - DNA, 780 bp, Leptospira interrogans
  CDS (1)..(780)
atgagggaaatcatgtctaaacagttcgaaggaaaagtagcactcgttaccggagcggcgtctcctcgcggtctcggaagagcgatcgcaaatacaatcgctaaagaaggaggcgacatagtactagtcgaccttaacaaagaacagatagaacaagcggcggctgatgtagccaaagaatttggagtaaaaactttaggactttcttgtaacgtcactaaaccggaggactgcgattctgtcattgccggagtaaaagaaaaatttggaaaactagacttcctcgttaacaatgccggagttctcaaggataatctttttatacgtatgtccgaacaagaatttgattttgttttagacgtaaacttgaaaggcgtttttttgatgactaagtatgcttctaaacttcttcttaaagcagagtctggaaggattgtaaacatttcttctgtttccggtcttactggacaaccgggacaagcaaactattcttcctcaaaggcgggagtgattgcattgacaaaagttgcggcgagagaatttgcaggaagaaatgttctagtcaatgcagtttgtcccggttacgttcaaaccgatatgactgcatctttgccagaagaagttcaaaagaaactgaccgatcctgcttttattcctcttagaaggccggggacacaacaagagattgcaaatgccgtgaagtttttcttaagcgatcaatccaattacattaccggaacttatttaagagttgatggtggtgcagcaatcggtatgtaa

SEQ ID NO: 7243 - protein, 259 aa, Leptospira interrogans
MREIMSKQFEGKVALVTGAASPRGLGRAIANTIAKEGGDIVLVDLNKEQIEQAAADVAKEFGVKTLGLSCNVTKPEDCDSVIAGVKEKFGKLDFLVNNAGVLKDNLFIRMSEQEFDFVLDVNLKGVFLMTKYASKLLLKAESGRIVNISSVSGLTGQPGQANYSSSKAGVIALTKVAAREFAGRNVLVNAVCPGYVQTDMTASLPEEVQKKLTDPAFIPLRRPGTQQEIANAVKFFLSDQSNYITGTYLRVDGGAAIGM

SEQ ID NO: 7244 - DNA, 750 bp, Corynebacterium efficiens
  CDS (1)..(750)
atgaactcactcaacggacgcatctgcattgtcaccggcgcggcacagggaatcggcaagggcatcgccgagcgcctggccgccgagggcgccaccgtcgtggtcgccgacctcaacggcgaggccgccagcgccaccgccgcggaactgggcaacgactccatcggtgtcaccgtcgacatctccgaccgcaccgccgtggacgcgatggtcgccgaggcgaaggacaagtacgggcgtatcgacgtcctggtcaacaacgccggctgggacaagatcggtcccttcctggagatcgaaccggagatctgggaccgcatcatcaacatcaacctctacggcaccctgcactgctcccagtccgtggcacgcatcatggtggagcaggagggtgggggaaccatcatcaacatcggttccgatgccgcccgcgtgggttcctccggtgaggccgtctactccgcctgcaagggtggcgtggtctccttcaccaagacgcttgcccgtgaactcgcccgttatggggtcaccgcgaatgccatctgccccggacccgcggataccccgctgttcgcccagatctccgaggagaacccgaagctgcgcaccgccctggagaaggccatcccgctgcgtcgtctggcgcagccggaggacctggccaacgccgtcgccttcttcgcctcccctgagtcctcctacatcaccggtcagacgctgtccgtctccggtggcctgaccatgatctaa

SEQ ID NO: 7245 - protein, 249 aa, Corynebacterium efficiens
MNSLNGRICIVTGAAQGIGKGIAERLAAEGATVVVADLNGEAASATAAELGNDSIGVTVDISDRTAVDAMVAEAKDKYGRIDVLVNNAGWDKIGPFLEIEPEIWDRIININLYGTLHCSQSVARIMVEQEGGGTIINIGSDAARVGSSGEAVYSACKGGVVSFTKTLARELARYGVTANAICPGPADTPLFAQISEENPKLRTALEKAIPLRRLAQPEDLANAVAFFASPESSYITGQTLSVSGGLTMI

SEQ ID NO: 7246 - DNA, 777 bp, Streptomyces roseochromogenes subsp
  CDS (1)..(777)
atgaccgggcccgccggatccccagtggcttacgagccggtcgccatggtcaccggagccggccggggcatcggcgcggccacggccgagcgccttgccgcggagggcatggcggtgatcgtcgtggaccgcgccgaacaggacaccacagccaccgtctcagccatccgcgcggctggcggacgggcccgcgggatcggctgtgacgtcgccgtagcccacgcggtgacggccgcggtcgcctcggccgtcgaggagttcggtcacgtcgacgtgctggtgaactgcgccggggtcaaccaggatcggctgctgctcaccatgagcgaccaggagtgggacacggtcctggacgtcaacctcggcggcaccatgcgctgttcgttcgcggtcggcaggcacatgtgccggcaggggcacggccggatcatcaacttcagttctgtggccgcgcgcggcaatgcaggtcagaccaactatgcgaccgcgaagggcgcgattgccgggttcacccgcacgctcgcggccgaactgggtcctcacggcgtgacggtcaacgcgatcgcaccgggcttcgtggccacgccgatggtggacgagctgatcgaacggctcggcgtggaccgggacacggccctgctggaggcggcgatgtcctcggccgtgggccggatcgggacgcctgaggaaatcgccgcggcggtggcctttgtcacccggcaggaatcgggctacctcacaggggagaccatccacgtggaaggtggtcggcgatga

SEQ ID NO: 7247 - protein, 258 aa, Streptomyces roseochromogenes subsp
MTGPAGSPVAYEPVAMVTGAGRGIGAATAERLAAEGMAVIVVDRAEQDTTATVSAIRAAGGRARGIGCDVAVAHAVTAAVASAVEEFGHVDVLVNCAGVNQDRLLLTMSDQEWDTVLDVNLGGTMRCSFAVGRHMCRQGHGRIINFSSVAARGNAGQTNYATAKGAIAGFTRTLAAELGPHGVTVNAIAPGFVATPMVDELIERLGVDRDTALLEAAMSSAVGRIGTPEEIAAAVAFVTRQESGYLTGETIHVEGGRR

SEQ ID NO: 7248 - DNA, 738 bp, Chlorobium tepidum
  CDS (1)..(738)
atgttcacaggaaaaaccgccgtcgtcaccggcgcggcacgaggcatcggccagtcgatcgccctcgatctcgccgccaaaggcgctgatcttgttattggcgacatcaaggcggagtggctgaccgaaaccgaagaggcgctcaaacagctcggcgcaaaagtgagctgcaaggagctcgatgtcaccagcaccgacgcgtgccagaaggttttcgacgaagtggctaaagagaatggccgcatcgacattctcgtcaacaacgcaggcatcacccgcgacggccttctgatgcgtatgagcgaagaggactgggacgccgtgctgacggtgaacctcaagggcgtcttcaactgcaccaaggcggtcacgcgcaccatgatgaagcagcgttccggctcgatcatcaacatcgcctcgatcatcggcctcatgggcaacgccggacaggccaactacgcggcttcgaaaggcggcgtcatcgccttcaccaagtcgattgccagggagctggcttcgcgcaatgtgcgggccaacgctatcgcccccggcttcatttcatcgaaaatgaccgacgccctctccgaagaggtgcgccagaagatgctcgaagccattccgctcggcgtttttggcacgccccagcatgttgccgacgcggtggcatttctcgccagcgaccagtcagcctacatcaccggtcaggtgctgagcgtcaacggcggcatgtacatgtaa

SEQ ID NO: 7249 - protein, 245 aa, Chlorobium tepidum
MFTGKTAVVTGAARGIGQSIALDLAAKGADLVIGDIKAEWLTETEEALKQLGAKVSCKELDVTSTDACQKVFDEVAKENGRIDILVNNAGITRDGLLMRMSEEDWDAVLTVNLKGVFNCTKAVTRTMMKQRSGSIINIASIIGLMGNAGQANYAASKGGVIAFTKSIARELASRNVRANAIAPGFISSKMTDALSEEVRQKMLEAIPLGVFGTPQHVADAVAFLASDQSAYITGQVLSVNGGMYM

SEQ ID NO: 7250 - DNA, 741 bp, Pseudomonas putida
  CDS (1)..(741)
atgacgaaacgcatagcgtacgtgacgggcggcatgggcggcattggcacaagcatctgccagcgtctgcataaggacggctatacggtcgtcgcgggttgcggcccgaactctccgcgccgtgtcaaatggctcgaggaacagaaggcgaacggctatgacttcatcgcgtccgagggcaacgtcggcgactgggagtccaccaagaacgccttcgacaaggtgaaggccgaagtcggcgaggtcgacatcctggtgaacaacgcgggcatcacgcgcgacgtcgtgttccgcaagatgacgcacgaggactggacggccgtcatcgacaccaacctgacgagcctcttcaacgtgaccaagcaggtggtcgacggcatggtggagcgcggtttcgggcggatcatcaacatttcgtcggtgaacggccagaaggggcagttcggccagacgaactactcgacggcgaaggccggcatccacggcttcacgatggcgctcgcgcaggaagtggcgaccaagggcgtgacggtcaacaccgtgtcgccaggctatatcggcacggacatggtcaaggcgatccgccccgaggtgctggagaagatcgtcgcgacgattccggtgcgccgtctcggccgcccggacgagatcggctcgatcgtgtcgtggctggcatcggaggaatcgggcttctcgaccggtgcggacttctcgctcaacggcgggctgcacatgggctga

SEQ ID NO: 7251 - protein, 246 aa, Pseudomonas putida
MTKRIAYVTGGMGGIGTSICQRLHKDGYTVVAGCGPNSPRRVKWLEEQKANGYDFIASEGNVGDWESTKNAFDKVKAEVGEVDILVNNAGITRDVVFRKMTHEDWTAVIDTNLTSLFNVTKQVVDGMVERGFGRIINISSVNGQKGQFGQTNYSTAKAGIHGFTMALAQEVATKGVTVNTVSPGYIGTDMVKAIRPEVLEKIVATIPVRRLGRPDEIGSIVSWLASEESGFSTGADFSLNGGLHMG

SEQ ID NO: 7252 - DNA, 723 bp, Paracoccus zeaxanthinifaciens
  CDS (1)..(723)
atgtccaaggtagcactggtcaccggcggatcgcgcggcatcggcgccgagatctgcaaggcgcttcaggccgcaggctataccgtcgccgcgaactatgccggcaatgacgacgcggccaaggccttcaccgaggaaaccggcatcaagacctacaagtggtcggtcgccgattacgatgcctgcaaggccggcatcgcccaggtcgaagaggatctgggcccgatcgccgtgctgatcaacaatgccgggatcacccgcgacgcgcccttccacaagatgacgcccgagaagtggaaggaggtcatcgacaccaacctgaccggcaccttcaacatgacccatccggtctggccgggcatgcgcgaacgcaagttcggacgcgtcatcaacatcagctcgatcaacgggcagaagggccagttcgggcaggcgaactatgccgcggccaaggcgggcgacctgggcttcaccaagtcgctggcgcaggaaggcgcgcgcaacaacatcaccgtcaacgcgatctgccccggctatatcgcgacggacatggtgatggccgttcccgaacaggtccgcgaggggatcatcgcgcagatccccgtcggccgcttgggcgagccgtccgagatcgcgcgctgcgtggtgttcctggcctccgacgatgcgggcttcgtcacaggctcgaccatcacggcgaatggcggccagtactacatctga

SEQ ID NO: 7253 - protein, 240 aa, Paracoccus zeaxanthinifaciens
MSKVALVTGGSRGIGAEICKALQAAGYTVAANYAGNDDAAKAFTEETGIKTYKWSVADYDACKAGIAQVEEDLGPIAVLINNAGITRDAPFHKMTPEKWKEVIDTNLTGTFNMTHPVWPGMRERKFGRVINISSINGQKGQFGQANYAAAKAGDLGFTKSLAQEGARNNITVNAICPGYIATDMVMAVPEQVREGIIAQIPVGRLGEPSEIARCVVFLASDDAGFVTGSTITANGGQYYI

SEQ ID NO: 7254 - DNA, 714 bp, Homo sapiens
  CDS (1)..(714)
atggacaaagtgtgtgctgtttttggaggctcccgaggcattggcagagctgtggcccagttaatggcccggaaaggctaccgactggcggtcattgccagaaacctggaaggggccaaagccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccaggatttgtacacacagatatgacgaaagacttgaaagaagaacatttaaagaaaaatattcctcttgggaggtttggagaaactattgaggtggcacatgcggttgtgtttcttttagaatcaccgtatattacagggcatgttctggtagtggatgggggattacaactcattttgtaa

SEQ ID NO: 7255 - protein, 237 aa, Homo sapiens
MDKVCAVFGGSRGIGRAVAQLMARKGYRLAVIARNLEGAKAAAGDLGGDHLAFSCDVAKEHDVQNTFEELEKHLGRVNFLVNAAGINRDGLLVRTKTEDMVSQLHTNLLGSMLTCKAAMRTMIQQQGGSIVNVGSIVGLKGNSGQSVYSASKGGLVGFSRALAKEVARKKIRVNVVAPGFVHTDMTKDLKEEHLKKNIPLGRFGETIEVAHAVVFLLESPYITGHVLVVDGGLQLIL

SEQ ID NO: 7256 - DNA, 741 bp, Xanthomonas campestris
  CDS (1)..(741)
atgacgcttcgcatcgcatacgtcaccagtggcatgggcagtgtgggtactgcgatctgccagaaactggcgcgcaccgggcacacggtggtggccgggtgtggtcctaattcgccgcgcaaatcggcgtggctgcgtgagcaacgcgagctcgggttcgacttcgttgcctccgaaggcaacgccgccgattgggattccaccatggctgcgtttgccaaggtcaaggcggaggtcggcgagatcgatgtgctggtcaacaacgccggtggcagccgcgacacgctgttccgccagatgagccgcgacgactggaatgcggtgattgccagcaacctgcattcgctgttcaacatcaccaagcaggtggtggacggcatgacctcgcgcggctgggggcgcatcgtcaacattgggtcggtcagcgcgcacaagggccagatcgggcagatcaacttcgccaccgccaaggcggccatgcatgggttcagccgtgcgctggcgcaggaagtggcctcgcgcggtgtcaccgtcaacaccatttcgcccggctatatcgccagcgcttccatcagcaatttcccaccggatgtgctggaccgcctggccacctcggtgccggtgcgccggctcggcaagccggccgaagtggccggcctgtgcgcatggctggcctccgacgacgccgcgtatgtgaccggcgcggactatgcggtcaacggcggtttgtacatgggctag

SEQ ID NO: 7257 - protein, 246 aa, Xanthomonas campestris
MTLRIAYVTSGMGSVGTAICQKLARTGHTVVAGCGPNSPRKSAWLREQRELGFDFVASEGNAADWDSTMAAFAKVKAEVGEIDVLVNNAGGSRDTLFRQMSRDDWNAVIASNLHSLFNITKQVVDGMTSRGWGRIVNIGSVSAHKGQIGQINFATAKAAMHGFSRALAQEVASRGVTVNTISPGYIASASISNFPPDVLDRLATSVPVRRLGKPAEVAGLCAWLASDDAAYVTGADYAVNGGLYMG

SEQ ID NO: 7258 - DNA, 753 bp, Xanthomonas campestris
  CDS (1)..(753)
atggagttgcgcatgacatctcgcgtcgcgttggtcaccggcggcaccggcggtatcggtaccgccatctgcaagcgcctggccgaccagggtcaccgggtcgccagcaatttccgcaacgaagaaaaagcacgcgagtggcagcagcgcatgcaggtccaaggctacgaattcgccctgtttcgtggggatgtggcctcgtccgaccatgcgcgcgcgctggtggacgacgtggaagccgcgctcgggccgatcgaagtgctggtcaacaacgccggcattacccgcgacaccacgttccatcgcatgaccgccgagcagtggcacgacgtcatcaacaccaatctcaattcggtgttcaacgtgacccgcccggtgatcgaaggcatgcgcaagcgcggctggggccgggtgatccagatcagctccatcaacgggctcaaaggccagtacggccaagccaattacgccgccgccaaggccggcatgcatggtttcaccatctcgctggcgcgcgaaaatgcggccttcggcatcaccgtcaacacggtgtcgccgggctacgtggccaccgacatggtgatggctgtgccggaagaagtgcgcgccaagatcgtcgccgatatccccaccggccggcttgggcggccggaggaaattgcgtatgcagtggcgtttctggtggccgaagaggcggcgtggattaccggctccaacctggacatcaatggcggccaccacatgggctggtaa

SEQ ID NO: 7259 - protein, 250 aa, Xanthomonas campestris
MELRMTSRVALVTGGTGGIGTAICKRLADQGHRVASNFRNEEKAREWQQRMQVQGYEFALFRGDVASSDHARALVDDVEAALGPIEVLVNNAGITRDTTFHRMTAEQWHDVINTNLNSVFNVTRPVIEGMRKRGWGRVIQISSINGLKGQYGQANYAAAKAGMHGFTISLARENAAFGITVNTVSPGYVATDMVMAVPEEVRAKIVADIPTGRLGRPEEIAYAVAFLVAEEAAWITGSNLDINGGHHMGW

SEQ ID NO: 7260 - DNA, 744 bp, Xanthomonas campestris
  CDS (1)..(744)
atgagcaagccattgcagggcgagatcgctctggtcaccggcgccagccgcggcatcggcgcggccatcgccgatacgctggccgcccagggtgccacggtcatcggcacggccacctccgcctccggggccgctgccatcggcgagcgcctggctgccaacggcggccacggccgggagctcaatgtcaccgatgcggccgcggtcgatgccttgatcgatgcgatcggcaaggagttcggtgcggtctcgatcctggtcaacaacgccggcatcacccgcgacaacctgctgatgcggatgaaggacgacgattggcaggcgatcatcgacaccaacctgaccagtgtcttccggacctccaaggcggtgatgcgcggcatgatgaaagcgcgcaagggtcgcatcatcaacatcgcctcggtggtgggtgtgaccggtaatccgggccagaccaactacgcggcggccaaggccggcatcattgcgttttccaagtcgctggccaaggaaatcggctcgcgcgggatcactgtcaatgtggtcgcgcccggcttcatcgataccgatatgaccaaggcgctgccggaagatgccaagacagcgttgctgcagcagatcgcgctgggccatctggggcagccggacgacatcgccaatgcggtggcattcctggctggcccgcccgcccgttacatcactggtgagaccctgcacgtcaacggcggcatgtacatgccgtga

SEQ ID NO: 7261 - protein, 247 aa, Xanthomonas campestris
MSKPLQGEIALVTGASRGIGAAIADTLAAQGATVIGTATSASGAAAIGERLAANGGHGRELNVTDAAAVDALIDAIGKEFGAVSILVNNAGITRDNLLMRMKDDDWQAIIDTNLTSVFRTSKAVMRGMMKARKGRIINIASVVGVTGNPGQTNYAAAKAGIIAFSKSLAKEIGSRGITVNVVAPGFIDTDMTKALPEDAKTALLQQIALGHLGQPDDIANAVAFLAGPPARYITGETLHVNGGMYMP

SEQ ID NO: 7262 - DNA, 732 bp, Xanthomonas axonopodis
  CDS (1)..(732)
atgaactcatctgcacgacgcgcactcgttaccggcggcagcggcgatcttggcggtgcgatctgccgccacctggctgcgcagggccggcatgtgatcgtgcacgccaacggcaacctggcgcgtgccgacgaggtggttgccgcgatcgtggccgatggcgggagcgcacaggcagtggccttcgatgtggccgacgcgcaggcaagttcggcggcgctggagagcttgctggaagctggcccgatccagatcgtggtcaacaacgcgggcatccacgacgacgcgccgatggcaggcatgaatgtcgagcagtggcatcgcgtcatcgacgtgtcgctgcacggttttttcaatgtcacccagccgttgctgctgccgatggcgcgcacgcgttggggccgcgtcgtcagcgtgtcgtcggtggcggccgtgctgggtaatcgcgggcagaccaactacgccgccgccaaggccgccttgcatggtgccagcaagtcgctctcgcgcgaaatggccagccgcggcatcgcggtgaatgtggtcgcgcccggcgtgatcgaaagcgacatggtcggcgacagttttgcgccggaggcgatcaagcagttggtgcccgccggccgcgtcggcaaacccgatgaagtggccgcgctggtcgcctttctgtgctcggacgcggccggctacatcaatggccaggtgatcggcgtcaatggtgggatgggctga

SEQ ID NO: 7263 - protein, 243 aa, Xanthomonas axonopodis
MNSSARRALVTGGSGDLGGAICRHLAAQGRHVIVHANGNLARADEVVAAIVADGGSAQAVAFDVADAQASSAALESLLEAGPIQIVVNNAGIHDDAPMAGMNVEQWHRVIDVSLHGFFNVTQPLLLPMARTRWGRVVSVSSVAAVLGNRGQTNYAAAKAALHGASKSLSREMASRGIAVNVVAPGVIESDMVGDSFAPEAIKQLVPAGRVGKPDEVAALVAFLCSDAAGYINGQVIGVNGGMG

SEQ ID NO: 7264 - DNA, 744 bp, Xanthomonas axonopodis
  CDS (1)..(744)
atgagcaagcccctgcagggcgaaatcgccctcgtcaccggcgccagccgcggcatcggtgcggccattgccgataccctggccgcccatggcgccacggtcatcggcaccgccacctcggcttccggcgctgcggcgatcggcgagcgtctggccgcccacggcggacacggtcgtgaactgaacgtcaccgacgcggctgcagtcgatggcgtgatcgatgccatcggcaaggagttcggcgccatctcgatcctggtcaacaacgccggcatcacccgcgacaacctgttgatgcggatgaaggacgacgactggcaggcgatcatcgacaccaacctgaccagcgtgttccgcacctccaaggcggtcatgcgcggcatgataaaggcgcgcaagggccgcatcatcaatatcgcctcggtagtgggtgtgaccggtaatcctgggcagaccaactatgccgccgccaaggccggcatcatcgcgttctccaaatcgctggccaaggaaatcggctcgcgcggagtgaccgtgaatgtggtggcgcccggtttcatcgataccgacatgaccaaggcgctgccggacgaggccaggaccgccttgctgcagcagattgcgctgggtcatctgggcgagccggaagacatcgccaatgcggtggcgtttctggccggcccgacggcccgctacatcaccggtgagaccctgcacgtcaacggtggcatgtacatgccgtaa

SEQ ID NO: 7265 - protein, 247 aa, Xanthomonas axonopodis
MSKPLQGEIALVTGASRGIGAAIADTLAAHGATVIGTATSASGAAAIGERLAAHGGHGRELNVTDAAAVDGVIDAIGKEFGAISILVNNAGITRDNLLMRMKDDDWQAIIDTNLTSVFRTSKAVMRGMIKARKGRIINIASVVGVTGNPGQTNYAAAKAGIIAFSKSLAKEIGSRGVTVNVVAPGFIDTDMTKALPDEARTALLQQIALGHLGEPEDIANAVAFLAGPTARYITGETLHVNGGMYMP

SEQ ID NO: 7266 - DNA, 744 bp, Thermoanaerobacter tengcongensis
  CDS (1)..(744)
atggtagatgaaaagagggtggcatttgtcacaggaggttctagaggtataggcagagctattgctgtaagacttgctaaagatggctttaatattgctataacttatgtaaaggacgataagagtgcagaagaagttgttgaagaggtaaaaaaacacggagttgatgctctagcaataaaatgcgatgtttccaaataccatgaggttgaaaaagctgtagaaaaggttatagaggagtttggaagcatagatgtggtagttaacaatgcaggaattacaaaggacaatttgattttaaaaatggaagaagaagagtgggaccaagtaatagatgtaaatctcaaaggagcctttaatgtaataaaatttgcttcaaagtatatgataaaaaagagaaaggggaaaataataaacataagttctgtggtggggcttatgggaaatgtaggacaggctaattatgctgcttctaaagcaggaatcataggacttacaaagtcagtagctaaagagcttgctagcagaggaataactgtaaatgctgtagctcctggttttattgaaactgacatgaccaacgtattgaaagaagacataaaagaagcaatgctaaaaagcattcccttaaaaagggcaggaaaacctgaagaagttgcagaagttgtggcttttttggcaagctcagcctcagattacattactgggcaagtaataaatgttgacggaggaatggttatgtaa

SEQ ID NO: 7267 - protein, 247 aa, Thermoanaerobacter tengcongensis
MVDEKRVAFVTGGSRGIGRAIAVRLAKDGFNIAITYVKDDKSAEEVVEEVKKHGVDALAIKCDVSKYHEVEKAVEKVIEEFGSIDVVVNNAGITKDNLILKMEEEEWDQVIDVNLKGAFNVIKFASKYMIKKRKGKIINISSVVGLMGNVGQANYAASKAGIIGLTKSVAKELASRGITVNAVAPGFIETDMTNVLKEDIKEAMLKSIPLKRAGKPEEVAEVVAFLASSASDYITGQVINVDGGMVM

SEQ ID NO: 7268 - DNA, 732 bp, Fusobacterium nucleatum
  CDS (1)..(732)
atggaggacttaatgaatagactagaaggaaaagttgcagttgttactggaagtgcaagagggataggaagagctattgtcgaaaaacttgcagcacacggagcaaaaatggttatctcttgtgatatgggggaaacatcttatgaacaaggaaatgtagttcataaaattttaaatgttacagacagagaagctataaaagcatttgtagatgaagtcgaaaaggaatatggaaaaatagatattcttgtaaataatgcaggaattacaaaagatggattattaatgagaatgacagaagatcaatgggatgcagttataaatgtaaacttaaaaggagttttcaatatgacacaagctgtatcaagatcaatgttaaaagctagaaaaggttctattattactctatcatcagttgttggattacatggaaatgcaggacaaacaaactatgcagcaacaaaaggtggagtagtagcaatgtctaaaacttgggcaaaagaatttggtggaaggaatgtaagagctaactgtgttgctcctggttttattcaaacacctatgactgatgtattgtcagaagatacaataaaaggaatgttagatgctactcctcttggaagacttggacaagttgaagatatagcaaatactgtattatttttagcaagtgatgaatcttcatttataactggagaagtaatttctgtatctggtggtttgatgctttaa

SEQ ID NO: 7269 - protein, 243 aa, Fusobacterium nucleatum
MEDLMNRLEGKVAVVTGSARGIGRAIVEKLAAHGAKMVISCDMGETSYEQGNVVHKILNVTDREAIKAFVDEVEKEYGKIDILVNNAGITKDGLLMRMTEDQWDAVINVNLKGVFNMTQAVSRSMLKARKGSIITLSSVVGLHGNAGQTNYAATKGGVVAMSKTWAKEFGGRNVRANCVAPGFIQTPMTDVLSEDTIKGMLDATPLGRLGQVEDIANTVLFLASDESSFITGEVISVSGGLML

SEQ ID NO: 7270 - DNA, 747 bp, Azoarcus evansii
  CDS (1)..(747)
atgcagttgaaggacaaggttgcagtggtgacgggcgcagggcagggcatcggcgcggccgttgcaagggcttacgcgcgagagggcgcgaaggtcgcggtgatcgatatcgatcaggcgaccgcggaccgtatggccggacagatcgtcgaggccggcggacaggcgatcggtgtggcgtgcaacgtcgcggatcgcgatcacgtcgaggcgatggcagccaaggtgaatgccgaatggggccgcatcgacatcctcgtcaataacgccggcatcacgcgcacggcgatgctcaacaagatgacgcccgagcagtggaaccaggtgctggccgtccatctcaccggtgcgttcaactgtctgcaggcagtggtcggcggcatgatcgagcgtcagtacggccgcatcatctacgtgacctccaccgccggcgtgctcggcacgatcggccagatcaactacagcgccgcgaaggccggcgtgctcggcatgaccaagagcacggcgaaggagctcgcgcgctacggcatcaccgcgaacgcgatcgcaccgggagcggcaacgccgatgaccgagacgatccgcaccgatgagcgcttcaaggaaaagtacctcgaccggattcccctcggacgctgggccgagccggaggagatcacgccggtgttcgtgttcttcgcctccgatgcgtcgagctatgtgaccggacagatcctggcggccgatggcggaatgacgatccactga

SEQ ID NO: 7271 - protein, 248 aa, Azoarcus evansii
MQLKDKVAVVTGAGQGIGAAVARAYAREGAKVAVIDIDQATADRMAGQIVEAGGQAIGVACNVADRDHVEAMAAKVNAEWGRIDILVNNAGITRTAMLNKMTPEQWNQVLAVHLTGAFNCLQAVVGGMIERQYGRIIYVTSTAGVLGTIGQINYSAAKAGVLGMTKSTAKELARYGITANAIAPGAATPMTETIRTDERFKEKYLDRIPLGRWAEPEEITPVFVFFASDASSYVTGQILAADGGMTIH

SEQ ID NO: 7272 - DNA, 741 bp, Clostridium perfringens
  CDS (1)..(741)
atgttaaaagataaagtagcaatagtaactggtggaacaagaggaattggaagagcaatcgctttaaaattagcagatcaaggagctaatattgttataaattatagaaattctgataaagaggcagaagaattaaaagccattttagaagaaaaaggggtaaaagttcttactgtaaaatgtgatataagtaattttgaagattctaaaaatcttatggataaatgcaaggaagtatttggaaagatagatatacttgtaaataatgcaggtataacaaaggatactttaattatgagaatgaaggaagaagactttgataatgtaatagatgtaaacttaaaaggtacatttaattgtgcaaagcatgcttctgccataatgttgaaacaaagatttggtaaaattataaacatgacttctgttgtaggtatagctgggaatgctggtcaagtaaattattcagcatcaaaagctggtgttataggattaactaaatctttagctaaagaattaggaagtagaggaataactgtaaatgctgtagcacctggatttataaatactgatatgacagcttctttatctgaaaaagttaaagaggaagcttctaaaaatattcctttaaaaagattaggagaccctgaagacgttgctaacttagtaggattcttagcatcagatgcagcaaattatataacaggtcaagtcataaatgtagatggcggaatggtaatgtag

SEQ ID NO: 7273 - protein, 246 aa, Clostridium perfringens
MLKDKVAIVTGGTRGIGRAIALKLADQGANIVINYRNSDKEAEELKAILEEKGVKVLTVKCDISNFEDSKNLMDKCKEVFGKIDILVNNAGITKDTLIMRMKEEDFDNVIDVNLKGTFNCAKHASAIMLKQRFGKIINMTSVVGIAGNAGQVNYSASKAGVIGLTKSLAKELGSRGITVNAVAPGFINTDMTASLSEKVKEEASKNIPLKRLGDPEDVANLVGFLASDAANYITGQVINVDGGMVM

SEQ ID NO: 7274 - DNA, 741 bp, Ralstonia solanacearum
  CDS (1)..(741)
atgaccaaacgcatcgcatacgtcaccggcggcatgggcgggatcggtacggcgatttgccagcgcttggcgcgcgacgatttcatcgtcgtcgcggggtgcggcccgaattctccgcgcaaggacaaatggctcgagcagcagcgcgagctgggcttcgatttcatcgcctcggaaggcaacgtcgcggactgggattcgagcaaggctgcgttcgacaaggtcaaggccgaagtcggcgaggtcgatgtgctgatcaacaatgccggcatcacccgcgacgtggtgttccgcaagatgacccggtcggactgggacgcggtgatcggcaccaacctgacgtcgctgttcaacgtgaccaagcaggtgatcgacggcatggtcgaccggggctggggccgcatcgtcaacatctcgtcggtgaacggccagaagggccagttcggccagaccaactactccaccgccaaggccggcctgcacggcttcaccatggcgctggcgcaggaggtggcgaccaagggggtgacggtcaacaccgtgtcgccgggctatatcgccaccgacatggtgaaggcgatccggcaggacgtgctcgacaagatcatcggcacgattccggtcaagcgcctgggcgatccgaatgagatcgcctcgatctgcgcctggctggcttccgaggaatccggcttctcgaccggcgcggacttttcgctcaacggcggcctgcacatgggctga

SEQ ID NO: 7275 - protein, 246 aa, Ralstonia solanacearum
MTKRIAYVTGGMGGIGTAICQRLARDDFIVVAGCGPNSPRKDKWLEQQRELGFDFIASEGNVADWDSSKAAFDKVKAEVGEVDVLINNAGITRDVVFRKMTRSDWDAVIGTNLTSLFNVTKQVIDGMVDRGWGRIVNISSVNGQKGQFGQTNYSTAKAGLHGFTMALAQEVATKGVTVNTVSPGYIATDMVKAIRQDVLDKIIGTIPVKRLGDPNEIASICAWLASEESGFSTGADFSLNGGLHMG

SEQ ID NO: 7276 - DNA, 750 bp, Ralstonia solanacearum
  CDS (1)..(750)
atgacccaagcattgaacaaccaggtcgctctcgtcaccggcgcatcgcgcggcatcggccgggcgatcgccctggagctggcgcgccagggggccaccgtggtcggcacggccacctccgaggcaggcgcccaggcgatttccgcctactttgccgaagcgggtgtcaagggcgccggggtggtgctcaacgtcaacgatgcggcgcgctgcgaagccgtgatcgacgaagccatcaagacacacggcggcctgaatatcctcgtgaacaatgccggcatcacccaggacaacctggcgatgcgcatgaaggacgacgaatggatggccgtcatcgacaccaacctgagcgccgttttccgcttgtcccgcgccgtgctgcgtccgatgatgaaggcgcgtggcggtcgtatcatcaacatcacctcggtggtgggctcggccggcaacccgggccaggccaactatgcggccgccaaggcgggcgtggaaggcatggcacgggcgatggccaaggaaatcggcagccgtaacatcacggtcaacagcgttgcgcccggtttcatcgataccgacatgacgaaggtgctgtcggacgagcagcataccgcgctgaaggcgcagattccgctcggccgcctgggcatgccggaagacattgccaatgcggttgcttttctggcgtcaccggcggcgggctacatcacgggcgcgacgctgcacgtcaacggcggcatgtacatgggataa

SEQ ID NO: 7277 - protein, 249 aa, Ralstonia solanacearum
MTQALNNQVALVTGASRGIGRAIALELARQGATVVGTATSEAGAQAISAYFAEAGVKGAGVVLNVNDAARCEAVIDEAIKTHGGLNILVNNAGITQDNLAMRMKDDEWMAVIDTNLSAVFRLSRAVLRPMMKARGGRIINITSVVGSAGNPGQANYAAAKAGVEGMARAMAKEIGSRNITVNSVAPGFIDTDMTKVLSDEQHTALKAQIPLGRLGMPEDIANAVAFLASPAAGYITGATLHVNGGMYMG

SEQ ID NO: 7278 - DNA, 717 bp, Ralstonia solanacearum
  CDS (1)..(717)
atgcgtgcgctcgtaaccgggggcagcggtgcaatcgggcaggccgtcagcgaggcgctggcaagggccgggcacgaagtctgggtgcatgcgaaccgcaatctggagcaggctgaagccgtcgcgcagcggatcgtcgcggccggcggcaccgcgcatgccatcgcattcgacgtgaccgacgcgcaggccaccgaggccgccctggcgcccgtgctcgacggcgcgcccgtgcagattctcgtcaacaacgccggcgtccacgacgatgcgccgatggccggcatgacgcagcagcaatggcgccgcgtcatcgacgtctcgctcaatggcttcttcaatgtcacgcagccgctgctgatgccgatgatccgcacccgctgggggcgcatcatcaacatggcctcggtggccggcgtgatgggcaatcgcgggcaggccaactatgcggcggccaaggccggcctgatcggcgcgaccaaatcgctggcgcaggagctggcctcgcgcggcatcaccgtgaatgcggtggcgcccggcatcatcgcttcgccgatggccggggaggcgtttccggccgagcgcatcaagcagctggtgccggccgggcgcgcgggccagcccgacgaggtcgcgggcatggtggcgtacctggcatcggatgcggccgcctatgtcacggggcaggtcctctcgatcaacggcggactggcctga

SEQ ID NO: 7279 - protein, 238 aa, Ralstonia solanacearum
MRALVTGGSGAIGQAVSEALARAGHEVWVHANRNLEQAEAVAQRIVAAGGTAHAIAFDVTDAQATEAALAPVLDGAPVQILVNNAGVHDDAPMAGMTQQQWRRVIDVSLNGFFNVTQPLLMPMIRTRWGRIINMASVAGVMGNRGQANYAAAKAGLIGATKSLAQELASRGITVNAVAPGIIASPMAGEAFPAERIKQLVPAGRAGQPDEVAGMVAYLASDAAAYVTGQVLSINGGLA

SEQ ID NO: 7280 - DNA, 1062 bp, Mus musculus
  CDS (66)..(776)
gtagctgtgtcttttattacaagttctgagtctcagggatccatcttgctggtccgcggtccaagatggacaaagtctgtgcggtttttggaggctcccgggggatcggcagggcggtagcccagctaatggcccagaagggttaccgtctggcgatcgtctccagaaacctggaagtggccaaagtcaccgccggcgagctcggcggaaaccacttggcatttaggtgtgatgttgccaaagaacaagatgttcagagtacatttcaagagatggagaaacatttaggtccagtaaatttcttggtaaatgcagccggtatcaacagaggcagtcttctagtaagaacaaagactgaagacatgatctctcagctgcacactaacctcctgggctccatgctgacctgtaaagctgccatgaagacaatgattcagcagggagggtctattgttaatgtgggaagtattattggtttgaaaggcaacgttggccagtctgcatacagtgccaccaaaggaggactcgttgggttttcacgctcgcttgctaaagaggttgcacggaagaaaatcagagtgaatgtggtggcaccaggatttattcgcacggatatgacaagacacttgaaagaagaacacttcaagaaaaacattcctcttgggaggtttggagaaactcttgaggtagcacatgccgttgtgtttcttttagagtcaccatacatcacaggccatgttcttatcgtggatggaggattgcagctcaccgtctaattagagatgatgttactgtgatggcgctttgggtcaagtacacatttccctattaatttgacaatctcatctatatgggtgacatttgctaatggaaacaaatcagctaacggatgctacaaaggattccatctttgtatgaacatgtctcaaaaaacaaagtgtgaccagttgtaaagggtgtgaattctctgtcttagaggccatggacatttttaagggttattgtaacacacctgtatcaagctggatattaaaggcatcaaccttcaaaaaaaaaaaaaaa

SEQ ID NO: 7281 - protein, 236 aa, Mus musculus
MDKVCAVFGGSRGIGRAVAQLMAQKGYRLAIVSRNLEVAKVTAGELGGNHLAFRCDVAKEQDVQSTFQEMEKHLGPVNFLVNAAGINRGSLLVRTKTEDMISQLHTNLLGSMLTCKAAMKTMIQQGGSIVNVGSIIGLKGNVGQSAYSATKGGLVGFSRSLAKEVARKKIRVNVVAPGFIRTDMTRHLKEEHFKKNIPLGRFGETLEVAHAVVFLLESPYITGHVLIVDGGLQLTV

SEQ ID NO: 7282 - DNA, 759 bp, Rhizobium meliloti
  CDS (1)..(759)
atgggaaccgctctactcgaggggaattttgccgtgatcaccggtgctgcatccaggcgcggcctgggcaaggccaccgccaggcttttcgccgaacatggcgccacggtcgccattctcgaccttgacgaggccgatgccagggaggcggccgccagcctcggtccccggcatgtcggcatggcatgtaatgtgaccgacctcgcgagcgttcgcaccgtcatggatgccttggtttcgcaatggggccggatcgacatcctcgtgaacaatgcggggatcacccagccgctgaagatcatggagatcgcgccggagaactacgatgccgtgctcgacgtgaacctgcgcggcacgctttactgcagccaggcggtgatccctcatatgcgatcgcgcaaacagggcaagatcgtcaacctttcctcggtctccgcgcagcgcggcggcggtatattcggcggtccacactattccgccgccaaggcgggcgtcctcggcctgacgaaagcgatggcccgcgagttggcacccgacaatgtgagggtcaacgcgatctgccccggtttcatcgcgaccgacatcacgggcggcctgctgacgccggagaaactggaggaaatcaaggcgggcattcccatggggcgcccgggaaccgcggatgatgtggccggttgcgcgctcttcctcgcctccgacctttcggcttacgtcaccggctcggaagtcgacgtgaacggcggctcgctgatccattga

SEQ ID NO: 7283 - protein, 252 aa, Rhizobium meliloti
MGTALLEGNFAVITGAASRRGLGKATARLFAEHGATVAILDLDEADAREAAASLGPRHVGMACNVTDLASVRTVMDALVSQWGRIDILVNNAGITQPLKIMEIAPENYDAVLDVNLRGTLYCSQAVIPHMRSRKQGKIVNLSSVSAQRGGGIFGGPHYSAAKAGVLGLTKAMARELAPDNVRVNAICPGFIATDITGGLLTPEKLEEIKAGIPMGRPGTADDVAGCALFLASDLSAYVTGSEVDVNGGSLIH

SEQ ID NO: 7284 - DNA, 910 bp, Azotobacter sp
  CDS (107)..(850)
aatcaatccccgtgagccacaacaccaatgacgctgtgcagcttacgtgctgcttcttgcagtcgtgagtcgccagggtctccgacaaaaaaaggaagggaaatctatgagcaatcaacgaattgcattcgtaacgggcggcatgggtggaatcgggacctcaatcagtcagcgcctttacaaggaaaatttcaaagtcatcgtcggatgcaccccacaatccaaacgcaaagatggctggctctccgcccagcgcgatagcggtttcagcttcgaagcctgtgaacatgacgtcaccgattgggaaagcacccagcgtgccttcgccgaactgcgcgaacgcgtcggcacaatcgatgtgctggtaaacaatgctggcattacccgcgacgccagcttccgcaagctcactccggaaaactggagtgcagtgatcaacaccaacctcaacggcatgttcaacaccaccaaacaggtcattgaagacatgctcggcaagggctggggccgcatcatcgacatctcctccatcaacggccagcgcggccagttcggccagaccaactactccgcggccaaagccggtattcatggcttcaccatggccctggcccgcgaagtggccagcaagggcgtgaccgtcaacacgatttcccctggctacatcctcaccgaaatgactggagccatgcgcccggaagttctcgaacagatcgctgccggcattccggtcggtcgccttggacagcccgaggaaatcgccagcatggttgcctggctggcctctgatgaggctgcctatgccactggcgccgacttctccatcaacggtggtctgaacatgcaatgacgcctgccgggaagctgctaggctttccgatcagacttccctattcatatgaggtagctt

SEQ ID NO: 7285 - protein, 247 aa, Azotobacter sp
MSNQRIAFVTGGMGGIGTSISQRLYKENFKVIVGCTPQSKRKDGWLSAQRDSGFSFEACEHDVTDWESTQRAFAELRERVGTIDVLVNNAGITRDASFRKLTPENWSAVINTNLNGMFNTTKQVIEDMLGKGWGRIIDISSINGQRGQFGQTNYSAAKAGIHGFTMALAREVASKGVTVNTISPGYILTEMTGAMRPEVLEQIAAGIPVGRLGQPEEIASMVAWLASDEAAYATGADFSINGGLNMQ

SEQ ID NO: 7286 - DNA, 942 bp, Streptomyces avermitilis
  CDS (1)..(942)
atgtccgaacagagcaggtccacgccgggtgacaaggtcgcgccgggtgacaaggtcgcgccgggcgaccaggccgcgccgggtgacaaggtcgcgccgggtgacaaggtcgcgccgggtgacaaggtcgcgccgggcgacaaggtcgcgccgggcgacaaggccgcgccgggcgacaaggtcgcgccgggcgaccaggccgcgccgggcgacaaggtcgcgctggtcaccggaggttcgcggggtatcggccgcgcggtcgtcgcgcggctggcgagcgacggctacgacatcggcttctgctaccgctccgacgaccaggcggcggccctggtggagaaggaggtgcgcgagctgggccgccgggtgctgtcccggcgcgtggacgtgacggaccgtacgcaggtacgggagttcgtcaccgcggccgaggaggaactcggccccgcctcggcggtggtcacctcggccggcatcacccgcgacagcccgctggtcctgatgccggacgaggactgggacgcggtgctgcgcaccaacctggacggcacctacaacctgtgccgtgcggtggccttcccgatgatcaagcggggcggcggggccgtggtcacgctctcctcggtggccggggtcgcgggcaacgcgggccagaccaactactccgcgtcgaagtccgggatcatcggcttcacccggtcgctcgccaaggagggcggccggcacgggatacgcgccaactcggtggccccgggcttcatcgacaccgacatgacctcggagctgccgccgaaggtggccaaggagatgctgggccggattccgctgaagcggttcgggcgaccggaggacgtggcggccctggtcgccttcctgctctcgtccgaggccgcgtacatcaccgggcaggtgttccaggtggacggcggtatcgcgctgtga

SEQ ID NO: 7287 - protein, 313 aa, Streptomyces avermitilis
MSEQSRSTPGDKVAPGDKVAPGDQAAPGDKVAPGDKVAPGDKVAPGDKVAPGDKAAPGDKVAPGDQAAPGDKVALVTGGSRGIGRAVVARLASDGYDIGFCYRSDDQAAALVEKEVRELGRRVLSRRVDVTDRTQVREFVTAAEEELGPASAVVTSAGITRDSPLVLMPDEDWDAVLRTNLDGTYNLCRAVAFPMIKRGGGAVVTLSSVAGVAGNAGQTNYSASKSGIIGFTRSLAKEGGRHGIRANSVAPGFIDTDMTSELPPKVAKEMLGRIPLKRFGRPEDVAALVAFLLSSEAAYITGQVFQVDGGIAL

SEQ ID NO: 7288 - DNA, 744 bp, Azotobacter vinelandii
  CDS (1)..(744)
atgagcaatcaacgaattgcattcgtcacgggcggcatgggcggaatcgggacagcaatcagccggcgcctctacaaggaaaacttcaccgtgatcgtcgggtgcactccgcaatccaaacgcaaagatggatggctcgcggcccagcgcgatagcggcttcacttttgaagtctgcgaacacgacgtaaccgattgggagagcactcagcgtgccttcgccgagttgcgcgaacgtgtggggaccattgacgtattggtgaacaatgccggtatcacccgggatgccagctttcgcaagctcactccggaaaactggcaagcagtgatcaacaccaacctcaatggcttgttcaataccaccaagcaagtcatcgaagacatgctcggcaagggctggggccgcgttatcaatatttcgtcgatcaacgggcagcgtggccagttcggtcagaccaactactctgccgccaaagcgggcatccacggcttcaccatggccctggctcgcgaagtggccagcaagggcataaccgtcaacaccatctctcccggctacatcctcaccgaaatgaccggcgccatgcggccggaagttctcgagcagatcactgccggcattccggtcggccgcctcggccagcccgaggaaatcgccagcacggtcgcctggttggcctccgaggaagcggcctatgccaccggcgccgacttttccatcaacggcggtctgaacatgcaatga

SEQ ID NO: 7289 - protein, 247 aa, Azotobacter vinelandii
MSNQRIAFVTGGMGGIGTAISRRLYKENFTVIVGCTPQSKRKDGWLAAQRDSGFTFEVCEHDVTDWESTQRAFAELRERVGTIDVLVNNAGITRDASFRKLTPENWQAVINTNLNGLFNTTKQVIEDMLGKGWGRVINISSINGQRGQFGQTNYSAAKAGIHGFTMALAREVASKGITVNTISPGYILTEMTGAMRPEVLEQITAGIPVGRLGQPEEIASTVAWLASEEAAYATGADFSINGGLNMQ

SEQ ID NO: 7290 - DNA, 963 bp, Brassica napus
  CDS (1)..(963)
atggcaaccacagtcgcagcaacgaagctcacctccttgaaagccgtcaagaagctcgggttccgtgagatccgccaggtccgtcaatggtctccgcttcagtccgccatgcctcatttcggaatgctccgatgcggatcgcggcagtcattcgcaacctccactgttgtgaaagctcaggcgacagctgttgagcaatcgacaggggaagctgttccgaaagtggagtctccggtggttgttgtcactggtgcttcgagagggattggtaaagctattgctctttccttgggcaaagctggctgcaaggtgttggtgaactatgcaaggtcagcaaaggaggctgaggaagtttctaaacagattgaagcatatggaggccaggctattacttttgggggtgatgtctccaaagaggctgatgtggaagccatgatgaaaaccgctattgatgcatggggaaccattgatgtcgtcgtcaacaatgcaggaatcactcgggataccttgttgattcgcatgaagaagtcccaatgggatgaagtgattgatttgaatctcactggagtgtttctctgcacacaggcagcaacaaagatcatgatgaagaagagaaagggaagaatcatcaacatagcgtcagttgttggtctcattggtaatattggccaagcaaactacgctgctgctaaagctggagttattgggttttccaagactgccgccagagagggtgcgagcaggaatataaatgtcaatgtggtttgccctgggttcattgcgtctgacatgactgccaagcttggagaagacatggaaaagaaaatcttgggaacaatcccattaggacgatatggacaacctgaagatgtggctggcttggtagaattcttggctctcagccctgcagccagttacatcaccggacaggcattcaccattgatggaggtattgccatctag

SEQ ID NO: 7291 - protein, 320 aa, Brassica napus
MATTVAATKLTSLKAVKKLGFREIRQVRQWSPLQSAMPHFGMLRCGSRQSFATSTVVKAQATAVEQSTGEAVPKVESPVVVVTGASRGIGKAIALSLGKAGCKVLVNYARSAKEAEEVSKQIEAYGGQAITFGGDVSKEADVEAMMKTAIDAWGTIDVVVNNAGITRDTLLIRMKKSQWDEVIDLNLTGVFLCTQAATKIMMKKRKGRIINIASVVGLIGNIGQANYAAAKAGVIGFSKTAAREGASRNINVNVVCPGFIASDMTAKLGEDMEKKILGTIPLGRYGQPEDVAGLVEFLALSPAASYITGQAFTIDGGIAI

SEQ ID NO: 7292 - DNA, 1274 bp, Brassica napus
  CDS (73)..(1059)
acgaggttcgctagtacagacggcttttctctgatctccactctcgccgttaaacaacccattctccgttccatggccaccacctccatcgcaggacccagactcacttccttgaaaaccgccgccgggaagctcggctaccgtgagatctgtcatgtccggcaatgggctccggttcattctccgatgcctcatttcggaatgctgcgatgtggatcgcgacgcccgtttgcaacctcctcctccactgttgttcaagctcaagctcaagccactgctgctgagcaatcaacaggtgaagaagaagctgttccgaaagtggagtctccagttgtcgttgtcactggtgcctctcgaggcattggtaaagccattgctctttccctgggcaaagctggctgcaaggtcttggtgaattatgctaggtcagctaaggaggctgaacaagtttctaaacagattgaggcatacggtggccaggctattacttttgggggtgatgtctccaaagaggctgatgtggatgccatgatgaaaaccgctgttgatgcatggggaaccattgatgtcgtcgttaacaatgcaggaattactcgggataccttgttgatacgaatgaagaagtcccaatgggatgaagtgattgatttgaatctcactggagtattcctctgtacccaggcagcgacaaagataatgatgaagaagagaaagggaagaatcatcaacatagcgtcagttgttggtctcattggtaatattggccaagcaaactacgctgctgctaaagctggagttatcgggttctccaagactgctgccagagagggtgcgagcaggaatattaacgtcaatgtggtttgccccgggttcattgcatctgacatgactgctaaacttggagaagacatggaaaagaaaatcttgggaacaatcccattaggacgatatggacaaccggaagatgtggctggcttggtagaattcttggctctcagtcctgcagccagttacatcactggacaggcattcaccatcgatgggggtattgccatctaggagcatttggtaagatcggcttttgtttaggcaataaacagacaaagttgagttgtttctggcacttggtcggatatctatttctgtttggggagagatgtaaaactcattgcttatactatgttataaatcaaagagccttgtagacaaacttgttgatttcaatagaggtttttttttgtgtgtaaaaaaaaaaaaaaaaaaaaaaaaaaaaa

SEQ ID NO: 7293 - protein, 328 aa, Brassica napus
MATTSIAGPRLTSLKTAAGKLGYREICHVRQWAPVHSPMPHFGMLRCGSRRPFATSSSTVVQAQAQATAAEQSTGEEEAVPKVESPVVVVTGASRGIGKAIALSLGKAGCKVLVNYARSAKEAEQVSKQIEAYGGQAITFGGDVSKEADVDAMMKTAVDAWGTIDVVVNNAGITRDTLLIRMKKSQWDEVIDLNLTGVFLCTQAATKIMMKKRKGRIINIASVVGLIGNIGQANYAAAKAGVIGFSKTAAREGASRNINVNVVCPGFIASDMTAKLGEDMEKKILGTIPLGRYGQPEDVAGLVEFLALSPAASYITGQAFTIDGGIAI

SEQ ID NO: 7294 - DNA, 753 bp, Sulfolobus tokodaii
  CDS (1)..(753)
atgggcatagaattaaatggaaaaatagccatagttactggagcctctagcggaattggtagggctattgcatttaagttagctagcagaggtgcaaatctaattttaggagatgtaaaaattgatgaacttagaaaagtagctgaggaaatagcaaaagaaactaaagttaaagtaattcccctctacgttaacgtaggcgatttcaattcaacaaaagaattctataataaaggtatctcagagcttggagtagattatgtagacattttagtgaataatgcaggaataaatagagatgcactgttcgtcaaaatgacttatgaacaatgggatgaagtaattaaggtagatttatacagcatgtttaacatgactaaacaagttgttgatggtatggttaagaggaattacgggagaattataaatatatcatcattaagttggttaggaaatatagggcaagcaaactattcagcagctaaggctggagtgataggttttactaagacattagctagagaattaggtaaatataacataacagttaacgcgatttgtccagggtttattgatactccaatgactagggcagtaccagaaaaaataaggcaaagaattatagagagaattccaatgggtagaataggccaaccggaagatgttgcaaacttggttgcattcctcgcatcggatgaagcctcttatataactggagaagttataggtgttactggagggttagttctataa

SEQ ID NO: 7295 - protein, 250 aa, Sulfolobus tokodaii
MGIELNGKIAIVTGASSGIGRAIAFKLASRGANLILGDVKIDELRKVAEEIAKETKVKVIPLYVNVGDFNSTKEFYNKGISELGVDYVDILVNNAGINRDALFVKMTYEQWDEVIKVDLYSMFNMTKQVVDGMVKRNYGRIINISSLSWLGNIGQANYSAAKAGVIGFTKTLARELGKYNITVNAICPGFIDTPMTRAVPEKIRQRIIERIPMGRIGQPEDVANLVAFLASDEASYITGEVIGVTGGLVL

SEQ ID NO: 7296 - DNA, 738 bp, Rhizobium loti
  CDS (1)..(738)
atgttcgaactgaccggccgcaaggcgctcgtcaccggcgcatcgggaggcatcggcgaggcgatcgcccgcgtgctgcatgcgcaaggcgccattgtcggcctgcacggcacccgcatcgagaaactggaggccttggcggccgaactcggcgatcgggtcaaactgttcccggccaatctgtcgaaccgcgacgaggtcaaggcgctcggccagaaggcggaggccgatctcgaaggcgtcgacatcctggtcaacaatgccggcatcaccaaggacggcctgttcgtgcgcatgtcggacgccgattgggactccgtgatcgaggtcaatttgaccgccgttttccggctgacccgcgaactcacccatccgatgatgcgccgccgtcatggccgcatcatcaacatcacctcggtggtcggcgtgactggcaatcccggccagaccaactactgcgcctcaaaggccggcatgatcggcttctccaaatcgctggcgcaggagatcgccacccgcaacatcaccgtcaactgcgtcgctccgggcttcatcgaatcggcgatgaccgacaagctcaacgacaagcagaaagaggcgatcatggcggcgattccaacgcgccgcatgggaacgggtgccgaggtggcgtccgccgtcgcctaccttgcctccaacgaagccgcctacgtcactggccagaccgtccatgtcaatggcggcatggccatgatttga

SEQ ID NO: 7297 - protein, 245 aa, Rhizobium loti
MFELTGRKALVTGASGGIGEAIARVLHAQGAIVGLHGTRIEKLEALAAELGDRVKLFPANLSNRDEVKALGQKAEADLEGVDILVNNAGITKDGLFVRMSDADWDSVIEVNLTAVFRLTRELTHPMMRRRHGRIINITSVVGVTGNPGQTNYCASKAGMIGFSKSLAQEIATRNITVNCVAPGFIESAMTDKLNDKQKEAIMAAIPTRRMGTGAEVASAVAYLASNEAAYVTGQTVHVNGGMAMI

SEQ ID NO: 7298 - DNA, 726 bp, Rhizobium loti
  CDS (1)..(726)
atgaccaaggttgcaatcgtcacgggcggatcgcgcggtatcggcgcggcgatctcgatcgctttgaagtccgccggctattcggttgccgcgaactatgccggcaatgacgaggcggcggcgaagttcaaggccgagaccggcattccggtctacaaatggtcggtcgccgactatgacgcttgcgccgccggcatcaaacaggtcgaggccgacctcggcccggtctcggtgctggtcaacaatgccggcatcacccgcgatgccatgttccacaagatcacccgcgaccagtggaaagaagttatcgacaccaatctgtccggcgtcttcaacatgacgcatccgctgtggaacggcatgcgcgaccgcaagttcggccgcgtcatcaccatctcctcgatcaacggccagaagggccaggccggccaggtcaactattccgccgccaaggccggcgacatcggcttctcgaaggcgctcgcccaggagggcgctcgcgcgggcatcaccgtcaacgtcatctgccccggctacatcgccaccgaaatggtcaaggccatcgacgagaaggtgctcaacgagcgcatcctgccgcagatcccggtcggccgcctcggcgagccggaagagatcgcacgctgcgtcgtcttcctcgcctcgcaggatgccggcttcatcaccggctcgaccatcacggccaatggcggccagtacttcgtctga

SEQ ID NO: 7299 - protein, 241 aa, Rhizobium loti
MTKVAIVTGGSRGIGAAISIALKSAGYSVAANYAGNDEAAAKFKAETGIPVYKWSVADYDACAAGIKQVEADLGPVSVLVNNAGITRDAMFHKITRDQWKEVIDTNLSGVFNMTHPLWNGMRDRKFGRVITISSINGQKGQAGQVNYSAAKAGDIGFSKALAQEGARAGITVNVICPGYIATEMVKAIDEKVLNERILPQIPVGRLGEPEEIARCVVFLASQDAGFITGSTITANGGQYFV

SEQ ID NO: 7300 - DNA, 735 bp, Streptococcus pyogenes
  CDS (1)..(735)
atggaaattaaaggaaaaaatatatttatcacaggctcaacgagaggtatcggtttagcaatggctcatcaattcgccagtttagaagctaatattgtcttaaatggtcgctctgctatctctgaggagcttgttgctagttttactgactacggcgttacagttgttaccatctctggggatgtttcagaagcatcagaagctaaacgtatggtcaatgaagctatcgaaagtttaggttcgattgatgttttagttaacaatgctggcattactaatgataaattgatgcttaaaatgacggaagaggattttgagcgcgtcttgaaaatcaatttgaccggtgcttttaacatgactcaatcagtgttaaaaccaatgatcaaggcccgccaaggagcaattattaatgtctctagtgtggttggtttaacaggcaatattgggcaagcaaactatgctgcttctaaggcaggaatgattggttttaccaagtctgttgcccgtgaagttgctgctcgtaacatttgcgtgaatgctattgctccaggatttatcgagtccgacatgacaggtgtccttcctgaaaaaatgcaagagcaaatcttaagtcaaatcccaatgaaacgtattggaaaagctcaagaagttgctcacttagcaagcttcttggtggaacaagattatattacgggacaagttatcgctattgatggcggtatgacaatgcaataa

SEQ ID NO: 7301 - protein, 244 aa, Streptococcus pyogenes
MEIKGKNIFITGSTRGIGLAMAHQFASLEANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 7302 - DNA, 726 bp, Rhizobium etli
  CDS (1)..(726)
atgagcagagtggctctggtcaccggaggtacacgcggcattggcgcagcaatatccacggcgctgaaaaatgccggctacagggttgcggccacttacgccggtaatgacgagaaggctcatgccttccacgacgtcaccggcgttgcggtattcaaatgggatgtttcggactacgcagcctgcggtgaagggatcaccaaggtcgaaggcgagatcgggccggtcgaaatcctcgtcaataatgccggcatcacccgcgacgcaatgttccacaagatgacgccgcagcagtggcacgaggtgatcaacaccaacctgaccggtctattcaacatgacgcatcaggtctggagcggcatgcgcgaccgcagcttcggccgcatcgtcaatatctcgtcgatcaacggccaaaagggccagatgggccaggcgaactattcggcggccaaggcgggcgatctcggctttaccaaggcgcttgcccaggaaggggctgcaaaaaacatcaccgtcaatgccatctgccccggttatatcggaacggaaatggtgcttgccgtgccggagaaggtactgaatgaacgcatcattccgcagatcccggtcggtcgtctcggcgaaccggaagaaatcgcgcgttgcgtcaccttcctcgtctccgacgatgccggcttcatcaccggctcgacgctgacggccaatggcgggcaattcttcgtttaa

SEQ ID NO: 7303 - protein, 241 aa, Rhizobium etli
MSRVALVTGGTRGIGAAISTALKNAGYRVAATYAGNDEKAHAFHDVTGVAVFKWDVSDYAACGEGITKVEGEIGPVEILVNNAGITRDAMFHKMTPQQWHEVINTNLTGLFNMTHQVWSGMRDRSFGRIVNISSINGQKGQMGQANYSAAKAGDLGFTKALAQEGAAKNITVNAICPGYIGTEMVLAVPEKVLNERIIPQIPVGRLGEPEEIARCVTFLVSDDAGFITGSTLTANGGQFFV

SEQ ID NO: 7304 - DNA, 729 bp, Methylobacterium extorquens
  CDS (1)..(729)
atggctcaggaacgcgtcgccctcgtcacgggcggaacgcgcggcatcggcgccgcgatctccaagcgcctgaaggacaagggttacaaggtcgccgccaattacggcggaaacgacgaggcggccaacgccttcaaggccgagaccggcatcccggtgttcaagttcgacgtcggtgatctcgcgagctgcgaggccggcatcaaggcgatcgaggctgaactcggtccgatcgacatcctcgtgaacaacgccggcatcacccgcgacggcgccttccacaagatgaccttcgagaagtggcaggcggtgatccgcaccaacctcgactcgatgttcacctgcacccgtccgctgatcgagggaatgcgctcgcgcaatttcgggcgcatcatcatcatctcgtcgatcaacggccagaagggccaggccggccagaccaactactccgcggccaaggccggcgtgatcggcttcgccaaggcgctggcgcaggagagcgcctcgaagggcgtcaccgtgaacgtggtggcccccggctacatcgccaccgagatggtgatggcggtgccggaagacatccgtaacaagatcatctcgacgatcccgaccggccgcctcggtgaggccgacgagatcgcccacgcggtcgagtacctcgccagcgacgaggccggcttcgttaacggctcgaccctcaccatcaacggcggtcagcacttcgtctga

SEQ ID NO: 7305 - protein, 242 aa, Methylobacterium extorquens
MAQERVALVTGGTRGIGAAISKRLKDKGYKVAANYGGNDEAANAFKAETGIPVFKFDVGDLASCEAGIKAIEAELGPIDILVNNAGITRDGAFHKMTFEKWQAVIRTNLDSMFTCTRPLIEGMRSRNFGRIIIISSINGQKGQAGQTNYSAAKAGVIGFAKALAQESASKGVTVNVVAPGYIATEMVMAVPEDIRNKIISTIPTGRLGEADEIAHAVEYLASDEAGFVNGSTLTINGGQHFV

SEQ ID NO: 7306 - DNA, 729 bp, Pasteurella multocida
  CDS (1)..(729)
atgcagggtaaaattgcattagtaacaggcgcaacgcgtggtattggtcgtgcgattgcagaagaattaagtgcaaaaggcgcatttgttatcggtacagcaacgtctgaaaaaggcgcagaaagtatttctgcctatttaggcgagaaaggtaaagggcttgtgctgaacgtgtctgatcttgcctcgattgaaacaacgctagagaaaatcaaagcagatttcggtgagattgatattttagtcaataatgcaggcattacacgtgataatctgttaatgcgtatgaaagatgaagaatggtttgatatcatgcaaactaatttaacttcggtgtatcacttatcaaaagccatgttgcgttctatgatgaaaaagcgttttggtcgcattattacgattggttcagtagtcggatcgatgggtaatcctggtcaaactaactattgtgctgcaaaagcaggcttgattggttttagtaaagcgcttgcaaaagaagtggcttcgcgtggtattactgtgaatgtagtagcgcctggttttatcgcaaccgatatgacagatgtgttaacagaagagcaaaaagccggtattttatctcaagttccagcagggcgtttaggtgatccaaaagatattgccaaagcggtcgcctttttagcttcggatgatgcgggttatattacaggtactacattacatgtgaatggtgggatgtataccaactaa

SEQ ID NO: 7307 - protein, 242 aa, Pasteurella multocida
MQGKIALVTGATRGIGRAIAEELSAKGAFVIGTATSEKGAESISAYLGEKGKGLVLNVSDLASIETTLEKIKADFGEIDILVNNAGITRDNLLMRMKDEEWFDIMQTNLTSVYHLSKAMLRSMMKKRFGRIITIGSVVGSMGNPGQTNYCAAKAGLIGFSKALAKEVASRGITVNVVAPGFIATDMTDVLTEEQKAGILSQVPAGRLGDPKDIAKAVAFLASDDAGYITGTTLHVNGGMYTN

SEQ ID NO: 7308 - DNA, 741 bp, Streptomyces antibioticus
  CDS (1)..(741)
atggttcacaatggccggggtgtcgccctggtgaccggcggatcgcgcggtattggtcgcgcagtcgtcctgcggcttgttcgcgagggattcgatgtggcgttctgctatcagcgcgaagccgtggccgcagccgatctggagaaggctgtggccgaattgggtggccgcgtcgcgcaccgacgggtggacgtttccgatgccgttcaggtcaaggaatgggtgcgtgacgtagagagcgaactcgggcctgtcgaggtcgtggtgacttccgccggaattgtgcgggacgggcccctcgtcatgatgcaggacaaggactggcaggacgtcatcgacgtcaatctcaacggcacgttcaacgtctgccgggccgctgtcttcggcatgatgaagcgcaaatccggatgcctcatcaacctttcctcggtggccggcgtgagcggtcatgccacccagtcgaactattctgcctcgaaggccgggatcatcggattcacgaagtccctctcgaaggaactcggccgatacggaatccgggccaatgtggtggcgccggggttcatcgacacagatatggtcgccgggatttccgacgggctgcggaccaaggccgtcgcaggcgttgcactcggccgtttcggccgacccgacgaggtggcggacgcggttgcctacctggcgtcggcggagtacgtcaccggcgcggtgcttcagatcgacggcggcctttcgatctga

SEQ ID NO: 7309 - protein, 246 aa, Streptomyces antibioticus
MVHNGRGVALVTGGSRGIGRAVVLRLVREGFDVAFCYQREAVAAADLEKAVAELGGRVAHRRVDVSDAVQVKEWVRDVESELGPVEVVVTSAGIVRDGPLVMMQDKDWQDVIDVNLNGTFNVCRAAVFGMMKRKSGCLINLSSVAGVSGHATQSNYSASKAGIIGFTKSLSKELGRYGIRANVVAPGFIDTDMVAGISDGLRTKAVAGVALGRFGRPDEVADAVAYLASAEYVTGAVLQIDGGLSI

SEQ ID NO: 7310 - DNA, 822 bp, Streptomyces antibioticus
  CDS (1)..(822)
atgaatcagccctggcccgcgacccgggcagaccgaccgaacatttgcagggaaggagcacgaatgagcctcggggccgacaccgtcgcgatcgtcaccggagccggacggggcatcggcgccgccacggcgcagcggctcgccgcggagggcgcgaccgtggcagtcgtcgaccggaccgaggcggacacggccgacaccgtggcgtcgatccgggcggccggtggccgcgccctcggcatcgggtgcgacgtgacagtcaccgacctggtcgaggcggcggtcgaccgcacggtcgcggagttcggtcgtctggacgtcctcgtcaacaacgccggggtaacccgggacagcctcgtcttcatgatgggcgacgaggactgggatacggtcatcgacgtgcacctgaacggcgccgcccggaccgtccgcgcggcacggcgccagatggtgcgtcaaggttccgggcggatagtgaacttgagctcgatcgcggctctgggcaaccaggggcaggccaactacgccactgccaaggccgcgatccagggctacacccgcaccctggccgtggaacttggcccgcacggtattacggtcaatgcgatcgcgcctgggttcatcgccacgaccatgacggacgacacggctcgccggatgggctccgatccggtggcgctgcggaaggcggtggcgtcgcgggtgccgatgcgcagggttggcaggccggaggacatcgccggcctggtggccttcctggccgggcctgatgcgagctatctcacagggcagacgatctacgtcgacggcggaccgcagtga

SEQ ID NO: 7311 - protein, 273 aa, Streptomyces antibioticus
MNQPWPATRADRPNICREGARMSLGADTVAIVTGAGRGIGAATAQRLAAEGATVAVVDRTEADTADTVASIRAAGGRALGIGCDVTVTDLVEAAVDRTVAEFGRLDVLVNNAGVTRDSLVFMMGDEDWDTVIDVHLNGAARTVRAARRQMVRQGSGRIVNLSSIAALGNQGQANYATAKAAIQGYTRTLAVELGPHGITVNAIAPGFIATTMTDDTARRMGSDPVALRKAVASRVPMRRVGRPEDIAGLVAFLAGPDASYLTGQTIYVDGGPQ

SEQ ID NO: 7312 - DNA, 777 bp, Streptomyces rishiriensis
  CDS (1)..(777)
atgactgggcccgccgcatcagcggtggcttgcgagccggtcgcgatggtcaccggagccggccggggcatcggcgctgccacggccgagcgccttgccgcggagggcatggcggtgatcgtcgtggaccgcgtggaacaggacaccacagccaccgtctcggccatccgtgcggccggcggacgggccagcgggctcggctgtgacgtctccgtagctcaggcggtgacggccaccgtcgcctcggccgtcgaggagttcggtcacctcgacgtgctggtgaactgcgccgggatcacccaggatcggctgctgctcaccatgagcgaccaggagtgggacagggtcctggacgtcaacctcggcggcagcatgcgatgttcgttcgcggtcgggaggcacatgcgccggcaggggcacggccggatcatcaacttcagttctgttgccgcgcgcggcaatgccggtcagaccaactatgcgaccgcgaagggcgcgattgccgggttcacccgcacgctcgcggccgaattcggtccgcacggcgtgacggtcaactcgatcgcaccgggcttcgtggccacgccgatggtggcagagctgaccgaacggctcggcgtggatcgggacaccgtcctgctggaggcggcgatgtcctcggccgtgggccggatcgggacgcccgaggaaatcgccgcggtggtggcattcgtcacccggccggaatcgggctacctcaccggggagaccatccacgtcgaaggtggtcggcgatga

SEQ ID NO: 7313 - protein, 258 aa, Streptomyces rishiriensis
MTGPAASAVACEPVAMVTGAGRGIGAATAERLAAEGMAVIVVDRVEQDTTATVSAIRAAGGRASGLGCDVSVAQAVTATVASAVEEFGHLDVLVNCAGITQDRLLLTMSDQEWDRVLDVNLGGSMRCSFAVGRHMRRQGHGRIINFSSVAARGNAGQTNYATAKGAIAGFTRTLAAEFGPHGVTVNSIAPGFVATPMVAELTERLGVDRDTVLLEAAMSSAVGRIGTPEEIAAVVAFVTRPESGYLTGETIHVEGGRR

SEQ ID NO: 7314 - DNA, 762 bp, Streptomyces coelicolor
  CDS (1)..(762)
atgtccaccactgagcagcgggtcgccgtagtcaccggagccgcgcgcggcatcggcgccgccaccgccctacgactggccgccgagggccgcgccgtcgccgtcatcgacctcgacgaggccgcctgcaaggacaccgtggagaagatcaccgcggccggcggcaaggcgatcgcggtcggctgcgacgtctccgacgaggcacaggtcgaggcggccgtcgcgcgcatcgccgaggagctgggcgcgccgacgatcctcgtcaacaacgcgggcgtgctgcgcgacaacctcctgttcaagatgagcgtctccgactgggacaccgtcatgaacgtgcacctgcgcggcgccttcctgatgacgaaggcctgccagaagcacatggtggacgccaagttcggccgtgtcgtcaacctgtcctcctcctccgccctcggcaaccgcggccaggtcaactactccgccgccaaggccggtctccagggcttcaccaagaccctcgccaaggagctgggcaagttcggcgtgaccgccaacgccgtcgcccccggcttcatcgccaccgagatgacgaaggccaccgccgaccgcgtcggcatgggcttcgacgacttcaaggccgccgccgccacccagatcccggtcgcgcgcgtgggtgagcccgacgacatcgccaacgccatcgccttcttcaccggcgaggccgccggcttcgtctccggccaggtcctgtacgtggccggcggaccgctcgactag

SEQ ID NO: 7315 - protein, 253 aa, Streptomyces coelicolor
MSTTEQRVAVVTGAARGIGAATALRLAAEGRAVAVIDLDEAACKDTVEKITAAGGKAIAVGCDVSDEAQVEAAVARIAEELGAPTILVNNAGVLRDNLLFKMSVSDWDTVMNVHLRGAFLMTKACQKHMVDAKFGRVVNLSSSSALGNRGQVNYSAAKAGLQGFTKTLAKELGKFGVTANAVAPGFIATEMTKATADRVGMGFDDFKAAAATQIPVARVGEPDDIANAIAFFTGEAAGFVSGQVLYVAGGPLD

SEQ ID NO: 7316 - DNA, 738 bp, Rhizobium meliloti
  CDS (1)..(738)
atgttcgatctttcaggccgcaaggctctcgttaccggcgcttccggtggtatcggcgaggaaatcgcccgcatgctgcatgcccagggcgccgtcgtcggactccatggtacccgcgtcgagaagctcgaaacgcttgccaacaccctcggcgagcgggttcagatattcccggcaaacctctccgatcgcgcggaagtcaaggcgctcggagagaaggcggaagccgatctcggcggcgtcgatatcctcgtcaacaacgccggcattaccaaggacgggctcttcgtccgcatgagcgacgaggactgggacaacgtcatcgaagtcaatctcacggccgtcttccggctgacgcgcgagctcacgcatccgatgatgcgccgtcgcttcggccgcatcgtcaacataacctcggtcgtcggtgtcaccggcaatccggggcaggcgaattactgcgcctcgaaggcgggcatgatcggcttctccaagtcgcttgcacaggaaatcgccacccgcaacgtcacggtcaactgcgtcgccccgggcttcatcgaaagcgcgatgacgggcaagctgaacgacaagcagaaggaagggatcatgtctgcgatcccgatgcggcggatgggaagcggagcggaagtcgcctccgccgtggcctatctcgcttctaacgaagcgggatatgtcaccggtcagacgatccacgtcaacggcggcatggcgatgatctga

SEQ ID NO: 7317 - protein, 245 aa, Rhizobium meliloti
MFDLSGRKALVTGASGGIGEEIARMLHAQGAVVGLHGTRVEKLETLANTLGERVQIFPANLSDRAEVKALGEKAEADLGGVDILVNNAGITKDGLFVRMSDEDWDNVIEVNLTAVFRLTRELTHPMMRRRFGRIVNITSVVGVTGNPGQANYCASKAGMIGFSKSLAQEIATRNVTVNCVAPGFIESAMTGKLNDKQKEGIMSAIPMRRMGSGAEVASAVAYLASNEAGYVTGQTIHVNGGMAMI

SEQ ID NO: 7318 - DNA, 738 bp, Rhizobium leguminosarum
  CDS (1)..(738)
atgctcgatctttccggccgcaaggctctcgtcacaggcgcatcgggcggtatcggcgaggaaatcgcccgccttcttcataggcagggcgccatcgtcggcctgcatggcacccgcgtcgagaaactggaagcgctggccgccgatctcggcgagcgcgtcaagatcttcccggcgaacctttcagaccgcgatgaggtcaaggcgctcggccagaaggccgaggccgatctcgaaggcgtcgacatcctcgtcaacaatgccggcatcacccgcgacggcctgttcgtgcgcatgagcgacgaggactgggacagcgtcatcgaagtgaacctgacggcgaccttccgcctgacgcgcgaattgacgcatccgatgatgcgtcgccgctatggccgcatcatcaatatcacctcggtcgtcggcgtcaccggcaatccgggccaggccaattactgcgcctccaaggccggcatgatcggcttcaccaagtccctggcgcaggaaattgccacccgcaacgtgacggtcaattgcgtggcgcccggtttcatcgaaagcgccatgaccggcaagctgaacgacaagcagaaggaagcgatcatgggagcgattccgatgaagcgcatgggcacaggcggcgaggtcgcttcggcggtcgcttaccttgcgtcctccgaggctgcttatatgacgggccagacgctgcacgtaaacggcggcatggcgatgatctga

SEQ ID NO: 7319 - protein, 245 aa, Rhizobium leguminosarum
MLDLSGRKALVTGASGGIGEEIARLLHRQGAIVGLHGTRVEKLEALAADLGERVKIFPANLSDRDEVKALGQKAEADLEGVDILVNNAGITRDGLFVRMSDEDWDSVIEVNLTATFRLTRELTHPMMRRRYGRIINITSVVGVTGNPGQANYCASKAGMIGFTKSLAQEIATRNVTVNCVAPGFIESAMTGKLNDKQKEAIMGAIPMKRMGTGGEVASAVAYLASSEAAYMTGQTLHVNGGMAMI

SEQ ID NO: 7320 - DNA, 789 bp, Streptomyces sphaeroides
  CDS (1)..(789)
atgacgagcccggccgatgcgaccaccgaagtcgctgtgtctcaggagtcggtcgccatggtcaccggagccggccggggcatcggcgcggccacggccgagcgcctcgccgccgagggcatggcggtgatcgtcgtggaccgcaccgaacaggacacccgggccacggtcgcggccattcgcacggccggcggacgggcccgcgggatcggctgtgacgtcgccgtggcccaggccgtgacggccgcggtcgccacggccgtcgaggagttcggccgcatcgacgtactggtgaactgcgccgggatcaaccgggaccggctgctgctcaccatgggcgatcaggagtgggacacggtcctggacgtcaacctcggcggcaccatgcgatgttcgttcgccgtcggccggcacatgcgccggcaggggcacggccggatcatcaacttcagctccgtggccgcgcgcggcaatgccggccagaccaactacgcgaccgccaaaggcgcgatcgccgggttcacccgtacgctcgcggccgaactgggcccgcacggcgtgacggtcaacgccatcgcaccgggcttcgtggccacgccgatggtggacgagctggccgaacggctcggcggggaccgggactcggtcatgtcggaggcggcgaagtcctcggcagtgggccggatcgggacgcccgaggaaatcgccgcgaccgtggtcttcgtcgcccggccggaatcgggctacctcaccggcgagaccgttcacgtcgacggcggtcggccatga

SEQ ID NO: 7321 - protein, 262 aa, Streptomyces sphaeroides
MTSPADATTEVAVSQESVAMVTGAGRGIGAATAERLAAEGMAVIVVDRTEQDTRATVAAIRTAGGRARGIGCDVAVAQAVTAAVATAVEEFGRIDVLVNCAGINRDRLLLTMGDQEWDTVLDVNLGGTMRCSFAVGRHMRRQGHGRIINFSSVAARGNAGQTNYATAKGAIAGFTRTLAAELGPHGVTVNAIAPGFVATPMVDELAERLGGDRDSVMSEAAKSSAVGRIGTPEEIAATVVFVARPESGYLTGETVHVDGGRP

SEQ ID NO: 7322 - DNA, 741 bp, Burkholderia sp
  CDS (1)..(741)
atgtctcagcgaattgcttacgtaacgggcggtatgggtggcatcggcaccagcatctgccagcgcctgctgaaggacggcttcacggtggtcgcaggctgcggcccgaactcgccgcgccgcgtgaagtggctcgaggaccagaaggcgctcgggttcgacttcatcgcatcggaaggcaacgtcggcgactgggactcgaccaaggaagcgttcgacaaggtcaaggccgaggtcggcgagatcgacgtgctggtcaacaatgcgggcatcacgcgcgacgtcgtgttccgcaagatgacgcacgaggactggacggccgtcatcgacaccaacctgacgagcctgttcaacgtgacgaaacaggtgatcgacgggatggtcgagcgcggctggggccggatcatcaacatctcgtcggtgaacggccagaagggccagttcggccagaccaactattcgaccgcgaaggccggcattcacggcttcacgatggcgctcgcgcaggaagtcgcgacgaagggcgtgacggtcaacaccgtgtcgccgggctacatcggcaccgacatggtcaaggcgatccgccctgacgtgctcgagaagatcgtcgccacgattccggtgcgtcgtctcggcgggcccgaggagatcgactcgatcgtcgcgtggctcgcgtcgaacgattcgggttttgcgacgggcgccgacttctcgctgaacggcggcctgcacatgggctga

SEQ ID NO: 7323 - protein, 246 aa, Burkholderia sp
MSQRIAYVTGGMGGIGTSICQRLLKDGFTVVAGCGPNSPRRVKWLEDQKALGFDFIASEGNVGDWDSTKEAFDKVKAEVGEIDVLVNNAGITRDVVFRKMTHEDWTAVIDTNLTSLFNVTKQVIDGMVERGWGRIINISSVNGQKGQFGQTNYSTAKAGIHGFTMALAQEVATKGVTVNTVSPGYIGTDMVKAIRPDVLEKIVATIPVRRLGGPEEIDSIVAWLASNDSGFATGADFSLNGGLHMG

SEQ ID NO: 7324 - DNA, 846 bp, Drosophila melanogaster
  CDS (71)..(820)
tatagttgtcgcacgaccgttgaggagaaaacaagtgaaaactgctgtttactaagtcatttttagagccatgtcagtgggagtactagctggaaaagtagccctggtaacaggtgccggatcaggaattggtcgtgccacctgccgccttttggccagagatggtgccaaagtgatcgccgttgaccgcaatctaaaggcggcccaagaaaccgtacaggaattgggctctgagcgatctgccgccctggaggtggacgtttcctctgcccagagtgttcaattctcggtggccgaggccctaaagaaattccagcaggcacccactattgtggtcaattcggctggaataacccgagatggttatctgctcaagatgcccgaacgggactacgatgacgtatacggggtcaatctgaagggcacctttctggttacccaggcctatgccaaggccatgatcgagcagaaactggaaaacggcaccattgtgaacctctcaagcatcgtggccaagatgaacaacgtgggccaggccaactatgcggccaccaaggcgggcgtgatctccttcacggaggtggcctccaaggagttcggaaagtttggcatccgtgtgaactgcatcctgccaggctacatagacacgcccatggtagcggttgtgcccgattctgtaaagcaggaggtggtacaacgatgccccttgggccgattgggtcagccggaggagatcgccgaggtcattgcctttttggcctccccgcaatcgtcatacgtcaatggggctgccatcgaggtcaccgggggccttaaataatcgtgaaatgcatatatgcaatataa

SEQ ID NO: 7325 - protein, 249 aa, Drosophila melanogaster
MSVGVLAGKVALVTGAGSGIGRATCRLLARDGAKVIAVDRNLKAAQETVQELGSERSAALEVDVSSAQSVQFSVAEALKKFQQAPTIVVNSAGITRDGYLLKMPERDYDDVYGVNLKGTFLVTQAYAKAMIEQKLENGTIVNLSSIVAKMNNVGQANYAATKAGVISFTEVASKEFGKFGIRVNCILPGYIDTPMVAVVPDSVKQEVVQRCPLGRLGQPEEIAEVIAFLASPQSSYVNGAAIEVTGGLK

SEQ ID NO: 7326 - DNA, 723 bp, Streptococcus agalactiae
  CDS (1)..(723)
atgaaagtagcaatagttactggtggtaccagaggaattggaagggctattacaaaagagttatacaaagaaggttacaaagtcattgctatttataatagcaatgatgctaaggcaagagctttacaagaggagttaccaaaattagacgtttataaatgcaatatttcagatgcaaaagcagtacaaaaattggtgactaaaatttttagagaatatggcggtattgattgtttagttaataatgctggtattgttagagatggctttttcttgatgatgtctaaggaaaaatggatggatgtcattaacataaatattatggggctagttaacatgagtaaagccgtgttaaaaatcatgaaggctaagcgtatacagggaaaggttatcaatatttcttcaactagtggtatagcagggcagatagggcaagcgaactattcagcaacgaaaggcgctatcatttccattactaaaactctagcgaaagaatttgcatcagatggtattacgattaattgtgtaagtccaggattcattgaaacagatatgacaaatgaattgcaaaataaagaagagctaaaagagcatcttattcctctaaaaaggtttggacaacctgaagaggtggcttggctcgtaagctttttagcaagtgagaaggcaaactatattacaggaaaaaatattgtgattgatggaggaatgattaatgattaa

SEQ ID NO: 7327 - protein, 240 aa, Streptococcus agalactiae
MKVAIVTGGTRGIGRAITKELYKEGYKVIAIYNSNDAKARALQEELPKLDVYKCNISDAKAVQKLVTKIFREYGGIDCLVNNAGIVRDGFFLMMSKEKWMDVININIMGLVNMSKAVLKIMKAKRIQGKVINISSTSGIAGQIGQANYSATKGAIISITKTLAKEFASDGITINCVSPGFIETDMTNELQNKEELKEHLIPLKRFGQPEEVAWLVSFLASEKANYITGKNIVIDGGMIND

SEQ ID NO: 7328 - DNA, 738 bp, Alcaligenes latus
  CDS (1)..(738)
atgactcaaaaactcgcttacgtgacgggcggcatgggcggcatcggtacttcgatgtgccaacgcctgcacaaggacggcttcaaggtcatcgccggctgcggtccgagccgcgactaccagaagtggctggacgagcagaaggccctgggctacacgttctacgcctcggtgggcaacgtggccgactgggactccaccgtcgtcgccttcgagaaggtcaaggccgagcacggcacggtggacgtgctggtgaacaacgccggcatcacgcgtgacggccagttccgcaagatgagcaaggccgattggcaggccgtgatgtccaccaacctggacagcatgttcaacgtcaccaagcaggtgatcgacggcatgctggacaagggctggggccgcatcatcaacatctcctcggtcaacggcgagaagggccagttcggccagaccaactactccgccgccaaggccggcatgcacggcttcaccatggccctggcgcaggaagtggctgccaagggcgtgacggtcaacaccgtgagccccggctacatcgccaccgacatggtcaaggccatccgccaggacgtgctggacaagatcgtctccaccattcccatcaagcgcctgggcaccccggaggaaatcgcctccatcgtggcctggctggcgggcgacgaatccggcttcaccaccggtgccgacttcagctgcaacggcggcctgcacatgggctga

SEQ ID NO: 7329 - protein, 245 aa, Alcaligenes latus
MTQKLAYVTGGMGGIGTSMCQRLHKDGFKVIAGCGPSRDYQKWLDEQKALGYTFYASVGNVADWDSTVVAFEKVKAEHGTVDVLVNNAGITRDGQFRKMSKADWQAVMSTNLDSMFNVTKQVIDGMLDKGWGRIINISSVNGEKGQFGQTNYSAAKAGMHGFTMALAQEVAAKGVTVNTVSPGYIATDMVKAIRQDVLDKIVSTIPIKRLGTPEEIASIVAWLAGDESGFTTGADFSCNGGLHMG

SEQ ID NO: 7330 - DNA, 744 bp, Bacillus megaterium
  CDS (1)..(744)
atgacaacattacaaggtaaagtagcaatcgtaacaggcggatctaaaggtatcggggcagcaattacacgtgagcttgcttctaatggagtaaaagtagcagtaaactataacagcagtaaagaatctgcagaagcaattgtaaaagaaattaaagacaacggcggagaagctattgcggttcaagctgacgtgtcttatgtagatcaagcaaaacacctaatcgaagaaacaaaagctgcgtttggtcaattagacattctagtaaacaatgctggaattacgcgcgaccgttcattcaagaagttaggtgaagaagattggaaaaaagtaattgatgtaaacttacatagcgtatacaacacaacatcagctgcgctaacgcaccttttagaatctgaaggtggtcgtgttatcaatatttcatcaattattggtcaagcgggcggatttggtcaaacaaactactcagctgctaaagcaggtatgctaggattcactaaatcattagctcttgaactagctaagacaggcgtaacggttaatgcaatttgcccaggatttattgaaacggaaatggtgatggcaattcctgaagatgttcgtgcaaaaattgttgcgaaaattccaactcgtcgcttaggtcacgctgaagaaattgcacgtggagttgtttacttagcaaaagacggcgcgtacattacaggacaacagttaaacattaacggcggcttatacatgtaa

SEQ ID NO: 7331 - protein, 247 aa, Bacillus megaterium
MTTLQGKVAIVTGGSKGIGAAITRELASNGVKVAVNYNSSKESAEAIVKEIKDNGGEAIAVQADVSYVDQAKHLIEETKAAFGQLDILVNNAGITRDRSFKKLGEEDWKKVIDVNLHSVYNTTSAALTHLLESEGGRVINISSIIGQAGGFGQTNYSAAKAGMLGFTKSLALELAKTGVTVNAICPGFIETEMVMAIPEDVRAKIVAKIPTRRLGHAEEIARGVVYLAKDGAYITGQQLNINGGLYM

SEQ ID NO: 7332 - DNA, 1239 bp, Arabidopsis thaliana
  CDS (85)..(1044)
aagacttttctctcttcttcttctccactgggtcgatctttacgaggttcacttgtacggattcactttaacaacagattcgccatggccgccgccgtcgcagcaccgagactcatctccttgaaagccgtcgcgaagctaggtttccgtgagatctctcaaatccgacaattggctccgcttcactctgcgatacctcatttcggaatgctgcgatgtagatcgcggcagccgttttctacctctgttgtgaaagctcaagctactgctactgagcaatcaccaggggaagttgttcaaaaagtggaatctccagtggtcgttatcactggtgcctcgagagggattggtaaagcaattgctctagccttgggtaaagctggctgcaaggtcttggtgaattatgctaggtcagcaaaagaggctgaagaagttgctaaacagattgaagaatatggtggccaggctatcacttttgggggtgatgtctcgaaagcgactgatgtggatgcgatgatgaaaaccgctcttgacaaatggggaaccattgatgttgtggttaacaatgcaggaattactcgggataccttgttaatacgaatgaagcaatcacaatgggacgaagtgattgctttgaatctcactggtgtatttctctgtactcaggcagcagtaaagatcatgatgaagaaaaaaaggggaagaatcatcaatatctcgtcagttgttggtctcattggtaatattggtcaagcaaactacgcagcggctaaaggtggagttatttcgttttccaagactgctgccagagaaggtgcgagcaggaatataaatgtcaatgtggtttgccccggattcattgcatctgacatgactgcagagcttggagaagacatggaaaagaaaatcctgggaacaatcccattaggacggtatggaaaagctgaagaagtggctggcttggtagaattcttggctctcagtcctgcagccagttacataaccggacaggcattcaccattgatggaggtattgctatctagacatttggtatgagtcggcttttgtttagttaaaacaatttggtaaaagagacaaagttgagttctttttagcacttggtcggattgctattttgcggtttctgttaagaaatatgtaacacttactgcttaaactacgtatttggtcactttcagaaactagaaatcgattaatccaatctcgcattctaaatt

SEQ ID NO: 7333 - protein, 319 aa, Arabidopsis thaliana
MAAAVAAPRLISLKAVAKLGFREISQIRQLAPLHSAIPHFGMLRCRSRQPFSTSVVKAQATATEQSPGEVVQKVESPVVVITGASRGIGKAIALALGKAGCKVLVNYARSAKEAEEVAKQIEEYGGQAITFGGDVSKATDVDAMMKTALDKWGTIDVVVNNAGITRDTLLIRMKQSQWDEVIALNLTGVFLCTQAAVKIMMKKKRGRIINISSVVGLIGNIGQANYAAAKGGVISFSKTAAREGASRNINVNVVCPGFIASDMTAELGEDMEKKILGTIPLGRYGKAEEVAGLVEFLALSPAASYITGQAFTIDGGIAI

SEQ ID NO: 7334 - DNA, 735 bp, Buchnera aphidicola
  CDS (1)..(735)
atgaaaattgaaaaaaaaaccgcattagtcacaggagcaaaccaaggtcttggaaaagaaattgctataaaattatcacaaaagggaatacaagtcataggaacatctacaactgtagatggagtaaaaacaattaacaaatatttaaaaaaaaatggattcggttttattttagatttaaaagacactgattcaattttagaaaaaatgaaagaaatttgtcaaaaaaaatattctattgatatactgattaataatgctggaattacatcagataatttattagtttatatgagtaataaggaatgggaaaatgtaataaaaattaatctaacatcagtattttatatgtcaaaatctgttattcgttcgatgattaaaaaaagatatggtcgtattgttacaattggttctgtaattggataccttggaaatcgaggtcaaataaattatagtgcttcaaaatcaggactgattggatttcataaatcactagcattagaagtagcacaaaaaggtattaccgttaatattgtttctccaggttttatcaaaactaatcttacaaaaaatttaaatgtttttcaatataaaaagcatttatctaaaattcctatgaaaagaataggaactgcagaagaaatagctaacgcagtaatatttctgtcttccgaaaaagcatcctatataaccggacaaacaatccatgttaatggaggtatgtatatgacataa

SEQ ID NO: 7335 - protein, 244 aa, Buchnera aphidicola
MKIEKKTALVTGANQGLGKEIAIKLSQKGIQVIGTSTTVDGVKTINKYLKKNGFGFILDLKDTDSILEKMKEICQKKYSIDILINNAGITSDNLLVYMSNKEWENVIKINLTSVFYMSKSVIRSMIKKRYGRIVTIGSVIGYLGNRGQINYSASKSGLIGFHKSLALEVAQKGITVNIVSPGFIKTNLTKNLNVFQYKKHLSKIPMKRIGTAEEIANAVIFLSSEKASYITGQTIHVNGGMYMT

SEQ ID NO: 7336 - DNA, 738 bp, Buchnera aphidicola
  CDS (1)..(738)
atgaaaacaaccaaaaaaatagctgtaataacaggagctaatcgtgggttaggaaaaggtattgcagaagaactttcaaacacaaataatataacagtaattggaacatctacctctcaaaaaggttgcaaaattattaataagtatttaaaaaataatggaatcggcataaagttagatatcactaatcctaatgaaattactaaaacgatggattttgtttacaaaaatttcggacgcgttgatattttaatcaataatgcaggtattatacgagataaattattaataaatatgaaaacacaagattggaattctgtattaaatgttaatttaaattctatattctatatgtctaaatctgttataagaaatatgattaaaaacaaacaaggaaaaattataacaataggatctgtaatcgcgcatattggaaattgtggacaaactaattattccgcagcaaaattaggattagtaggattccacaaatcattagcattagaattagcacctaaaggaatcactgtaaatatgattgcaccagggttaataaaaaccggtatgaccaacaatcttagccaaaaacaattaagtaaatatctttcaaaaataccgatgaaaagattgggaacaattaaagaaatttctaaaataacgttatttttaatttctaatgatgctaattatattacaggacaagtgattcatgttaatggcgggatgtacatgccatga

SEQ ID NO: 7337 - protein, 245 aa, Buchnera aphidicola
MKTTKKIAVITGANRGLGKGIAEELSNTNNITVIGTSTSQKGCKIINKYLKNNGIGIKLDITNPNEITKTMDFVYKNFGRVDILINNAGIIRDKLLINMKTQDWNSVLNVNLNSIFYMSKSVIRNMIKNKQGKIITIGSVIAHIGNCGQTNYSAAKLGLVGFHKSLALELAPKGITVNMIAPGLIKTGMTNNLSQKQLSKYLSKIPMKRLGTIKEISKITLFLISNDANYITGQVIHVNGGMYMP

SEQ ID NO: 7338 - DNA, 747 bp, Chlamydia trachomatis
atgagtggtttattggtaaacaagactgcaattgtgactggcggttctagaggcatagggttcagtatagcgaagttattcgctgagcaaggggctaatgtccaaatctggggaattaatggggaagcggggcaggcggctgctcagactctctctgagcaaactggaagacaagtatcctttgctcttgttgatgtcagcaagaatgatatggtttccgcacaagttcagaactttcttgcggagtataacactatcgatgttatagttaacaatgcggggattacgcgtgatgctcttcttatgcgaatgtctgaagaagaatggtcttcggtaattaacaccaacttaggttctatatacaacgtttgctcagcagttataagacctatgattaaagctagatctggggcaattattaatattagttctattgtaggacttagagggagcccaggtcagacgaattatgcagcagctaaggctggaattattggattcagtaaagcgttatccaaagaagttggaagtaagaatatacgagtcaattgtattgctcctggtttcatagatactgatatgaccaagagcttgaatgataatttgaaaaatgagtggttgaaaggagttcctttgggaagagttggtatgcctgaagaaattgctaaggccgctttgttcttagcttctgacggatcttcgtacatcacagggcaagttttgagtgttgacggaggtatggcttaa

SEQ ID NO: 7339 - protein, 247 aa, Chlamydia trachomatis
SGLLVNKTAIVTGGSRGIGFSIAKLFAEQGANVQIWGINGEAGQAAAQTLSEQTGRQVSFALVDVSKNDMVSAQVQNFLAEYNTIDVIVNNAGITRDALLMRMSEEEWSSVINTNLGSIYNVCSAVIRPMIKARSGAIINISSIVGLRGSPGQTNYAAAKAGIIGFSKALSKEVGSKNIRVNCIAPGFIDTDMTKSLNDNLKNEWLKGVPLGRVGMPEEIAKAALFLASDGSSYITGQVLSVDGGMA

SEQ ID NO: 7340 - DNA, 768 bp, Mycobacterium avium
  CDS (1)..(768)
atgactgacacggccaccgagaacaccaccgaaagtgccgccgactacggcagaccggcattcgtctcccgctccgtcctggtgaccggaggaaaccggggcatcggtctggcgatcgcccagcggctggccgccgaggcccacaaggtggccgtcacgcaccgcggatccggggcgcccgacgggctgttcggtgtcgagtgcgacgtcaccgacaacgacgccgtcgaccgcgccttcacagaggtggaggagcaccaggggccggtcgaggtgctggtgtccaacgccggtatctccaaggacgcattcctgatccggatgacggaggagcggttcaccgaggtcatcaacgccaacctgaccggggcgttccgggtgacccagcgcgcggcccggagcatgcagaaaaagcggttcggccgcatcatctacatcggctcggtgtccggcatgtggggcatcggcaaccaggccaactacgcggccgccaaggcgggcctgatcgggatggcccgctcgatctcccgcgaactgtccaaggcgggtgtgaccgccaacgtcgtcgcacccggttacatcgacaccgagatgacccgcgcgctggacgagcggatccaggcgggcgcactggagttcatcccggccaagcgggtcggcaccgccgcggaggtgcccggggccgtcagcttcctggcctccgaggacgccagttacatcgccggcgcggtgatccccgtcgacggcggtatgggcatgggccactga

SEQ ID NO: 7341 - protein, 255 aa, Mycobacterium avium
MTDTATENTTESAADYGRPAFVSRSVLVTGGNRGIGLAIAQRLAAEAHKVAVTHRGSGAPDGLFGVECDVTDNDAVDRAFTEVEEHQGPVEVLVSNAGISKDAFLIRMTEERFTEVINANLTGAFRVTQRAARSMQKKRFGRIIYIGSVSGMWGIGNQANYAAAKAGLIGMARSISRELSKAGVTANVVAPGYIDTEMTRALDERIQAGALEFIPAKRVGTAAEVPGAVSFLASEDASYIAGAVIPVDGGMGMGH

SEQ ID NO: 7342 - DNA, 918 bp, Mycobacterium smegmatis
  CDS (96)..(863)
ggatccgccgcacggggagccccgaggcgatttctggctggaccggccaacacgttaagttgacgggcgaagacgcaggacgcgaggaacagaggatgactgtgactgacaatccggccgacaccgcgggcgaggccactgcaggccgcccggcgttcgtctcccgttcggtgctggtgaccggtggtaaccgcggcatcggcctggcgatcgcgcgacggctggccgccgacgggcacaaggtggccgtcacccaccgcggttccggtgcacccgacgacctgttcggtgttcaatgtgacgtcaccgacagcgctggtgtcgaccgcgccttcaaagaggtcgaggagcaccagggcccggtcgaggtgctggtggccaacgcaggcatctccaaggacgcattcctcatgcgcatgaccgaggagcggttcgaagaggtcatcaacaccaacctcacgggcgcgttccggtgcgcccagcgggcgtcgcgcaccatgcagcgcaagcggttcgggcgcatcatcttcatcgggtcggtctcgggcatgtgggggatcggcaatcaggccaactacgcggccgccaaggcgggcctgatcggcatggcccgctcgatctcccgtgagctggacaaggcgggcgtcaccgcgaacgtgttgccccccggttacatcgacaccgagatgacccgggcgctcgacgagcgcatccaggggggcgcgatcgacttcatcccggacaagcgggtcggcacggtcgaggaggtcgcgggcgcggtcagcttcctggcctcggaggacgcctcctacatcgcgggcgcggtcatccccgtcgacggcggtatgggcatgggccactagtcaaaagcccggacacacaagatttctcgctcacaaggagtcaccaaatgacagg

SEQ ID NO: 7343 - protein, 255 aa, Mycobacterium smegmatis
MTVTDNPADTAGEATAGRPAFVSRSVLVTGGNRGIGLAIARRLAADGHKVAVTHRGSGAPDDLFGVQCDVTDSAGVDRAFKEVEEHQGPVEVLVANAGISKDAFLMRMTEERFEEVINTNLTGAFRCAQRASRTMQRKRFGRIIFIGSVSGMWGIGNQANYAAAKAGLIGMARSISRELDKAGVTANVLPPGYIDTEMTRALDERIQGGAIDFIPDKRVGTVEEVAGAVSFLASEDASYIAGAVIPVDGGMGMGH

SEQ ID NO: 7344 - DNA, 750 bp, Staphylococcus epidermidis
  CDS (16)..(750)
aaggatggaataatcatgaataaaagtgctttagttacaggtgcttctcgtggtattggtagaagcattgcattgcaattagcggaagaaggatataatgtagctgtcaattatgctggaagtaaagataaagcagaagcagttgttgaagaaattaaagctaaaggtgtagaaagctttgcaatacaagccaatgttgcaaaaggcgatgaagttaaagaaatgattaaagaagtggtaagtcagtttggttctgtagatgtattggttaacaatgcagggataactaaagacaacttacttatgcgtatgaaagaacaagaatgggatgacgtgattgatacgaacttaaaaggcgtgtttaactgtattcaaaaagtaacgccacaaatgttgcgtcaacgtagtggtgcaatcattaatttaactagtattgttggtgcaatgggtaatcctggacaagcaaactatgttgcaacaaaagcaggtgtcattggattaacaaaaactgcagcacgagaactagcatcacgaggtattacagtgaacgctgtagcacctggtttcatcgtttcagacatgacaaatgctttaagtgatgatttgaaggatcaaatgttagagcaaattcctttaaaacgttttggagaagatacagatatagctaatactgttgccttcctagcttctgataaagctaaatatattacaggccaaacaattcatgttaacggtggaatgtatatgtaa

SEQ ID NO: 7345 - protein, 244 aa, Staphylococcus epidermidis
MNKSALVTGASRGIGRSIALQLAEEGYNVAVNYAGSKDKAEAVVEEIKAKGVESFAIQANVAKGDEVKEMIKEVVSQFGSVDVLVNNAGITKDNLLMRMKEQEWDDVIDTNLKGVFNCIQKVTPQMLRQRSGAIINLTSIVGAMGNPGQANYVATKAGVIGLTKTAARELASRGITVNAVAPGFIVSDMTNALSDDLKDQMLEQIPLKRFGEDTDIANTVAFLASDKAKYITGQTIHVNGGMYM

SEQ ID NO: 7346 - DNA, 735 bp, Vibrio cholerae
  CDS (1)..(735)
atgaatctagagggcaaagttgctcttgtgactggcgcaagccgcggcattggtaaagcgattgctgaactcttagctgaacgtggtgccaaagtgattggtacggcaaccagcgaaagcggtgcgcaggcgatcagcgattacttgggtgacaacggcaaaggtatggcattgaatgtgaccaatcctgagtcgattgaagcggttctgaaagccattaccgacgagttcggcggcgtcgacattctggtgaacaatgctggtatcactcgcgataatctgctgatgcgcatgaaagaagaagagtggtcagacattatggagaccaatctgacgtcgattttccgtctgtctaaagccgttttgcgtggcatgatgaaaaaacgtcaaggtcgtatcatcaatgttggctctgttgttggcactatgggtaacgcaggtcaagccaactacgcggcagcaaaagcgggcgtaattggctttactaagtcaatggcgcgtgaagttgcatcgcgcggtgtgaccgtcaacacagttgcaccaggttttatcgaaactgatatgacaaaagcgctgaatgacgagcaacgtactgctacactagcgcaggttccagcaggtcgactgggggatcctcgtgaaattgcgtctgcggttgctttccttgcatcaccagaagcggcatacatcaccggcgagacactgcatgtcaacggcggtatgtacatgatctaa

SEQ ID NO: 7347 - protein, 244 aa, Vibrio cholerae
MNLEGKVALVTGASRGIGKAIAELLAERGAKVIGTATSESGAQAISDYLGDNGKGMALNVTNPESIEAVLKAITDEFGGVDILVNNAGITRDNLLMRMKEEEWSDIMETNLTSIFRLSKAVLRGMMKKRQGRIINVGSVVGTMGNAGQANYAAAKAGVIGFTKSMAREVASRGVTVNTVAPGFIETDMTKALNDEQRTATLAQVPAGRLGDPREIASAVAFLASPEAAYITGETLHVNGGMYMI

SEQ ID NO: 7348 - DNA, 738 bp, Rhizobium sp
  CDS (1)..(738)
atgttcgaattgactggccgcaaggcactcgtcaccggcgcatcggggggcattggcgaggcgatcgccagggttctgcatgcgcagggcgcgatcgttggcctgcatggcacccgtgtcgagaaactggagacgctggccgccgagcttggcgaccgagtcaagctgttcccggccaatttgtcgaaccgcgacgaggtcaaggcgctcggccagaaggcggaggccgatctcgaaggtgtcgacatactggtcaacaatgccggcatcaccaaggacggtctgttcgtgcgcatgtcggatgccgactgggacaccgtgctcgaggtcaatctgacagccgtgttcaggctgacccgtgaactcacccatccgatgatgcgccgccgccacggccgcatcatcaacatcacctcggtggtcggcgtcaccggcaatcccggtcagaccaattactgcgcctccaaggccggcatgatcggtttttccaaatcgctggcgcaagagatcgccacccgcaacatcaccgtcaactgcgtcgccccgggcttcatcgaatcggcgatgaccgacaagctcaacgacaagcagaaagaggcgatcatggcggcgatcccgacgcgccgtatgggcaccagcgttgaagtcgcgtccgccgtcgcctatctcgcctccaacgaagccgcctacgtcaccggccagaccatccatgtgaatggcggcttggcgatgatctga

SEQ ID NO: 7349 - protein, 245 aa, Rhizobium sp
MFELTGRKALVTGASGGIGEAIARVLHAQGAIVGLHGTRVEKLETLAAELGDRVKLFPANLSNRDEVKALGQKAEADLEGVDILVNNAGITKDGLFVRMSDADWDTVLEVNLTAVFRLTRELTHPMMRRRHGRIINITSVVGVTGNPGQTNYCASKAGMIGFSKSLAQEIATRNITVNCVAPGFIESAMTDKLNDKQKEAIMAAIPTRRMGTSVEVASAVAYLASNEAAYVTGQTIHVNGGLAMI

SEQ ID NO: 7350 - DNA, 735 bp, Rhizobium meliloti
  CDS (1)..(735)
atgttcgaattgaccgggcgcaaggcgctcgtcacgggcgcatcaggagccataggaggggctatcgcccgcgtgctgcatgctcagggcgctatcgtcggactgcacggcacccaaatgaaaaactggagacactggcaactgagcttggagaccgggtcaagctgttcccggctaatctggccaatcgagacgaagtcaaggcgcttggtcagagagcggaagccgatcttgaaggcgtcgacatcctggtcaacaaatgctggcatcaccaaggatggattgttcttgcacatggcagaccccgactgggacattgtcctggaggtcaacctcaccgccatgttccgactgacccgcgagatcacccagcagatgatacgccgtcgaaatggccgcatcatcaatgtcacttcggtcgccggcgccatcggcaatccaggccagaccaattactgcgcctccaaggccggtatgatcggcttttccaagtcctggcgcaggagatcgacgcgaaacatcactgtcaactgcgtcgccccgggcttcatcgaatcggcaatgaccgataagctcaatcacaaacagaaggagaaaatcatggtggcgatcccgatccaccgcatgggcaccggtaccgaagtcgcgtccgccgttgcgtatctcgcttccgatcacgccgcctatgtcaccggacagaccattcacgtgaacggcggtatggcaatgatttga

SEQ ID NO: 7351 - protein, 244 aa, Rhizobium meliloti
MFELTGRKALVTGASGAIGGAIARVLHAQGAIVGLHGTQMKNWRHWQLSLETGSSCSRLIWPIETKSRRLVRERKPILKASTSWSTNAGITKDGLFLHMADPDWDIVLEVNLTAMFRLTREITQQMIRRRNGRIINVTSVAGAIGNPGQTNYCASKAGMIGFSKSWRRRSTRNITVNCVAPGFIESAMTDKLNHKQKEKIMVAIPIHRMGTGTEVASAVAYLASDHAAYVTGQTIHVNGGMAMI

SEQ ID NO: 7352 - DNA, 747 bp, Acinetobacter sp
  CDS (1)..(747)
atgtctgaacaaaaagtagctttagtgacgggtgcattaggtggtattggcagtgagatttgccgtcaactggttacagcaggctataaaattatcgcaacggttgtaccacgtgaagaagaccgcgaaaaacaatggcttcaaagtgaaggatttcaagacagcgatgtacgctttgtcttaacggatttaaataaccacgaagcggcaacagcagctattcaagaagcaattgctgctgaaggtcgtgtcgatgtgctggtcaataatgcaggcatcacccgtgatgcaacttttaaaaagatgagctatgaacagtggtcacaagtcattgataccaacttaaaaacattgttcacagtgactcagcccgtgtttaacaaaatgttagaacaaaagtcgggacgtattgtcaatatcagctcagtcaacggtttaaaaggtcagtttggacaagccaactactctgcgagcaaagccggcattatcggttttaccaaagccttagctcaagaaggtgcacgttcaaatatttgtgtaaacgtggttgcgcctggctataccgcaacaccaatggttactgccatgcgtgaagatgtgattaaaagcattgaagcacaaattcctctacaacgtcttgctgcgccagctgaaattgccgctgctgttatgtacttggtcagcgagcacggtgcgtacgtgacaggcgaaaccttatcgattaatggcggtttatacatgcactaa

SEQ ID NO: 7353 - protein, 248 aa, Acinetobacter sp
MSEQKVALVTGALGGIGSEICRQLVTAGYKIIATVVPREEDREKQWLQSEGFQDSDVRFVLTDLNNHEAATAAIQEAIAAEGRVDVLVNNAGITRDATFKKMSYEQWSQVIDTNLKTLFTVTQPVFNKMLEQKSGRIVNISSVNGLKGQFGQANYSASKAGIIGFTKALAQEGARSNICVNVVAPGYTATPMVTAMREDVIKSIEAQIPLQRLAAPAEIAAAVMYLVSEHGAYVTGETLSINGGLYMH

SEQ ID NO: 7354 - DNA, 729 bp, Paracoccus denitrificans
  CDS (1)..(729)
atggcaaaagtggcccttgtgaccggcgggtcgcgcggcatcggcgcggcaatctcgaaggcgctgaaggaggccggctatacggtcgccgcgaattacgccggcaatgacgatgccgcccgcgcctttaccgaggaaaccggcatcaagacctacaaatggtcggtggcggattacgacgcctgcgcggcgggcatcaagcaggtggaggaggagcttggccccatcgccgtgctggtcaacaatgccggcatcacccgcgacgcgatgttccacaagatgaccccccagcagtggaaagaggtcatcgacaccaacctgacgggcctgttcaacatgacccatccggtctggtcgggcatgcgcgaccgcaaatacggccgtatcgtcaacatcagctcgatcaacggccagaagggccaggccggccaggcgaactattcggcggccaaggcaggcgacctgggctttaccaaggcgctggcccaggaaggcgcccgtgccggcatcaccgtgaacgcgatctgccccggctatatcggcaccgagatggtccgcgccatcgacgagaaggtgctgaacgagggcatcatcccccagatcccggtcgccgcctgggcggagcccgaggaaatcgcgcgctgcgtggtcttcctggcttccgaggatgccggtttcatcaccggctcgacccatcaagcgccaaatggcggccagttcttcgtctga

SEQ ID NO: 7355 - protein, 242 aa, Paracoccus denitrificans
MAKVALVTGGSRGIGAAISKALKEAGYTVAANYAGNDDAARAFTEETGIKTYKWSVADYDACAAGIKQVEEELGPIAVLVNNAGITRDAMFHKMTPQQWKEVIDTNLTGLFNMTHPVWSGMRDRKYGRIVNISSINGQKGQAGQANYSAAKAGDLGFTKALAQEGARAGITVNAICPGYIGTEMVRAIDEKVLNEGIIPQIPVAAWAEPEEIARCVVFLASEDAGFITGSTHQAPNGGQFFV

SEQ ID NO: 7356 - DNA, 726 bp, Rhizobium meliloti
  CDS (1)..(726)
atgagcagggtagcactggtaacgggcggatcccgcggcattggcgctgcgatttgcgtggcgctgaaggctgcgggctacaaggtggccgcaaactatgccggaaatgacgagagggccaaggccttcgagcaggaaagcggcattcccgtctacaaatgggacgtatcgagctatcaggcctgcgtcgatggcatcgccagggtcgaggccgacctcggaccggtcgacatcctcgtcaacaatgccggcatcacccgtgacgccatgttccacaagatgacgccggaacagtggggcgaagtgatcggcaccaatctcaccggcgtcttcaacatgacgcatccgctgtggtcgggcatgcgcgaccgcggcttcggccgtatcgtcaacatctcgtcgatcaacggccagaaggggcagatgggccaggtgaactattccgccgccaaggccggcgatctcggcttgaccaaggcgctggcccaggaaggggcggcgaaagggatcaccgtcaacgcgatttgccccggctatatcggcaccgagatggtgcgcgccgttccggaaaaggtgctcaacgagcggatcattccccagatacccgtcggacgcctcggcgagccggaggaagtggcacgctgcgtcgtgtttctcgcttccgacgacgcgggcttcatcaccggctcgacgatttcggccaatggcggccagtacttcgcctga

SEQ ID NO: 7357 - protein, 241 aa, Rhizobium meliloti
MSRVALVTGGSRGIGAAICVALKAAGYKVAANYAGNDERAKAFEQESGIPVYKWDVSSYQACVDGIARVEADLGPVDILVNNAGITRDAMFHKMTPEQWGEVIGTNLTGVFNMTHPLWSGMRDRGFGRIVNISSINGQKGQMGQVNYSAAKAGDLGLTKALAQEGAAKGITVNAICPGYIGTEMVRAVPEKVLNERIIPQIPVGRLGEPEEVARCVVFLASDDAGFITGSTISANGGQYFA

SEQ ID NO: 7358 - DNA, 1359 bp, Brachydanio rerio
  CDS (83)..(796)
ggcgtccataacttcagttcacttttagcgacaaacaataaagaaaaaaaactagcgtatgaaattgacattaacgctggggatgtccaggctggctgtggtgttcgggggttcgcgtggcatcgggcgagcagcctctaagctgttggcacagaggggtcacaggattgtgctgttgtctaggaataaagaagctgcacagtccactgctcaatctctccctggagaaaaccatttgggcctaagctgcgatgtctcaaaagaagaagaggttcagaaagcgtttgagaccatcaataagacctgtggcactgtagggttcctggtcaatgcggctggcatcaacagagatgcgctattattgaggagtaaatctgaagacatgctgtctgttttgcacactaacctgctgggctccatgctcacatgtaaggccgctgtacgaaacatgctcagtcatggaggagccattgtcaacatcggttcagtggtgggtgtgaagggtaacgctggtcagtgtgtgtacagcgccagtaaagctggactagagggattcactcgctcactggcaaaggaagtggcttcccgtaacatacgagtgaacttggtggctccaggattgattcacacagacatgactgcaggactggcagaagaagcagcggtgaggaccattccattgggccgttttggggaacctgcagaagtggcccaggctatgcttttcctcctggagtcgccttatatcacaggacagattctgctggtggacggaggactgcagctgctgatgtaatgattctatgagtcactgaagtattaaagtgcatattttcgttttggtgattatacccaatatctctatttaggggttgagtcaaagcttgatattgttaatcttcttctcattgctgtgtggaattctgagtcatgtaaaacattgtgtaagagtagttttggaccgtctggattagattaatgttatttttagttcactggagtttttgggttattgctgcatgttccatacttaagataatggaggtcacagatcaaccagcggaggatatgactcgttttgtgatgtcatttctatttttagcatacatattttattcagatataaatgatgttagaatcgcaggtttgtaaaagatcagaaatatacagattttaaaatcaagaatgaactaaacactgaaaaaaaaatatttatagatgattccttgaattaactacattttttttttcgttaaatggttgtaatcaatttatttgggctgaatttaaacaagttaagttgaatattattacatttgtttaaatttaccacaaaaaaaaaaaaaaaaaaaaaaaaaa

SEQ ID NO: 7359 - protein, 237 aa, Brachydanio rerio
MSRLAVVFGGSRGIGRAASKLLAQRGHRIVLLSRNKEAAQSTAQSLPGENHLGLSCDVSKEEEVQKAFETINKTCGTVGFLVNAAGINRDALLLRSKSEDMLSVLHTNLLGSMLTCKAAVRNMLSHGGAIVNIGSVVGVKGNAGQCVYSASKAGLEGFTRSLAKEVASRNIRVNLVAPGLIHTDMTAGLAEEAAVRTIPLGRFGEPAEVAQAMLFLLESPYITGQILLVDGGLQLLM

SEQ ID NO: 7360 - DNA, 883 bp, Xenopus laevis
  CDS (41)..(751)
gaatctccctgcagctctgatatagtgacagatttaggagatgagcaaggtgtgtgctgtttttggaggatctagaggaatcggcaaagccgttgcaaagttattggctcagaaggactataaagttgcagttatatctagaaaccttgaagtggctcaagcagcagtaacagagattggagctcacctggccctcagctgtgatgtctccaaggagaatgagatccagtgcacattcaaagaaattaagaacaatttgggcaacattgactatctggttaattctgcaggcatcagtagagatgcactgttactaagaacaagatctgaggatattatgtctctcctctccatcaatctggtgggcacaattcagacatgcaaagtggcactcaaaggtatgattcagcagcaaggaggatccatcgtaaacataggaagcattgttggtcacaaaggaaacattggtcagagcatttacggtgccagtaaggaagggttgattggattctccaagtccctcgctaaagaagtggcaaaaaggaacatccgagttaatgtagttgcaccaggtttcattcgcactgatatgacttcagatttaaaagaagattccctaaataaaatgatccccttgggcaggtttggagagccagaagaagttgcccaatcagtcttgttcttattggaatccccttatatcacaggacatgttttagtagttgatggtggcctccagctgcacctttaggtttttttttcatcttccacaaatacaaagtatattgaagcctatatattcttaatggtttaaagttgtatattgcatattttaattactgtacgttgaaataaatataagaatagtaaaaaaaaaaaaaaa

SEQ ID NO: 7361 - protein, 236 aa, Xenopus laevis
MSKVCAVFGGSRGIGKAVAKLLAQKDYKVAVISRNLEVAQAAVTEIGAHLALSCDVSKENEIQCTFKEIKNNLGNIDYLVNSAGISRDALLLRTRSEDIMSLLSINLVGTIQTCKVALKGMIQQQGGSIVNIGSIVGHKGNIGQSIYGASKEGLIGFSKSLAKEVAKRNIRVNVVAPGFIRTDMTSDLKEDSLNKMIPLGRFGEPEEVAQSVLFLLESPYITGHVLVVDGGLQLHL

SEQ ID NO: 7362 - DNA, 756 bp, Pseudomonas sp
  CDS (1)..(756): n means a or g or c or t/u
atgggtactgcgagcaatgcggcacgtatagctctggtcaccggtggtatgggcggtatcggtacggcgatcagccagcgcctgcatcgggatggcttcaccgtggtggtgggctgtaatccctactccagccgcaaggcttcctggattgccacgcaactcgaggcgggctttcacttccactgcatcgactgcgacatcaccgactgggatagcacccgccaggccttcgacatggtgcacgagactgtcggcccgatcgatgtattggtcaacaatgccggcatcacccgcgacggcactttccgcaagatgtccccggaaaactggaaggcggtgatcgataccaatctcaccggcctgttcaacacaaccaagcaggtcatcgagggcatgctggccaagggctggggacgcgtcatcaacatctcctcaatcaatggccagcgaggccagttcgggcagaccaactactccgcggncaaggctggcattcatggcttcagcatggccttggcccgcgaggtgagtggcaagggcgtgaccgtcaatacggtttcccctggctacatcaagaccgacatgaccgcggcgattcgcccggacatcctcgaagacatgattactggcattcccgtgggccgtctcggccagcccgaggagatcgcctcgatcgtggcctggctggcctccgatcagtctgcctatgccaccggcgccgacttctcggtgaatggcggcatgaacatgcagtga

SEQ ID NO: 7363 - protein, 251 aa, Pseudomonas sp
  misc_feature (161)..(161): Xaa can be Asp or Gly or Ala or Val
MGTASNAARIALVTGGMGGIGTAISQRLHRDGFTVVVGCNPYSSRKASWIATQLEAGFHFHCIDCDITDWDSTRQAFDMVHETVGPIDVLVNNAGITRDGTFRKMSPENWKAVIDTNLTGLFNTTKQVIEGMLAKGWGRVINISSINGQRGQFGQTNYSAXKAGIHGFSMALAREVSGKGVTVNTVSPGYIKTDMTAAIRPDILEDMITGIPVGRLGQPEEIASIVAWLASDQSAYATGADFSVNGGMNMQ

SEQ ID NO: 7364 - DNA, 750 bp, Treponema hyodysenteriae
  CDS (1)..(750)
atggacttaaatcttaaaaataaaacagctatagtaacaggttcaagcagaggaataggaaagaaaatagcagaaactcttgctaaagaaggagttaatgttgtaatcactgctacaaactttgaaaaagcctctcaagttgctgaagaaataaaatcatctttcaatgtagaaaccttagcattacagcatgatgcaaaatcaagcgaatcatgcaaagaagtaattgctaaaacaatagaaaaatttggttctatagatatacttgtaaataatgcaggtattactaaagatatgttagttctacaaatggaagataatgcttggaatgatgtaatatcaacaaatctttcaggtactttctatatgtctagagaagcagctaaatctatgcttagagcaagaaaaggcaaaataataaatatatcaagcgttattggaaaaatgggaaatgccggacaggttaattattctgctgctaaggctggtattataggaatgacaaaatctatggctaaagaatttgcacctagaaatatatgtgtaaatgcaattgctccaggattcatacaaactgatatgacaggagttttacctgaagatacagtaaaaggaattatgagcattacaccattaaaaagattaggtactcctgaagatgtatctaacttagtattatttttagcctcagatatgagcagttatatcacaggagaagtaatagctgttgacggcggaatgtcaatgtaa

SEQ ID NO: 7365 - protein, 249 aa, Treponema hyodysenteriae
MDLNLKNKTAIVTGSSRGIGKKIAETLAKEGVNVVITATNFEKASQVAEEIKSSFNVETLALQHDAKSSESCKEVIAKTIEKFGSIDILVNNAGITKDMLVLQMEDNAWNDVISTNLSGTFYMSREAAKSMLRARKGKIINISSVIGKMGNAGQVNYSAAKAGIIGMTKSMAKEFAPRNICVNAIAPGFIQTDMTGVLPEDTVKGIMSITPLKRLGTPEDVSNLVLFLASDMSSYITGEVIAVDGGMSM

SEQ ID NO: 7366 - DNA, 750 bp, Brachyspira pilosicoli
  CDS (1)..(750)
atggatttaaatcttaaaaataaaatagctttagtaacaggcggaagcagaggaataggaaaaaaaatagcagaggctttggctaatgaaggagctaatgttgttgttactgctacaaatattaataaagctcaagaagttgctgatgaattaaaatcaaaatacaatgtagagacacttgctttagttcatgatgtaaaatctagcgaatcttgtaaagatgttgttgctaaaactatagagaaatttggttctattgatatattagttaataatgctggtattactagagatatgctagttatacaaatggacgacagtgcttggaacgatgttatagatactaatttatctggagcattttacacttcaagagaagctgctaaaagcatgttaagagcaagaaagggtaagataattaatatatcaagcgttataggaaaaatgggtaatgctggtcaggtgaattatgctgcagctaaggctggtattataggtattactaaatctatggcgaaagagtttgctcctcgaggaatatgcgttaatgctatagcacctggatttattcaaacagatatgactggtgtacttgctgaagatgctgtaaaaaagataatggatattacacctttaaaaaagttaggtaatgctgaagatgttgctaatatagttgtatttcttgcatcagatttgagcaattatataacaggggaagttatagccgttgacggcggaatgtctatgtaa

SEQ ID NO: 7367 - protein, 249 aa, Brachyspira pilosicoli
MDLNLKNKIALVTGGSRGIGKKIAEALANEGANVVVTATNINKAQEVADELKSKYNVETLALVHDVKSSESCKDVVAKTIEKFGSIDILVNNAGITRDMLVIQMDDSAWNDVIDTNLSGAFYTSREAAKSMLRARKGKIINISSVIGKMGNAGQVNYAAAKAGIIGITKSMAKEFAPRGICVNAIAPGFIQTDMTGVLAEDAVKKIMDITPLKKLGNAEDVANIVVFLASDLSNYITGEVIAVDGGMSM

SEQ ID NO: 7368 - DNA, 741 bp, Geobacter sulfurreducens
  CDS (1)..(741)
atggaatttaaggatagcatcgtggtcgtcaccggagggacccgcgggatcggccgggccatttcccttcacttcgcccggcaaggggcactggtgaccgccgcctaccgcgccgacgatgaggcggcccgcgccctggaagccgaggcggcggggctgcccggctccattgccgtgatacgggcggacgtgggcacggcagagggggccatggccgtcatcgacgcggcgagcggggagagcggcaccctccacgtcctcgtgaacaacgcggggatcatccgggacggctacctggccatgatggccgaggacgactgggatgcggtcatgcgggccaacctctctcccctcttccactgctgcaagtggggggtacggaagatgctcgccagacgaaggggcgccatcatcaacctctcttccgtatcggcctttgccggcactgccgggcagaccaactacgccgcaaccaagggggccgcggtcagtttcaccaaatctctggcccgggaagtgggccctctcggcatcagggtgaacgccgtggcgccgggactcatcgaaacggagatgattgccggcatgaagcgggagatggtcgatcggatcgtgggtagcagcatcctcggccgcaccgggcgcccggaggaagtggccgaagcagtggccttcctggcctcggaccgggcatcctacataaccggccagtgcctcgtggtcgacggcggaatcctctga

SEQ ID NO: 7369 - protein, 246 aa, Geobacter sulfurreducens
MEFKDSIVVVTGGTRGIGRAISLHFARQGALVTAAYRADDEAARALEAEAAGLPGSIAVIRADVGTAEGAMAVIDAASGESGTLHVLVNNAGIIRDGYLAMMAEDDWDAVMRANLSPLFHCCKWGVRKMLARRRGAIINLSSVSAFAGTAGQTNYAATKGAAVSFTKSLAREVGPLGIRVNAVAPGLIETEMIAGMKREMVDRIVGSSILGRTGRPEEVAEAVAFLASDRASYITGQCLVVDGGIL

SEQ ID NO: 7370 - DNA, 741 bp, Geobacter sulfurreducens
  CDS (1)..(741)
atgagtcttgctggaaaaatcgcagtggttacaggagcttctcgtggcatcggcagggagatcgccctccggctcgcccgtgagggcgctgatgttgcagtgaccgctacaaccctcgacagtgcccggaaaaccgcggacgagatagagcagatcggccggagagccctcgcgctggctgtggacgtggcggatgcggcggctgtggaagcgctgttcgcctcggtggtagaagcttttggcaaggttgatattcttgtcaacaatgccggcattacccgggacggcctgttgctgcggatgaaagatgccgattgggacgccgtactcgatgtgaacctcaagggcgccttcaattgcacgcgtgaagctgcaaaactcatgaccaaggcccggagcggccgcatcgtcaacattggctctgtggtgggcgagatgggaaatgcgggacaggtcaactattgcgccagcaaggcggggatgataggtatgaccaaggctgtcgcccgggaactggccaagcgcgggattaccgtcaatgccgtcacccctggttttatcgaaacagatatgacggcggttctttccgaaaaggtgcgtgagtcgctcatgcagcagattccgctggagcggttcggttcccccgaggatattgccaacgcggtccacttcctcgtgtccgacatggggagttatattaccggccacgtcctgtccgttaacggcgggatgtacatgtag

SEQ ID NO: 7371 - protein, 246 aa, Geobacter sulfurreducens
MSLAGKIAVVTGASRGIGREIALRLAREGADVAVTATTLDSARKTADEIEQIGRRALALAVDVADAAAVEALFASVVEAFGKVDILVNNAGITRDGLLLRMKDADWDAVLDVNLKGAFNCTREAAKLMTKARSGRIVNIGSVVGEMGNAGQVNYCASKAGMIGMTKAVARELAKRGITVNAVTPGFIETDMTAVLSEKVRESLMQQIPLERFGSPEDIANAVHFLVSDMGSYITGHVLSVNGGMYM

SEQ ID NO: 7372 - DNA, 744 bp, Treponema denticola
  CDS (1)..(744)
atgttattaaaaggaaaaaaagcattggtaacaggctcttcgcgaggaatcggaaaagaggttgttagaagatttattgaagagggagccgaagtttggggcttatgtacaaaaccttctgcaagcaaggcggaaatggaagcttttgcaaaagaaaaaggaagcacatttcatgaaatatacgctgactgcggcaatgcggaaggccttaccgaaacggtaaaaaaagccctcgaagaatccggcggctttgacatacttgtaaacaacgcaggtattacaagagacggcctttcatttaggatgaagctttccgactgggaagacgttttacgcgtaaacttaacaggcgtttttgtcgcctcgcaaattgtttcttccgatatgattagaaaaagagccggctcgattatcaatatgacaagtatcgtaggccttcacggtcaaggcggacaggtcaactattccgcaagcaaggctggccttataggttttacaaagagccttgcaaaagaaacggcaggaagaggagtacgcgtaaacgccatcgcccccggctatatcgaaaccgatatgacagccgccgtaaacgaagaaatgcggaaggcatggatcgagggcattcccttaaaaagagcagggctgcccctagacatagcaaacgccgcagtctttttggcttcggacttatcgctttatataaccgcccaagtcctaggagtcgacggcggactgggagcataa

SEQ ID NO: 7373 - protein, 247 aa, Treponema denticola
MLLKGKKALVTGSSRGIGKEVVRRFIEEGAEVWGLCTKPSASKAEMEAFAKEKGSTFHEIYADCGNAEGLTETVKKALEESGGFDILVNNAGITRDGLSFRMKLSDWEDVLRVNLTGVFVASQIVSSDMIRKRAGSIINMTSIVGLHGQGGQVNYSASKAGLIGFTKSLAKETAGRGVRVNAIAPGYIETDMTAAVNEEMRKAWIEGIPLKRAGLPLDIANAAVFLASDLSLYITAQVLGVDGGLGA

SEQ ID NO: 7374 - DNA, 735 bp, Wolbachia pipientis wMel
  CDS (1)..(735)
atgtttggattggaaagcagaaagttcctgattactggtgcatcaggcggaatagggcaagcaattgtaaaaattatgcacaaagccggagcaactttatgtgtttctggcacaaaaaaagaagtgctcgaagaagttgctaaacaatatgaaaaaaatatgcacgtactcccttgtgatttatcaaatgctgaggaagtaaatcaactagtaaacagagcaagtgagttgatggaaggctttgacgggcttgtatgcaacgcgggcattacgcaagacagtttattattgagaatgacagatgaaacatggcaaaaagtaattgatattaacttgagttctacatttaagctgagtagagaagcatgcaggaaactaattaagaataattggggaagaattataaatatttcctcaataatagggctgacaggaaacgccgggcaagcaaattatgcagcgtctaaagctggaataatagctatgagcaaatctatagcaaaagaagttgcaagtcgtaatataacagtaaattgtattgctcctgggtttatagatactaaaatgactgaagttttaaatgaagtgcaaaagggaaaaatattagataatattccaatgaaaagaatgggaacaggggaagaaatagcagcaggggtcttatttttagcaagtgatgaagcaaaatatataacagggcatgtgcttaacattaatggtgggttatttatgtag

SEQ ID NO: 7375 - protein, 244 aa, Wolbachia pipientis wMel
MFGLESRKFLITGASGGIGQAIVKIMHKAGATLCVSGTKKEVLEEVAKQYEKNMHVLPCDLSNAEEVNQLVNRASELMEGFDGLVCNAGITQDSLLLRMTDETWQKVIDINLSSTFKLSREACRKLIKNNWGRIINISSIIGLTGNAGQANYAASKAGIIAMSKSIAKEVASRNITVNCIAPGFIDTKMTEVLNEVQKGKILDNIPMKRMGTGEEIAAGVLFLASDEAKYITGHVLNINGGLFM

SEQ ID NO: 7376 - DNA, 741 bp, Bacillus cereus
  CDS (1)..(741)
atggagtttttaaatgggaaaacagctgttgtaacaggagctgcacagggaattggaaaagagattgcacgggtgtatgcaaagctaggggcgaaagtattaattagcgacgtaaatgaagagaagctacaaaaaacgacacgtgagttatcggacgaaggatatgaagtgtgctcatatcgatgtgatgtgagtaatcaaaatgaagcgaagtcgttaattgaatatgcggttcaaaaatttggtacattacatattttggtgaacaatgctggaattacaagagatgcaatgttacataaaatggagaagtctgcttgggaacaagtattacaagtgaacttaactggtgttttttattgtatgcaaccagctctcctttacatgagacaacaagggtatggacgtattattaatatatcttcaattagtagagaaggaaacataggtcaagcaaactatgcagctacgaaggcaggcgttgtaggtttaacgaaaacggcagcgaaagaagttgggaattttggtattacgtgtaatgcgatttgtccaggatttatggatacagatatgacaaaaacgataccagataaagtgaaagaaaagatggtcggcgcgattccagttggtagaattggaacgccagaagatattgcgaacgcagcagcctttttagcatcagaatacgcatcctatattacaggagaagtattgaatgtgagcggaggactgcaagtttaa

SEQ ID NO: 7377 - protein, 246 aa, Bacillus cereus
MEFLNGKTAVVTGAAQGIGKEIARVYAKLGAKVLISDVNEEKLQKTTRELSDEGYEVCSYRCDVSNQNEAKSLIEYAVQKFGTLHILVNNAGITRDAMLHKMEKSAWEQVLQVNLTGVFYCMQPALLYMRQQGYGRIINISSISREGNIGQANYAATKAGVVGLTKTAAKEVGNFGITCNAICPGFMDTDMTKTIPDKVKEKMVGAIPVGRIGTPEDIANAAAFLASEYASYITGEVLNVSGGLQV

SEQ ID NO: 7378 - DNA, 741 bp, Bacillus cereus
  CDS (1)..(741)
atgttaaaagggaaagtagcattagtaacgggtgcttcacgtggaattggtcgtgcaattgcgattgatttagcaaaacaaggggcaaatgttgtagtaaattatgctggtaacgagcaaaaggcaaatgaagtagttgatgaaataaagaaattaggttcggatgcaattgcagtaagagcagatgttgcaaatgctgaagacgttacaaatatggtgaaacaaactgtagatgtatttggacaagttgatattcttgtaaataatgcaggtgtaacaaaagataatttattaatgcgtatgaaagaagaagaatgggatacagttattaatacaaacctaaaaggtgtattcttatgtacaaaggcagtatctcgatatatgatgcgtcaacgtcatggacgtattgtaaatatcgcttctgttgtcggagtaacgggaaacccaggacaagcaaactatgttgctgctaaagcgggtgtaatcggattaacaaaaacatcagcaaaagagctagcaagccgcaatattactgtaaatgcaattgctcctggatttattgcgacagatatgacagacgtattagatgaaaatataaaagctgaaatgttaaaattaattcctgcggctcagtttggtgaagcgcaagatatcgcaaatgctgtaacgttttttgcttctgatcaaagcaaatatattacaggtcaaacgttaaatgttgatggcggtatggtaatgtaa

SEQ ID NO: 7379 - protein, 246 aa, Bacillus cereus
MLKGKVALVTGASRGIGRAIAIDLAKQGANVVVNYAGNEQKANEVVDEIKKLGSDAIAVRADVANAEDVTNMVKQTVDVFGQVDILVNNAGVTKDNLLMRMKEEEWDTVINTNLKGVFLCTKAVSRYMMRQRHGRIVNIASVVGVTGNPGQANYVAAKAGVIGLTKTSAKELASRNITVNAIAPGFIATDMTDVLDENIKAEMLKLIPAAQFGEAQDIANAVTFFASDQSKYITGQTLNVDGGMVM

SEQ ID NO: 7380 - DNA, 738 bp, Thermus thermophilus
  CDS (1)..(738)
atgcgtaaggccttgatcaccggagcaagccgcggcatcggtcgggccatcgccctgaggctcgcggaggacggcttcgccctggccatccactacggccagaaccgggagaaggccgaggaggtggcggaggaggcgaggcgccggggaagccccctggtggcggtcctcggggcgaacctcctggaggccgaggcggccaccgccctcgtccaccaggcggcggaggtcttagggggcttggacaccctggtgaacaacgccggcatcacccgggacaccctcctcgtgcgcatgaaggacgaggactgggaggcggtcctcgaggccaacctctccgccgtcttccgcaccacccgggaggcggtgaagctcatgatgaaggcccgcttcggccgcatcgtcaacatcaccagcgtggtggggatcctgggcaacccgggccaggccaactacgtggcctccaaggcggggctcatcggcttcacccgggcggtggccaaggagtacgcccagcgggggatcacggtgaacgccgtggccccggggttcattgagacggagatgacggaaaggctcccccaggaggtcaaggaggcttacctaaagcagatccccgccgggcgcttcggccgccctgaggaggtggccgaggccgtggccttcctcgtctcggagaaggcgggctacatcaccggccagaccctctgcgtggacggggggcttaccccccactga

SEQ ID NO: 7381 - protein, 245 aa, Thermus thermophilus
MRKALITGASRGIGRAIALRLAEDGFALAIHYGQNREKAEEVAEEARRRGSPLVAVLGANLLEAEAATALVHQAAEVLGGLDTLVNNAGITRDTLLVRMKDEDWEAVLEANLSAVFRTTREAVKLMMKARFGRIVNITSVVGILGNPGQANYVASKAGLIGFTRAVAKEYAQRGITVNAVAPGFIETEMTERLPQEVKEAYLKQIPAGRFGRPEEVAEAVAFLVSEKAGYITGQTLCVDGGLTPH

SEQ ID NO: 7382 - DNA, 738 bp, Thermus thermophilus
  CDS (1)..(738)
atgcggctcaaggacaaggcggtgctcatcacaggggcggcccacggcatcggccgggccacgttggagctcttcgccagggaaggggcgaggctcgtggcctgcgacatagaggaaggccccttaagggaggcggcggaggcggtgggggcccatccggtggtgatggacgtggccgaccccgcctccgtggagcgggggtttgccgaggccctggcccacctgggccggctggacggggtggtgcactacgccgggatcacccgggacaacttccactggaagatgcccctggaggactgggagcttgttctccgggtgaacctcacggggagcttcctggtggccaaggcggccagcgaggccatgcgggagaaaaaccctgggagcatcgtcctcaccgcgagccgggtctacctggggaacctggggcaggcgaactacgccgcctccaaggcgggggtggtggggcttacccggacgttggccctggagcttgggcggtgggggatccgggtgaacgccctggccccggggttcattgagacgcggatgacggccaaggtgccggagaaggtgcgggagaaggccatcgccgccacccccttgggccgggcggggaagcctttggaggtggcctacgccgccctctttttggtctccgacgagtccagcttcatcaccggccaggtcctcttcgtggacggggggaggaccatcggggcggccccggcctaa

SEQ ID NO: 7383 - protein, 245 aa, Thermus thermophilus
MRLKDKAVLITGAAHGIGRATLELFAREGARLVACDIEEGPLREAAEAVGAHPVVMDVADPASVERGFAEALAHLGRLDGVVHYAGITRDNFHWKMPLEDWELVLRVNLTGSFLVAKAASEAMREKNPGSIVLTASRVYLGNLGQANYAASKAGVVGLTRTLALELGRWGIRVNALAPGFIETRMTAKVPEKVREKAIAATPLGRAGKPLEVAYAALFLVSDESSFITGQVLFVDGGRTIGAAPA

SEQ ID NO: 7384 - DNA, 744 bp, Desulfovibrio vulgaris
  CDS (1)..(744)
atgagcgaacttacccccaccgccatcgtcaccggcgggtcgcgtggcatcggcaaggccgttgccgaaacgctggcccgtgccggtcttcaggtgttcctgacctacgtgagcaagcctgatgaggccgaggccgtcgccgcaggcatccgcgacgcaggcggaagcgccactgccttccgactcgacgtctccgacgccgccgccgttgccgccttcttccagtccgaaatcaaggacaaggtgcgcctcgacgtgctggtcaacaacgcgggcatcaccaaggacggcctcatcatgcgcatgaaggacgaggatttcgaacgggttctcgacgtgaacctgtgcggcgccttcacctgcctgcgcgaggcatcgaaactgatgacccgccagcgtctcgggcgtatcatcaacatcacctctgtcgtcgggcagatgggcaacgccgggcaggccaactactgcgcggcaaaagccggtctcatcgggctcaccaagtcggccgcgaaggaacttgccgcccgcaacgtcacggtcaacgccgtggcccccggcttcatcgaaacggatatgacggcgggcctccctgaagaggttcgcaaagcatatgtcgaggccatcccgctgcgtcgtctgggttccgcccaggacatcgcggacgcagtggcctttctggcctcggaaagggcatcgtacatcaccggacaggttctcgccgtcaacggcggcatgtactgctga

SEQ ID NO: 7385 - protein, 247 aa, Desulfovibrio vulgaris
MSELTPTAIVTGGSRGIGKAVAETLARAGLQVFLTYVSKPDEAEAVAAGIRDAGGSATAFRLDVSDAAAVAAFFQSEIKDKVRLDVLVNNAGITKDGLIMRMKDEDFERVLDVNLCGAFTCLREASKLMTRQRLGRIINITSVVGQMGNAGQANYCAAKAGLIGLTKSAAKELAARNVTVNAVAPGFIETDMTAGLPEEVRKAYVEAIPLRRLGSAQDIADAVAFLASERASYITGQVLAVNGGMYC

SEQ ID NO: 7386 - DNA, 726 bp, Rhodopseudomonas palustris
  CDS (1)..(726)
atgacgcgggtggcgttggtgactggggggacgcgcggtatcggtgcagcaatcagcaaggcgttgaaagcggcgggctacaaagtcgcagcgtcttatgcgggcaacgattcggcagcggagaaattcaaaaacgagacgggtattccggtatataaatgggacgtgagttcgttcgatgcctgtgccgagggcgtcaagaaagtcgaggccgaactcggtcccgtcgatgttctggtcaacaatgccggcatcacgcgcgacggcgcctttcacaagatgacgctcgagcaatggaatgcggtgatcaataccaatctcggctcgctgttcaacatgacccggcaggtgatcgaaggcatgcgcacgcgcaagttcgggcgcatcgtcaacatctcgtcgatcaacggtcagaaggggcagttcggtcaggtgaactattcggccgcgaaggccggcgacatcggcttcaccaaagcgctggcgctggagaatgcgcgcggcggcatcaccgtcaatgtgatctgcccgggctacatcaacaccgaaatggtgcaggccgtgccgaaggacgtgctcgacaaggcgatcctgccgctgattccgtgcaaccggctcggcgaagccgaggagatcgcgcgcgccgtggtgttcctcgccggcgacgatgcgggctacatcacaggttcaacgctcaccatcaacggcggccaatacatggtttga

SEQ ID NO: 7387 - protein, 241 aa, Rhodopseudomonas palustris
MTRVALVTGGTRGIGAAISKALKAAGYKVAASYAGNDSAAEKFKNETGIPVYKWDVSSFDACAEGVKKVEAELGPVDVLVNNAGITRDGAFHKMTLEQWNAVINTNLGSLFNMTRQVIEGMRTRKFGRIVNISSINGQKGQFGQVNYSAAKAGDIGFTKALALENARGGITVNVICPGYINTEMVQAVPKDVLDKAILPLIPCNRLGEAEEIARAVVFLAGDDAGYITGSTLTINGGQYMV

SEQ ID NO: 7388 - DNA, 738 bp, Rhodopseudomonas palustris
  CDS (1)..(738)
atgttcgatctgacaggcagaaccgcgctggtcaccggcgcaaccggtggcatcggcggcgcgatcgcccaggcgctgcacggccagggcgccaccgtggcgatctccggcacgcggcgcgaggcgctcgacgcgctggccgccaagctcggcgaacgcgtgcacgtgctgccttgcaatctgtcggacgcggcggacgtcgaggcgctggtgccggctgcggccgaagccatgggcgggctcgacatcctagtatgtaacgcaggtatcacccgcgacaatctgttcgtgcaattgcgcgacgaggattgggacgaggtgatcaaggtcaacctcacggcgaccttccggctgacgcgcgctgccaccaagctgatgatgcgcaagaagttcggccgcatcatcgcgatcacttcggtggtcggtgtcaccggcaatccggggcagggcaactacacggcctcgaaggcgggcttgattggcatgatcaagacgatcggcgccgaatacgccaagcgcaacgtcacggcgaactgcattgcgccgggcttcatcgcgacgccgatgaccgacgttctcaatgacaagcagcgcgaggcgattctcggcaaggtgccggccggccggctcggcacgccggacgacattgcggctgcggcggtttatctcagttcgaatgaggccgcctacgtcaccggtcagaccattcacgtcaacggcgggatggcgatgatctga

SEQ ID NO: 7389 - protein, 245 aa, Rhodopseudomonas palustris
MFDLTGRTALVTGATGGIGGAIAQALHGQGATVAISGTRREALDALAAKLGERVHVLPCNLSDAADVEALVPAAAEAMGGLDILVCNAGITRDNLFVQLRDEDWDEVIKVNLTATFRLTRAATKLMMRKKFGRIIAITSVVGVTGNPGQGNYTASKAGLIGMIKTIGAEYAKRNVTANCIAPGFIATPMTDVLNDKQREAILGKVPAGRLGTPDDIAAAAVYLSSNEAAYVTGQTIHVNGGMAMI

SEQ ID NO: 7390 - DNA, 771 bp, Bdellovibrio bacteriovorus
  CDS (1)..(771)
atgcttaaaaggattttgcacatgagcggaaagtcgcttcaaggaaagaaaattgttgtcactggtggcagccgcggaattggcgctgctatcgttaagcttcttgctgatgaaggcgctcaagttgccttcacttactcttcccgcgaagaggccgctcaacaggtggctcactctttgaccggcgaaggtcacttttacatcaaaatggacatcgcgaacgaagaatctgtgaactctgctgtagatcacattctggaaaaatggagcgacatcgacggcgttgtgaacaatgccggcatcaccaaagacgggttgcttctgcgcatgaaatcagaagatttcgattctgtggtgaacaccaacctgcgcggcaccttcctggtgaccaaagcctttaccaaacccatgatgaaagcgcgcaaaggttccatcgtgaacatcgtgtctatcattggtgagactggcaacgccggtcaggcaaactatgccgcttccaaagccggcacgattgcgtttagcaaatccgtggcgctggagctgggttcccgcaatgtgcgcgtgaacaacgtggcccctggatacatcgcaacggaaatgacagatgttctttctgaagatgtgaaatccaaaatgatggagaaaattcccttggcaaaaatcggcgaaggatccgacgtggcgcaagccgtgcgcttccttttgagcgacgaatccaagtacatcaccggtcacaccttggatgtgaacggcggaatgcacatgaactaa

SEQ ID NO: 7391 - protein, 256 aa, Bdellovibrio bacteriovorus
MLKRILHMSGKSLQGKKIVVTGGSRGIGAAIVKLLADEGAQVAFTYSSREEAAQQVAHSLTGEGHFYIKMDIANEESVNSAVDHILEKWSDIDGVVNNAGITKDGLLLRMKSEDFDSVVNTNLRGTFLVTKAFTKPMMKARKGSIVNIVSIIGETGNAGQANYAASKAGTIAFSKSVALELGSRNVRVNNVAPGYIATEMTDVLSEDVKSKMMEKIPLAKIGEGSDVAQAVRFLLSDESKYITGHTLDVNGGMHMN

SEQ ID NO: 7392 - DNA, 970 bp, Rattus norvegicus
  CDS (17)..(796)
cccacccgcagccgccatggcgtctcagctccggctccgttccgcgctggccctggtcacaggtgcgggtagcggcatcggtcgtgcgatcagcgtgcgcctagcggcagagggcgccgcagtggccgcctgcgacctggacggggcagcggcacaggacacggtgcggctgctgggaaacccagggagcgaggacagggagccgcgcgggaagcacgctgccttccaggcggacgtgtccgagggccccgcagccaaacgcctgctggagcaagtgcaggcctgcttttttcgcccgccatctgtcgttgtgtcctgtgcgggcatcacacgcgatgagtttctgctccacatgtcagaagaagactgggacagagtcatagctgtgaacctcaagggcaccttcctagtcactcaggctgccgcccaggcattggtgtccagtggcggtcgtggctccatcatcaacattagtagcatcgttggaaaggtggggaatattggacaaacaaattatgcgtcctccaaagcaggagtgattgggctcacccagactgcagcccgggagcttggacgtcatggaattcgatgtaactcagtcctcccagggttcattgcaacgcccatgacccagaaaatgccagagaaagtgaaggacaaggtaactgcaatgattccgttgggacacatgggggaccctgaggatgtagcagatgtggttgcgttcctggcatcagaagacagtggatacatcacaggggcctccgtggaagtcagtggaggtcttttcatgtaaccgcctgctggaagccggactctgctcactcccccaccactgcctggcctcctgctgatgaggacgctaagttcccaggctacaaaagagatggcagtgtgtggctcaggcatgctgaatatggaaggcaggggtgcttgtgaccctaataaattccaaatcctcttccctgcc

SEQ ID NO: 7393 - protein, 259 aa, Rattus norvegicus
MASQLRLRSALALVTGAGSGIGRAISVRLAAEGAAVAACDLDGAAAQDTVRLLGNPGSEDREPRGKHAAFQADVSEGPAAKRLLEQVQACFFRPPSVVVSCAGITRDEFLLHMSEEDWDRVIAVNLKGTFLVTQAAAQALVSSGGRGSIINISSIVGKVGNIGQTNYASSKAGVIGLTQTAARELGRHGIRCNSVLPGFIATPMTQKMPEKVKDKVTAMIPLGHMGDPEDVADVVAFLASEDSGYITGASVEVSGGLFM

SEQ ID NO: 7394 - DNA, 735 bp, Photobacterium profundum
  CDS (1)..(735)
atgagcctggaaggtaaagttgctctagttacgggtgcaagccgtggtattggtcgtgcaattgctgaaattttggttgagcgtggcgcaactgttattggcactgcaacgtctgaaagcggcgcagaagcaattagcgcatatttaggtgataaaggtaaaggtttagccctgaacgtgacttcacctgattccattgctgatacactaaagcagattaaagatcagttcggcgatattgatattttggtaaacaatgcgggtattactcgtgataacttgctaatgcgtatgaaagatgacgaatggcaagatattatggatactaacctaacatctgttttccgtctttctaaagcagtgctacgtgccatgatgaaaaaacgcaatggtcgtatcatcagcattggctctgttgtcggaatgatgggtaatgcaggtcagactaactatgcagcggcgaaggctggtttgattggtttcactaaatctctggcgcgtgaagtggcatctcgtggtattaccgtgaatgcggtagcaccaggttttattgaaacagatatgacaaaagccctgaatgatgagcaacgtgctgctacactagcaaatgttcctgctggtcgtttaggtgatccgcgtgaaattgcagcagcagttgcttttttagcttcagaagatgctgcttatgtaaccggtgaaacgttacatgttaacggcggcatgtacatgatttaa

SEQ ID NO: 7395 - protein, 244 aa, Photobacterium profundum
MSLEGKVALVTGASRGIGRAIAEILVERGATVIGTATSESGAEAISAYLGDKGKGLALNVTSPDSIADTLKQIKDQFGDIDILVNNAGITRDNLLMRMKDDEWQDIMDTNLTSVFRLSKAVLRAMMKKRNGRIISIGSVVGMMGNAGQTNYAAAKAGLIGFTKSLAREVASRGITVNAVAPGFIETDMTKALNDEQRAATLANVPAGRLGDPREIAAAVAFLASEDAAYVTGETLHVNGGMYMI

SEQ ID NO: 7396 - DNA, 726 bp, Photobacterium profundum
  CDS (1)..(726)
atgacccgacaggtattagtaacaggcgcgagcaaaggtattggacgtgctgttgctacacagcttgctaaagacggctttactgtcgtagtacattacatgagcgacaagtctggcgcagaagcaacattaagtgatattcagcacgctggcggttcgggtcgtatcattcaatttgatatcagtgatcgcgctcaatgccgtgaacaacttgaagccgacattgctgagtatggcgcttactatggcgtggtcagtaacgccggtattacccgcgataccgcattcccagcgatgacagaagaagaatgggatggcgttattcatactaatctcgacagcttttataacgtacttcacccttgcgttatgccaatggtacagaaacgaaaaggtggccgcattattacattagcctctgtttctggcattataggtaaccgtggtcaaaccaactatagcgcagcaaaagcaggcgtcattggtgcaaccaaatcgttagcactagagctggctaaacggaaaatcacggtgaactgtgtcgcacctggcttgatcgataccggtatggttgatgaccatgttaaagagcatgccttaccgcaagtaccattgcgccgtatgggtgaacctgaagaagtcgcgggtcttgttagctacttaatgtctgatatcgcggcgtatgtgacacgccaagtaatttcggtaaatggaggattaatatga

SEQ ID NO: 7397 - protein, 241 aa, Photobacterium profundum
MTRQVLVTGASKGIGRAVATQLAKDGFTVVVHYMSDKSGAEATLSDIQHAGGSGRIIQFDISDRAQCREQLEADIAEYGAYYGVVSNAGITRDTAFPAMTEEEWDGVIHTNLDSFYNVLHPCVMPMVQKRKGGRIITLASVSGIIGNRGQTNYSAAKAGVIGATKSLALELAKRKITVNCVAPGLIDTGMVDDHVKEHALPQVPLRRMGEPEEVAGLVSYLMSDIAAYVTRQVISVNGGLI

SEQ ID NO: 7398 - DNA, 744 bp, Photobacterium profundum
  CDS (1)..(744)
atgatgaataagaaagtattagtaacgggtgcgaagggcggaattggatcttcaattacaaatgttctgcttaatgcgggttatcgagttattgctggttactccccgaataataaagaatatgctattgaatggattaaaaaaaacaactattcagaaagccaggttcgcttactaccccttgatattactgacacccaatcttgcagggaatctcttgaatgtttgcttcaagatgaaggtcatatcgatgttctggtgaataacgcggggataacgcgagattcaacctttaaacgtatgtctgcagaactgtggaacgaggttatcaatactaatctcaatagtctgtttaatgtcactcaccctctttttgcttctatgtgtgagcgtggtaatgctcgcatcatcaatatctcctcagtcaatggcttaaaggggcagtttggtcagacgaactattcggcagccaaggctggcatgattggctttactaaggcccttgccgcagaaggcgctcgctttggggtaaccgttaatgccattgcgccaggctatacaggcacagcaatggtagaaacgattcaacctgccgcacttgaacgcatcaaagcacaaataccgatgggacgcctagctacaccagatgaagtcgctggagccgttgcttatcttgcaagtgacgctgccgcctatatcaccggagaaacgttgtccgttaacggcggtttatacatgcaataa

SEQ ID NO: 7399 - protein, 247 aa, Photobacterium profundum
MMNKKVLVTGAKGGIGSSITNVLLNAGYRVIAGYSPNNKEYAIEWIKKNNYSESQVRLLPLDITDTQSCRESLECLLQDEGHIDVLVNNAGITRDSTFKRMSAELWNEVINTNLNSLFNVTHPLFASMCERGNARIINISSVNGLKGQFGQTNYSAAKAGMIGFTKALAAEGARFGVTVNAIAPGYTGTAMVETIQPAALERIKAQIPMGRLATPDEVAGAVAYLASDAAAYITGETLSVNGGLYMQ

SEQ ID NO: 7400 - DNA, 765 bp, Photobacterium profundum
  CDS (1)..(765)
atgatgagcgcggagtcttttaaaatgaacaagaaagcattagttactggcgctaaaggtggtattggttcgtcgattacaaaaggattagttgaggcaggttatcgagtaatagccacatattttccaaacggagaagctaaggcaaaagaatggtttgaagagaataattattcagaagatcaggtccgtttattccctttggatgttacggatacaagtttttgtaaagaggctcttgcaacattattgcaggaagaaggtaacattgacgtattggttaataatgctggcattactcgtgactcgacatttaaacgtatgtcagcagcacaatggaatgaagtaatcaatacaaacctcaatagtttgttcaatgttacacatcctttgtttgactctatgtgtcagcatggaaatgctcgaattattaacattacttctgtaaacggtctaaaaggtcagtttggtcaggcgaactactcagcagcaaaagctggaatgattggctttaccaaagccttagctgcagaaggtgcccgttcgggtgtaaccgttaatgcaattgcacctggttacactggtacaccaatggttgaagcgattaagccggaagtattagactcaattaaagctgaaattccaatgaaacgtctagctatgccacaagaaattgctggcgcagtcactttcttagcaagtgatgcagcagcatatattacaggcgaaacgctgtcggtaaatggcggtttgtatatgaactaa

SEQ ID NO: 7401 - protein, 254 aa, Photobacterium profundum
MMSAESFKMNKKALVTGAKGGIGSSITKGLVEAGYRVIATYFPNGEAKAKEWFEENNYSEDQVRLFPLDVTDTSFCKEALATLLQEEGNIDVLVNNAGITRDSTFKRMSAAQWNEVINTNLNSLFNVTHPLFDSMCQHGNARIINITSVNGLKGQFGQANYSAAKAGMIGFTKALAAEGARSGVTVNAIAPGYTGTPMVEAIKPEVLDSIKAEIPMKRLAMPQEIAGAVTFLASDAAAYITGETLSVNGGLYMN

SEQ ID NO: 7402 - DNA, 25 bp, artificial sequence
  primer
atgaattttgaaggaaaaatcgcac

SEQ ID NO: 7403 - DNA, 24 bp, artificial sequence
  primer
ttagaccatgtacatcccgccgtt

SEQ ID NO: 7404 - protein, 53 aa, artificial sequence; identical to SEQ ID NO: 5292
  MISC_FEATURE (1)..(53): consensus for the disclosure of xaa see table XV

SEQ ID NO: 7405 - protein, 75 aa, artificial sequence; identical to SEQ ID NO: 5293
  MISC_FEATURE (1)..(75): consensus for the disclosure of xaa see table XV

SEQ ID NO: 7406 - protein, 100 aa, artificial sequence; identical to SEQ ID NO: 5294
  MISC_FEATURE (1)..(100): consensus for the disclosure of xaa see table XV

SEQ ID NO: 7407 - protein, 46 aa, artificial sequence; identical to SEQ ID NO: 5295
  MISC_FEATURE (1)..(46): consensus for the disclosure of xaa see table XV

SEQ ID NO: 7408 - protein, 688 aa, artificial sequence; identical to SEQ ID NO: 5296
  MISC_FEATURE (1)..(688): consensus Xaa in all positions is any amino acid

SEQ ID NO: 7409 - protein, 33 aa, artificial sequence; identical to SEQ ID NO: 4356
  MISC_FEATURE (1)..(33): consensus for the disclosure of xaa see table XV

SEQ ID NO: 7410 - protein, 36 aa, artificial sequence; identical to SEQ ID NO: 4357
  MISC_FEATURE (1)..(36): consensus for the disclosure of xaa see table XV

SEQ ID NO: 7411 - protein, 39 aa, artificial sequence; identical to SEQ ID NO: 4358
  MISC_FEATURE (1)..(39): consensus for the disclosure of xaa see table XV

SEQ ID NO: 7412 - protein, 323 aa, artificial sequence; identical to SEQ ID NO: 5813
  MISC_FEATURE (1)..(323): consensus Xaa in all positions is any amino acid.

SEQ ID NO: 7413 - protein, 45 aa, artificial sequence; identical to SEQ ID NO: 4350
  MISC_FEATURE (1)..(45): consensus for the disclosure of xaa see table XV

SEQ ID NO: 7414 - protein, 95 aa, artificial sequence
  MISC_FEATURE (1)..(95): consensus for the disclosure of xaa see table XV
GGDHLGPNXWXXXXXXXAXXXXXXXXXXYXXAGFXKXHLDXSXXCXXXXXXXXXXXXAXRAAXLXXXAEXXXXXXXXXXXXXXYXXGTEVPXPGG

SEQ ID NO: 7415 - protein, 90 aa, artificial sequence
  MISC_FEATURE (1)..(90): consensus for the disclosure of xaa see table XV
GXXXXXXRXXXXVXQPXVXFXXXXXXXXXXXXXXXLXXXXXXXXXXXXXEAHSTDYQXXXXXXXLVXXXXXXLKVGPXLTFAXREAXXXL

SEQ ID NO: 7416 - protein, 11 aa, artificial sequence
  MISC_FEATURE (1)..(11): consensus Xaa in position 1 is Tyr or Phe, xaa in position 3 is any amino acid, xaa in position 7 is Ile, Met or Val.
XSXSDRXRYYW

SEQ ID NO: 7417 - protein, 414 aa, artificial sequence
  MISC_FEATURE (1)..(414): consensus Xaa in all positions is any amino acid
  for the disclosure of the amendment in position 285 see table XVI
GXXXGIXSVCSAHPLVXEAAXXXXXXXXXXXLIEATXNQVXQXGGYTGMXPXDFXXXVXXXAXXXXXXXXXXXLGGDHLGPNXWXXXXAXXAMXXXXXXXXXYVXAGFXKIHLDXSMXCXXDXXPLXXXXXAXRAAXLXXXAEXXXXXXXXXXXXXYVIGTEVPXPGGXXXXXXXXXXXXXXXXXTXXXXAXXTXXXHXXAFXXXGXXXXXXRXIXXVVQPGVEFDXXXXXXYXXXXAXXLXXXXXXXXXXXXEAHSTDYQXXXAXXXLVXDHXAILKVGPXLTFALREAXFXLXXXXXEXXXXXXXXXXXXXXXEXXMXXXPXXWXXXYXXXXXXXXXXXXXSXSDRXRYYWXXXXXXXXXXXXXXXLXXXXXPXXLXSQXLPXXXXXXXXGXXXXXPXXXXXXXXXXXLXXY

SEQ ID NO: 7418 - protein, 369 aa, artificial sequence
  MISC_FEATURE (1)..(369): consensus Xaa in all positions is any amino acid
  for the disclosure of the amendment in position 285 see table XVI
XXXXXIXXXCSAHXXVXXXAXXXXXXXXXXXLXEATXNQVXXXGGYTGXXXXXFXXXVXXXAXXXXXXXXXXXXGGDHLGPNXWXXXXXXXAXXXXXXXXXXYXXAGFXKXHLDXSXXCXXXXXXXXXXXXAXRAAXLXXXAEXXXXXXXXXXXXXYXXGTEVPXPGGXXXXXXXXXXXXXXXXXTXXXXXXXTXXXHXXXXXXXGXXXXXXRXXXXVXQPXVXFXXXXXXXXXXXXXXXLXXXXXXXXXXXXEAHSTDYQXXXXXXXLVXXXXXXLKVGPXLTFAXREAXXXLXXXXXXXXXXXXXXXXXXXXXXXXMXXXPXXWXXXYXXXXXXXXXXXXXSXSDRXRYYWXXXXXXXXXXXXXXXL

SEQ ID NO: 7419 - protein, 29 aa, artificial sequence
  MISC_FEATURE (1)..(29): consensus for the disclosure of xaa see table XV
XDPXXPKXXXSXXXXXXXXXRXXXXXXXP

SEQ ID NO: 7420 - protein, 12 aa, artificial sequence
  MISC_FEATURE (1)..(12): consensus for the disclosure of xaa see table XV
XXXXXXXXXXXW

SEQ ID NO: 7421 - protein, 22 aa, artificial sequence
  MISC_FEATURE (1)..(22): consensus for the disclosure of xaa see table XV
XXXXXXXXXXXXXXYXXXXXXY

SEQ ID NO: 7422 - protein, 75 aa, artificial sequence; identical to SEQ ID NO: 5300
  MISC_FEATURE (1)..(75): consensus Xaa in all positions is any amino acid.

SEQ ID NO: 7423 - protein, 197 aa, artificial sequence
  MISC_FEATURE (1)..(197): consensus for the disclosure of xaa see table XV
KXXXKLXXXYXXXXXXLXXXXLXRXLILXPLVGXXFLPGGXXXFXXXXXXXXSXXXXIXXLXXXXXXXXXXXXTXLXXXXXXXXXXXXXXXXXXXHXXIXKXXSYSXXIXSXXLXXXXXXXXXXFKXKXXXXXXXXXXXXXXNXXXTXPXXXXSEXXLLXLXXXXXXXXSXXXXDXXXRXXXLAYXPXXXXXAXXXL

SEQ ID NO: 7424 - protein, 196 aa, artificial sequence; identical to SEQ ID NO: 1959
  MISC_FEATURE (1)..(196): consensus xaa in all positions is any amino acid
  for the disclosure of the amendment in position 106 see table XVI

SEQ ID NO: 7425 - protein, 59 aa, artificial sequence
  MISC_FEATURE (1)..(59): consensus xaa in position 2 till 11 is any amino acid, xaa in position 11 till 12 is any or no amino acid, Xaa in all other positions is any amino acid,
  for the disclosure of the amendment in position 16 see table XVI
LXXXXXXXXXXXGXXXXXGXCXXXXXXXXXXCXXXXXXXXXXXCXXHXXXXXXXXXXXR

SEQ ID NO: 7426 - protein, 569 aa, artificial sequence; identical to SEQ ID NO: 5817
  MISC_FEATURE (1)..(569): consensus Xaa in all position is any amino acid

SEQ ID NO: 7427 - protein, 11 aa, artificial sequence
  MISC_FEATURE (1)..(11): consensus for the disclosure of xaa see table XV
XXXXXXXXXXX

SEQ ID NO: 7428 - protein, 14 aa, artificial sequence
  MISC_FEATURE (1)..(14): consensus for the disclosure of xaa see table XV
XXPXXXXXXXXXGX

SEQ ID NO: 7429 - protein, 80 aa, artificial sequence
  MISC_FEATURE (1)..(80): consensus Xaa in all positions is any amino acid.
KXXCXXXXXXXXXXXXXXXXXXXXXXXXXXXXXXXXXXXXXXXXXXXXXXXXXTVPXXFXXXXXXGGXXXXXXXXXXGXL

SEQ ID NO: 7430 - protein, 11 aa, artificial sequence
  MISC_FEATURE (1)..(11): consensus for the disclosure of xaa see table XV
XXGXXXXXXXG

SEQ ID NO: 7431 - protein, 7 aa, artificial sequence
  MISC_FEATURE (1)..(7): consensus for the disclosure of xaa see table XV
XXXXAGX

SEQ ID NO: 7432 - protein, 25 aa, artificial sequence
  MISC_FEATURE (1)..(25): consensus for the disclosure of xaa see table XV
GXXXXXXYXXXKXGGXGXXXXXXXE

SEQ ID NO: 7433 - protein, 13 aa, artificial sequence
  MISC_FEATURE (1)..(13): consensus for the disclosure of xaa see table XV
XXXNXXXPGXXXX

SEQ ID NO: 7434 - protein, 266 aa, artificial sequence
  MISC_FEATURE (1)..(266): consensus Xaa in all positions is any amino acid
VTGXXXXXGIGXXXXXXLXXXGXXXXXXXXXXXXXXXXXXXXXXXXXXXXXXXXXXXXXXXXXXXXXXXXXXXXXXXXXXXXXXXXXGXXXXXXLVNNAGITXDXXXXXMXXXXWXXVXXXNLXXXFXXXXXXXXXMXXXXXXXGXIXNXXSXXGXXXXGXXGQXNYXAXKAGXXGXXXXXAXEXXXXXXXXXVNXXXPGXIXTXMXXXXXXXXXXXXXXXXXXXXXXXPXXRXGXXXXXAXXXXXLXXXXXXXYXTGXXXXXXGG

SEQ ID NO: 7435 - DNA, 432 bp, Saccharomyces cerevisiae; identical to SEQ ID NO: 6880
  CDS (1)..(432)

SEQ ID NO: 7436 - protein, 143 aa, Saccharomyces cerevisiae; identical to SEQ ID NO: 6881

SEQ ID NO: 7437 - DNA, 309 bp, Arabidopsis thaliana (mouse-ear cress); identical to SEQ ID NO: 6882
  CDS (1)..(309)

SEQ ID NO: 7438 - protein, 102 aa, Arabidopsis thaliana (mouse-ear cress); identical to SEQ ID NO: 6883

SEQ ID NO: 7439 - DNA, 501 bp, Brucella melitensis; identical to SEQ ID NO: 6884
  CDS (28)..(306)

SEQ ID NO: 7440 - protein, 92 aa, Brucella melitensis; identical to SEQ ID NO: 6885

SEQ ID NO: 7441 - DNA, 324 bp, Nostoc sp. PCC 7120; identical to SEQ ID NO: 6886
  CDS (1)..(324)

SEQ ID NO: 7442 - protein, 107 aa, Nostoc sp. PCC 7120; identical to SEQ ID NO: 6887

SEQ ID NO: 7443 - DNA, 309 bp, Arabidopsis thaliana (mouse-ear cress); identical to SEQ ID NO: 6888
  CDS (1)..(309)

SEQ ID NO: 7444 - protein, 102 aa, Arabidopsis thaliana (mouse-ear cress); identical to SEQ ID NO: 6889

SEQ ID NO: 7445 - DNA, 540 bp, Arabidopsis thaliana (mouse-ear cress); identical to SEQ ID NO: 6890
  CDS (1)..(540)

SEQ ID NO: 7446 - protein, 179 aa, Arabidopsis thaliana (mouse-ear cress); identical to SEQ ID NO: 6891

SEQ ID NO: 7447 - DNA, 327 bp, vaccinia virus; identical to SEQ ID NO: 6892
  CDS (1)..(327)

SEQ ID NO: 7448 - protein, 108 aa, vaccinia virus; identical to SEQ ID NO: 6893

SEQ ID NO: 7449 - DNA, 312 bp, Arabidopsis thaliana (mouse-ear cress); identical to SEQ ID NO: 6894
  CDS (1)..(312)

SEQ ID NO: 7450 - protein, 103 aa, Arabidopsis thaliana (mouse-ear cress); identical to SEQ ID NO: 6895

SEQ ID NO: 7451 - DNA, 309 bp, Arabidopsis thaliana (mouse-ear cress); identical to SEQ ID NO: 6896
  CDS (1)..(309)

SEQ ID NO: 7452 - protein, 102 aa, Arabidopsis thaliana (mouse-ear cress); identical to SEQ ID NO: 6897

SEQ ID NO: 7453 - DNA, 309 bp, Arabidopsis thaliana (mouse-ear cress); identical to SEQ ID NO: 6898
  CDS (1)..(309)

SEQ ID NO: 7454 - protein, 102 aa, Arabidopsis thaliana (mouse-ear cress); identical to SEQ ID NO: 6899

SEQ ID NO: 7455 - DNA, 393 bp, Arabidopsis thaliana (mouse-ear cress); identical to SEQ ID NO: 6900
  CDS (1)..(393)

SEQ ID NO: 7456 - protein, 130 aa, Arabidopsis thaliana (mouse-ear cress); identical to SEQ ID NO: 6901

SEQ ID NO: 7457 - DNA, 589 bp, Bos primigenius taurus (cattle); identical to SEQ ID NO: 6902
  CDS (36)..(356)

SEQ ID NO: 7458 - protein, 106 aa, Bos primigenius taurus (cattle); identical to SEQ ID NO: 6903

SEQ ID NO: 7459 - DNA, 309 bp, Arabidopsis thaliana (mouse-ear cress); identical to SEQ ID NO: 6904
  CDS (1)..(309)

SEQ ID NO: 7460 - protein, 102 aa, Arabidopsis thaliana (mouse-ear cress); identical to SEQ ID NO: 6905

SEQ ID NO: 7461 - DNA, 309 bp, Arabidopsis thaliana (mouse-ear cress); identical to SEQ ID NO: 6906
  CDS (1)..(309)

SEQ ID NO: 7462 - protein, 102 aa, Arabidopsis thaliana (mouse-ear cress); identical to SEQ ID NO: 6907

SEQ ID NO: 7463 - DNA, 575 bp, Oryza sativa (rice); identical to SEQ ID NO: 6908
  CDS (45)..(383)

SEQ ID NO: 7464 - protein, 112 aa, Oryza sativa (rice); identical to SEQ ID NO: 6909

SEQ ID NO: 7465 - DNA, 333 bp, Saccharomyces cerevisiae; identical to SEQ ID NO: 6910
  CDS (1)..(333)

SEQ ID NO: 7466 - protein, 110 aa, Saccharomyces cerevisiae; identical to SEQ ID NO: 6911

SEQ ID NO: 7467 - DNA, 612 bp, Saccharomyces cerevisiae; identical to SEQ ID NO: 6912
  CDS (1)..(612)

SEQ ID NO: 7468 - protein, 203 aa, Saccharomyces cerevisiae; identical to SEQ ID NO: 6913

SEQ ID NO: 7469 - DNA, 321 bp, Homo sapiens (man); identical to SEQ ID NO: 6914
  CDS (1)..(321)

SEQ ID NO: 7470 - protein, 106 aa, Homo sapiens (man); identical to SEQ ID NO: 6915

SEQ ID NO: 7471 - DNA, 583 bp, Ricinus communis (castor bean); identical to SEQ ID NO: 6916
  CDS (44)..(352)

SEQ ID NO: 7472 - protein, 102 aa, Ricinus communis (castor bean); identical to SEQ ID NO: 6917

SEQ ID NO: 7473 - DNA, 531 bp, Arabidopsis thaliana (mouse-ear cress); identical to SEQ ID NO: 6918
  CDS (1)..(531)

SEQ ID NO: 7474 - protein, 176 aa, Arabidopsis thaliana (mouse-ear cress); identical to SEQ ID NO: 6919

SEQ ID NO: 7475 - DNA, 698 bp, Mesembryanthemum crystallinum (common ice plant); identical to SEQ ID NO: 6920
  CDS (60)..(464)

SEQ ID NO: 7476 - protein, 134 aa, Mesembryanthemum crystallinum (common ice plant); identical to SEQ ID NO: 6921

SEQ ID NO: 7477 - DNA, 441 bp, Caenorhabditis elegans; identical to SEQ ID NO: 6922
  CDS (1)..(441)

SEQ ID NO: 7478 - protein, 146 aa, Caenorhabditis elegans; identical to SEQ ID NO: 6923

SEQ ID NO: 7479 - DNA, 361 bp, Schizosaccharomyces pombe; identical to SEQ ID NO: 6924
  CDS (24)..(329)

SEQ ID NO: 7480 - protein, 101 aa, Schizosaccharomyces pombe; identical to SEQ ID NO: 6925

SEQ ID NO: 7481 - DNA, 501 bp, Schizosaccharomyces pombe; identical to SEQ ID NO: 6926
  CDS (1)..(501)

SEQ ID NO: 7482 - protein, 166 aa, Schizosaccharomyces pombe; identical to SEQ ID NO: 6927

SEQ ID NO: 7483 - DNA, 309 bp, Arabidopsis thaliana (mouse-ear cress); identical to SEQ ID NO: 6928
  CDS (1)..(309)

SEQ ID NO: 7484 - protein, 102 aa, Arabidopsis thaliana (mouse-ear cress); identical to SEQ ID NO: 6929

SEQ ID NO: 7485 - DNA, 312 bp, Arabidopsis thaliana (mouse-ear cress); identical to SEQ ID NO: 6930
  CDS (1)..(312)

SEQ ID NO: 7486 - protein, 103 aa, Arabidopsis thaliana (mouse-ear cress); identical to SEQ ID NO: 6931

SEQ ID NO: 7487 - DNA, 391 bp, Arabidopsis thaliana (mouse-ear cress); identical to SEQ ID NO: 6932
  CDS (33)..(341)

SEQ ID NO: 7488 - protein, 102 aa, Arabidopsis thaliana (mouse-ear cress); identical to SEQ ID NO: 6933

SEQ ID NO: 7489 - DNA, 330 bp, Neurospora crassa; identical to SEQ ID NO: 6934
  CDS (1)..(330)

SEQ ID NO: 7490 - protein, 109 aa, Neurospora crassa; identical to SEQ ID NO: 6935

SEQ ID NO: 7491 - DNA, 533 bp, Fritillaria agrestis; identical to SEQ ID NO: 6936
  CDS (39)..(353)

SEQ ID NO: 7492 - protein, 104 aa, Fritillaria agrestis; identical to SEQ ID NO: 6937

SEQ ID NO: 7493 - DNA, 330 bp, Plasmodium yoelii yoelii; identical to SEQ ID NO: 6938
  CDS (1)..(330): m means a or c

SEQ ID NO: 7494 - protein, 109 aa, Plasmodium yoelii yoelii; identical to SEQ ID NO: 6939
  misc_feature (54)..(54): Xaa can be His or Asn

SEQ ID NO: 7495 - DNA, 294 bp, Bordetella bronchiseptica; identical to SEQ ID NO: 6940
  CDS (1)..(294)

SEQ ID NO: 7496 - protein, 97 aa, Bordetella bronchiseptica; identical to SEQ ID NO: 6941

SEQ ID NO: 7497 - DNA, 342 bp, Triticum aestivum; identical to SEQ ID NO: 6942
  CDS (1)..(342)

SEQ ID NO: 7498 - protein, 113 aa, Triticum aestivum; identical to SEQ ID NO: 6943

SEQ ID NO: 7499 - DNA, 324 bp, Aphelenchus avenae; identical to SEQ ID NO: 6944
  CDS (1)..(324)

SEQ ID NO: 7500 - protein, 107 aa, Aphelenchus avenae; identical to SEQ ID NO: 6945

SEQ ID NO: 7501 - DNA, 327 bp, Cowpox virus; identical to SEQ ID NO: 6946
  CDS (1)..(327)

SEQ ID NO: 7502 - protein, 108 aa, Cowpox virus; identical to SEQ ID NO: 6947

SEQ ID NO: 7503 - DNA, 495 bp, Oryza sativa; identical to SEQ ID NO: 6948
  CDS (1)..(495)

SEQ ID NO: 7504 - protein, 164 aa, Oryza sativa; identical to SEQ ID NO: 6949

SEQ ID NO: 7505 - DNA, 270 bp, Vibrio vulnificus; identical to SEQ ID NO: 6950
  CDS (1)..(270)

SEQ ID NO: 7506 - protein, 89 aa, Vibrio vulnificus; identical to SEQ ID NO: 6951

SEQ ID NO: 7507 - DNA, 525 bp, Arabidopsis thaliana; identical to SEQ ID NO: 6952
  CDS (1)..(525)

SEQ ID NO: 7508 - protein, 174 aa, Arabidopsis thaliana; identical to SEQ ID NO: 6953

SEQ ID NO: 7509 - DNA, 608 bp, Arabidopsis thaliana; identical to SEQ ID NO: 6954
  CDS (68)..(445)

SEQ ID NO: 7510 - protein, 125 aa, Arabidopsis thaliana; identical to SEQ ID NO: 6955

SEQ ID NO: 7511 - DNA, 340 bp, Arabidopsis thaliana; identical to SEQ ID NO: 6956
  CDS (1)..(309)

SEQ ID NO: 7512 - protein, 102 aa, Arabidopsis thaliana; identical to SEQ ID NO: 6957

SEQ ID NO: 7513 - DNA, 618 bp, Arabidopsis thaliana; identical to SEQ ID NO: 6958
  CDS (54)..(461)

SEQ ID NO: 7514 - protein, 135 aa, Arabidopsis thaliana; identical to SEQ ID NO: 6959

SEQ ID NO: 7515 - DNA, 420 bp, Populus tremula x Populus tremuloides; identical to SEQ ID NO: 6960
  CDS (1)..(420)

SEQ ID NO: 7516 - protein, 139 aa, Populus tremula x Populus tremuloides; identical to SEQ ID NO: 6961

SEQ ID NO: 7517 - DNA, 664 bp, Mus musculus; identical to SEQ ID NO: 6962
  CDS (37)..(507)

SEQ ID NO: 7518 - protein, 156 aa, Mus musculus; identical to SEQ ID NO: 6963

SEQ ID NO: 7519 - DNA, 508 bp, Tilia platyphyllos; identical to SEQ ID NO: 6964
  CDS (28)..(375)

SEQ ID NO: 7520 - protein, 115 aa, Tilia platyphyllos; identical to SEQ ID NO: 6965

SEQ ID NO: 7521 - DNA, 604 bp, Deschampsia antarctica; identical to SEQ ID NO: 6966
  CDS (85)..(426)

SEQ ID NO: 7522 - protein, 113 aa, Deschampsia antarctica; identical to SEQ ID NO: 6967

SEQ ID NO: 7523 - DNA, 327 bp, Plasmodium berghei; identical to SEQ ID NO: 6968
  CDS (1)..(327)

SEQ ID NO: 7524 - protein, 108 aa, Plasmodium berghei; identical to SEQ ID NO: 6969

SEQ ID NO: 7525 - DNA, 498 bp, Homo sapiens; identical to SEQ ID NO: 6970
  CDS (1)..(498)

SEQ ID NO: 7526 - protein, 165 aa, Homo sapiens; identical to SEQ ID NO: 6971

SEQ ID NO: 7527 - DNA, 456 bp, Theileria parva; identical to SEQ ID NO: 6972
  CDS (1)..(456)

SEQ ID NO: 7528 - protein, 151 aa, Theileria parva; identical to SEQ ID NO: 6973

SEQ ID NO: 7529 - DNA, 336 bp, Arabidopsis thaliana; identical to SEQ ID NO: 6974
  CDS (1)..(336)

SEQ ID NO: 7530 - protein, 111 aa, Arabidopsis thaliana; identical to SEQ ID NO: 6975

SEQ ID NO: 7531 - DNA, 383 bp, Mus musculus; identical to SEQ ID NO: 6976
  CDS (15)..(383)

SEQ ID NO: 7532 - protein, 122 aa, Mus musculus; identical to SEQ ID NO: 6977

SEQ ID NO: 7533 - DNA, 318 bp, Caenorhabditis elegans; identical to SEQ ID NO: 6978
  CDS (1)..(318)

SEQ ID NO: 7534 - protein, 105 aa, Caenorhabditis elegans; identical to SEQ ID NO: 6979

SEQ ID NO: 7535 - DNA, 324 bp, Trypanosoma brucei; identical to SEQ ID NO: 6980
  CDS (1)..(324)

SEQ ID NO: 7536 - protein, 107 aa, Trypanosoma brucei; identical to SEQ ID NO: 6981

SEQ ID NO: 7537 - DNA, 336 bp, Plasmodium falciparum; identical to SEQ ID NO: 6982
  CDS (1)..(336)

SEQ ID NO: 7538 - protein, 111 aa, Plasmodium falciparum; identical to SEQ ID NO: 6983

SEQ ID NO: 7539 - DNA, 654 bp, Homo sapiens; identical to SEQ ID NO: 6984
  CDS (11)..(505)

SEQ ID NO: 7540 - protein, 164 aa, Homo sapiens; identical to SEQ ID NO: 6985

SEQ ID NO: 7541 - DNA, 478 bp, Drosophila melanogaster; identical to SEQ ID NO: 6986
  CDS (48)..(392)

SEQ ID NO: 7542 - protein, 114 aa, Drosophila melanogaster; identical to SEQ ID NO: 6987

SEQ ID NO: 7543 - DNA, 351 bp, Drosophila melanogaster; identical to SEQ ID NO: 6988
  CDS (1)..(351)

SEQ ID NO: 7544 - protein, 116 aa, Drosophila melanogaster; identical to SEQ ID NO: 6989

SEQ ID NO: 7545 - DNA, 644 bp, Homo sapiens; identical to SEQ ID NO: 6990
  CDS (26)..(481)

SEQ ID NO: 7546 - protein, 151 aa, Homo sapiens; identical to SEQ ID NO: 6991

SEQ ID NO: 7547 - DNA, 572 bp, Gallus gallus; identical to SEQ ID NO: 6992
  CDS (47)..(352)

SEQ ID NO: 7548 - protein, 101 aa, Gallus gallus; identical to SEQ ID NO: 6993

SEQ ID NO: 7549 - DNA, 321 bp, Homo sapiens; identical to SEQ ID NO: 6994
  CDS (1)..(321)

SEQ ID NO: 7550 - protein, 106 aa, Homo sapiens; identical to SEQ ID NO: 6915

SEQ ID NO: 7551 - DNA, 531 bp, Lycopersicon esculentum; identical to SEQ ID NO: 6996
  CDS (45)..(371)

SEQ ID NO: 7552 - protein, 108 aa, Lycopersicon esculentum; identical to SEQ ID NO: 6997

SEQ ID NO: 7553 - DNA, 473 bp, Mus musculus; identical to SEQ ID NO: 6998
  CDS (9)..(332)

SEQ ID NO: 7554 - protein, 107 aa, Mus musculus; identical to SEQ ID NO: 6999

SEQ ID NO: 7555 - DNA, 575 bp, Sus scrofa; identical to SEQ ID NO: 7000
  CDS (24)..(344)

SEQ ID NO: 7556 - protein, 106 aa, Sus scrofa; identical to SEQ ID NO: 7001

SEQ ID NO: 7557 - DNA, 432 bp, Saccharomyces cerevisiae; identical to SEQ ID NO: 6880
  CDS (1)..(432)

SEQ ID NO: 7558 - protein, 143 aa, Saccharomyces cerevisiae; identical to SEQ ID NO: 6881

SEQ ID NO: 7559 - DNA, 441 bp, Caenorhabditis elegans; identical to SEQ ID NO: 6922
  CDS (1)..(441)

SEQ ID NO: 7560 - protein, 146 aa, Caenorhabditis elegans; identical to SEQ ID NO: 6923

SEQ ID NO: 7561 - DNA, 324 bp, Rattus norvegicus; identical to SEQ ID NO: 7006
  CDS (1)..(324)

SEQ ID NO: 7562 - protein, 107 aa, Rattus norvegicus; identical to SEQ ID NO: 7007

SEQ ID NO: 7563 - DNA, 378 bp, Arabidopsis thaliana; identical to SEQ ID NO: 7008
  CDS (1)..(378)

SEQ ID NO: 7564 - protein, 125 aa, Arabidopsis thaliana; identical to SEQ ID NO: 7009

SEQ ID NO: 7565 - DNA, 651 bp, Ashbya gossypii; identical to SEQ ID NO: 7010
  CDS (1)..(651)

SEQ ID NO: 7566 - protein, 216 aa, Ashbya gossypii; identical to SEQ ID NO: 7011

SEQ ID NO: 7567 - DNA, 336 bp, Ashbya gossypii; identical to SEQ ID NO: 7012
  CDS (1)..(336)

SEQ ID NO: 7568 - protein, 111 aa, Ashbya gossypii; identical to SEQ ID NO: 7013

SEQ ID NO: 7569 - DNA, 25 bp, artificial sequence
  primer
atggagaccaatttttccttcgact

SEQ ID NO: 7570 - DNA, 26 bp, artificial sequence
  primer
ctattgaaataccggcttcaatattt

SEQ ID NO: 7571 - DNA, 411 bp, Saccharomyces cerevisiae; identical to SEQ ID NO: 5218
  CDS (1)..(411)

SEQ ID NO: 7572 - protein, 136 aa, Saccharomyces cerevisiae; identical to SEQ ID NO: 5219

SEQ ID NO: 7573 - DNA, 420 bp, Aspergillus fumigatus; identical to SEQ ID NO: 5220
  CDS (1)..(420)

SEQ ID NO: 7574 - protein, 139 aa, Aspergillus fumigatus; identical to SEQ ID NO: 5221

SEQ ID NO: 7575 - DNA, 561 bp, Arabidopsis thaliana (mouse-ear cress); identical to SEQ ID NO: 5222
  CDS (10)..(435)

SEQ ID NO: 7576 - protein, 141 aa, Arabidopsis thaliana (mouse-ear cress); identical to SEQ ID NO: 5223

SEQ ID NO: 7577 - DNA, 540 bp, Arabidopsis thaliana (mouse-ear cress); identical to SEQ ID NO: 5224
  CDS (1)..(540)

SEQ ID NO: 7578 - protein, 179 aa, Arabidopsis thaliana (mouse-ear cress); identical to SEQ ID NO: 5225

SEQ ID NO: 7579 - DNA, 357 bp, nucleomorph Guillardia theta; identical to SEQ ID NO: 5226
  CDS (1)..(357)

SEQ ID NO: 7580 - protein, 118 aa, nucleomorph Guillardia theta; identical to SEQ ID NO: 5227

SEQ ID NO: 7581 - DNA, 543 bp, Drosophila melanogaster; identical to SEQ ID NO: 5228
  CDS (54)..(449)

SEQ ID NO: 7582 - protein, 131 aa, Drosophila melanogaster; identical to SEQ ID NO: 5229

SEQ ID NO: 7583 - DNA, 414 bp, Homo sapiens (man); identical to SEQ ID NO: 5230
  CDS (7)..(414)

SEQ ID NO: 7584 - protein, 135 aa, Homo sapiens (man) [sequence omitted]

SEQ ID NO: 7585 - DNA, 441 bp, Neurospora crassa; identical to SEQ ID NO: 5232
  CDS (1)..(441)

SEQ ID NO: 7586 - protein, 146 aa, Neurospora crassa; identical to SEQ ID NO: 5233

SEQ ID NO: 7587 - DNA, 411 bp, Dictyostelium discoideum; identical to SEQ ID NO: 5234
  CDS (4)..(411)

SEQ ID NO: 7588 - protein, 135 aa, Dictyostelium discoideum; identical to SEQ ID NO: 5235

SEQ ID NO: 7589 - DNA, 600 bp, Caenorhabditis elegans; identical to SEQ ID NO: 5236
  CDS (37)..(414)

SEQ ID NO: 7590 - protein, 125 aa, Caenorhabditis elegans; identical to SEQ ID NO: 5237

SEQ ID NO: 7591 - DNA, 396 bp, Schizosaccharomyces pombe; identical to SEQ ID NO: 5238
  CDS (1)..(396)

SEQ ID NO: 7592 - protein, 131 aa, Schizosaccharomyces pombe; identical to SEQ ID NO: 5239

SEQ ID NO: 7593 - DNA, 426 bp, Arabidopsis thaliana (mouse-ear cress); identical to SEQ ID NO: 5240
  CDS (1)..(426)

SEQ ID NO: 7594 - protein, 141 aa, Arabidopsis thaliana (mouse-ear cress) [sequence omitted]

SEQ ID NO: 7595 - DNA, 399 bp, Schizosaccharomyces pombe; identical to SEQ ID NO: 5242
  CDS (1)..(399)

SEQ ID NO: 7596 - protein, 132 aa, Schizosaccharomyces pombe; identical to SEQ ID NO: 5243

SEQ ID NO: 7597 - DNA, 570 bp, Phaffia rhodozyma; identical to SEQ ID NO: 5244
  CDS (49)..(501): n means a or g or c or t/u

SEQ ID NO: 7598 - protein, 150 aa, Phaffia rhodozyma; identical to SEQ ID NO: 5245
  misc_feature (140)..(140): Xaa can be Ser or Gly or Arg or Cys

SEQ ID NO: 7599 - DNA, 564 bp, Homo sapiens; identical to SEQ ID NO: 5246
  CDS (25)..(318)

SEQ ID NO: 7600 - protein, 97 aa, Homo sapiens; identical to SEQ ID NO: 5247

SEQ ID NO: 7601 - DNA, 414 bp, Giardia lamblia ATCC 50803; identical to SEQ ID NO: 5248
  CDS (1)..(414)

SEQ ID NO: 7602 - protein, 137 aa, Giardia lamblia ATCC 50803; identical to SEQ ID NO: 5249

SEQ ID NO: 7603 - DNA, 1890 bp, Plasmodium yoelii yoelii; identical to SEQ ID NO: 5250
  CDS (1)..(1890)

SEQ ID NO: 7604 - protein, 629 aa, Plasmodium yoelii yoelii; identical to SEQ ID NO: 5251

SEQ ID NO: 7605 - DNA, 426 bp, Oryza sativa; identical to SEQ ID NO: 5252
  CDS (1)..(426)

SEQ ID NO: 7606 - protein, 141 aa, Oryza sativa; identical to SEQ ID NO: 5253

SEQ ID NO: 7607 - DNA, 435 bp, Oryza sativa; identical to SEQ ID NO: 5254
  CDS (1)..(435)

SEQ ID NO: 7608 - protein, 144 aa, Oryza sativa; identical to SEQ ID NO: 5255

SEQ ID NO: 7609 - DNA, 414 bp, Plasmodium falciparum; identical to SEQ ID NO: 5256
  CDS (1)..(414)

SEQ ID NO: 7610 - protein, 137 aa, Plasmodium falciparum; identical to SEQ ID NO: 5257

SEQ ID NO: 7611 - DNA, 614 bp, Branchiostoma belcheri; identical to SEQ ID NO: 5258
  CDS (9)..(413)

SEQ ID NO: 7612 - protein, 134 aa, Branchiostoma belcheri; identical to SEQ ID NO: 5259

SEQ ID NO: 7613 - DNA, 477 bp, Aequipecten irradians; identical to SEQ ID NO: 5260
  CDS (5)..(427)

SEQ ID NO: 7614 - protein, 140 aa, Aequipecten irradians; identical to SEQ ID NO: 5261

SEQ ID NO: 7615 - DNA, 363 bp, Encephalitozoon cuniculi; identical to SEQ ID NO: 5262
  CDS (1)..(363)

SEQ ID NO: 7616 - protein, 120 aa, Encephalitozoon cuniculi; identical to SEQ ID NO: 5263

SEQ ID NO: 7617 - DNA, 408 bp, Homo sapiens; identical to SEQ ID NO: 5264
  CDS (1)..(408)

SEQ ID NO: 7618 - protein, 135 aa, Homo sapiens; identical to SEQ ID NO: 5265

SEQ ID NO: 7619 - DNA, 577 bp, Anopheles gambiae; identical to SEQ ID NO: 5266
  CDS (31)..(426)

SEQ ID NO: 7620 - protein, 131 aa, Anopheles gambiae; identical to SEQ ID NO: 5267

SEQ ID NO: 7621 - DNA, 393 bp, Caenorhabditis elegans; identical to SEQ ID NO: 5268
  CDS (1)..(393)

SEQ ID NO: 7622 - protein, 130 aa, Caenorhabditis elegans; identical to SEQ ID NO: 5269

SEQ ID NO: 7623 - DNA, 641 bp, Lycopersicon esculentum; identical to SEQ ID NO: 5270
  CDS (48)..(482)

SEQ ID NO: 7624 - protein, 144 aa, Lycopersicon esculentum; identical to SEQ ID NO: 5271

SEQ ID NO: 7625 - DNA, 453 bp, Mus musculus; identical to SEQ ID NO: 5272
  CDS (12)..(419)

SEQ ID NO: 7626 - protein, 135 aa, Mus musculus; identical to SEQ ID NO: 5273

SEQ ID NO: 7627 - DNA, 466 bp, Rattus norvegicus; identical to SEQ ID NO: 5274
  CDS (25)..(432)

SEQ ID NO: 7628 - protein, 135 aa, Rattus norvegicus; identical to SEQ ID NO: 5275

SEQ ID NO: 7629 - DNA, 456 bp, Spodoptera frugiperda; identical to SEQ ID NO: 5276
  CDS (25)..(426)

SEQ ID NO: 7630 - protein, 133 aa, Spodoptera frugiperda; identical to SEQ ID NO: 5277

SEQ ID NO: 7631 - DNA, 611 bp, Theileria annulata; identical to SEQ ID NO: 5278
  CDS (175)..(570)

SEQ ID NO: 7632 - protein, 131 aa, Theileria annulata; identical to SEQ ID NO: 5279

SEQ ID NO: 7633 - DNA, 454 bp, Arabidopsis thaliana; identical to SEQ ID NO: 5280
  CDS (1)..(423)

SEQ ID NO: 7634 - protein, 140 aa, Arabidopsis thaliana; identical to SEQ ID NO: 5281

SEQ ID NO: 7635 - DNA, 411 bp, Ashbya gossypii; identical to SEQ ID NO: 5282
  CDS (1)..(411)

SEQ ID NO: 7636 - protein, 136 aa, Ashbya gossypii; identical to SEQ ID NO: 5283

SEQ ID NO: 7637 - DNA, 25 bp, artificial sequence
  primer
ttagtttctctttctgtaacgtctg

SEQ ID NO: 7638 - DNA, 24 bp, artificial sequence
  primer
atggtacgtaccacgagatgttga

SEQ ID NO: 7639 - DNA, 300 bp, Saccharomyces cerevisiae; identical to SEQ ID NO: 5168
  CDS (1)..(300)

SEQ ID NO: 7640 - protein, 99 aa, Saccharomyces cerevisiae; identical to SEQ ID NO: 5169

SEQ ID NO: 7641 - DNA, 282 bp, Saccharomyces cerevisiae; identical to SEQ ID NO: 5170
  CDS (1)..(282)

SEQ ID NO: 7642 - protein, 93 aa, Saccharomyces cerevisiae; identical to SEQ ID NO: 5171

SEQ ID NO: 7643 - DNA, 995 bp, Gallus gallus (chicken); identical to SEQ ID NO: 5172
  CDS (100)..(723)

SEQ ID NO: 7644 - protein, 207 aa, Gallus gallus (chicken); identical to SEQ ID NO: 5173

SEQ ID NO: 7645 - DNA, 603 bp, Strongylocentrotus purpuratus (purple urchin); identical to SEQ ID NO: 5174
  CDS (1)..(603)

SEQ ID NO: 7646 - protein, 200 aa, Strongylocentrotus purpuratus (purple urchin); identical to SEQ ID NO: 5175

SEQ ID NO: 7647 - DNA, 401 bp, Babesia bovis; identical to SEQ ID NO: 5176
  CDS (69)..(362)

SEQ ID NO: 7648 - protein, 97 aa, Babesia bovis; identical to SEQ ID NO: 5177

SEQ ID NO: 7649 - DNA, 327 bp, Schizosaccharomyces pombe; identical to SEQ ID NO: 5178
  CDS (1)..(327)

SEQ ID NO: 7650 - protein, 108 aa, Schizosaccharomyces pombe; identical to SEQ ID NO: 5179

SEQ ID NO: 7651 - DNA, 1381 bp, Caenorhabditis elegans; identical to SEQ ID NO: 5180
  CDS (176)..(883)

SEQ ID NO: 7652 - protein, 235 aa, Caenorhabditis elegans; identical to SEQ ID NO: 5181

SEQ ID NO: 7653 - DNA, 1194 bp, Homo sapiens; identical to SEQ ID NO: 5182
  CDS (77)..(724)

SEQ ID NO: 7654 - protein, 215 aa, Homo sapiens [sequence omitted]

SEQ ID NO: 7655 - DNA, 392 bp, Plasmodium falciparum; identical to SEQ ID NO: 5184
  CDS (79)..(372)

SEQ ID NO: 7656 - protein, 97 aa, Plasmodium falciparum; identical to SEQ ID NO: 5185

SEQ ID NO: 7657 - DNA, 543 bp, Plasmodium yoelii yoelii; identical to SEQ ID NO: 5186
  CDS (72)..(389): n means a or g or c or t/u

SEQ ID NO: 7658 - protein, 105 aa, Plasmodium yoelii yoelii; identical to SEQ ID NO: 5187

SEQ ID NO: 7659 - DNA, 312 bp, Neurospora crassa; identical to SEQ ID NO: 5188
  CDS (1)..(312)

SEQ ID NO: 7660 - protein, 103 aa, Neurospora crassa; identical to SEQ ID NO: 5189

SEQ ID NO: 7661 - DNA, 618 bp, Brachydanio rerio; identical to SEQ ID NO: 5190
  CDS (1)..(618)

SEQ ID NO: 7662 - protein, 205 aa, Brachydanio rerio; identical to SEQ ID NO: 5191

SEQ ID NO: 7663 - DNA, 627 bp, Dermacentor variabilis; identical to SEQ ID NO: 5192
  CDS (1)..(627)

SEQ ID NO: 7664 - protein, 208 aa, Dermacentor variabilis; identical to SEQ ID NO: 5193

SEQ ID NO: 7665 - DNA, 648 bp, Mus musculus; identical to SEQ ID NO: 5194
  CDS (1)..(648)

SEQ ID NO: 7666 - protein, 215 aa, Mus musculus; identical to SEQ ID NO: 5195

SEQ ID NO: 7667 - DNA, 300 bp, Plasmodium falciparum; identical to SEQ ID NO: 5196
  CDS (1)..(300)

SEQ ID NO: 7668 - protein, 99 aa, Plasmodium falciparum; identical to SEQ ID NO: 5197

SEQ ID NO: 7669 - DNA, 699 bp, Homo sapiens; identical to SEQ ID NO: 5198
  CDS (83)..(667)

SEQ ID NO: 7670 - protein, 195 aa, Homo sapiens; identical to SEQ ID NO: 5199

SEQ ID NO: 7671 - DNA, 915 bp, Gallus gallus; identical to SEQ ID NO: 5200
  CDS (183)..(830)

SEQ ID NO: 7672 - protein, 215 aa, Gallus gallus; identical to SEQ ID NO: 5201

SEQ ID NO: 7673 - DNA, 294 bp, Plasmodium falciparum; identical to SEQ ID NO: 5202
  CDS (1)..(294)

SEQ ID NO: 7674 - protein, 97 aa, Plasmodium falciparum; identical to SEQ ID NO: 5203

SEQ ID NO: 7675 - DNA, 279 bp, Candida albicans; identical to SEQ ID NO: 5204
  CDS (1)..(279)

SEQ ID NO: 7676 - protein, 92 aa, Candida albicans; identical to SEQ ID NO: 5205

SEQ ID NO: 7677 - DNA, 1266 bp, Mus musculus; identical to SEQ ID NO: 5206
  CDS (90)..(737)

SEQ ID NO: 7678 - protein, 215 aa, Mus musculus; identical to SEQ ID NO: 5195

SEQ ID NO: 7679 - DNA, 782 bp, Mus musculus; identical to SEQ ID NO: 5208
  CDS (60)..(692)

SEQ ID NO: 7680 - protein, 210 aa, Mus musculus; identical to SEQ ID NO: 5209

SEQ ID NO: 7681 - DNA, 1153 bp, Sus scrofa; identical to SEQ ID NO: 5210
  CDS (144)..(776)

SEQ ID NO: 7682 - protein, 210 aa, Sus scrofa; identical to SEQ ID NO: 5211

SEQ ID NO: 7683 - DNA, 285 bp, Ashbya gossypii; identical to SEQ ID NO: 5212
  CDS (1)..(285)

SEQ ID NO: 7684 - protein, 94 aa, Ashbya gossypii; identical to SEQ ID NO: 5213

SEQ ID NO: 7685 - DNA, 833 bp, Branchiostoma belcheri tsingtaunese; identical to SEQ ID NO: 5214
  CDS (61)..(729)

SEQ ID NO: 7686 - protein, 222 aa, Branchiostoma belcheri tsingtaunese; identical to SEQ ID NO: 5215

SEQ ID NO: 7687 - DNA, 24 bp, artificial sequence
  primer
atggccgcaactaaagaagcaaag

SEQ ID NO: 7688 - DNA, 25 bp, artificial sequence
  primer
tcaagcacgtgtagcattgtacaat

SEQ ID NO: 7689 - DNA, 1350 bp, Escherichia coli K12; identical to SEQ ID NO: 4558
  CDS (1)..(1350)

SEQ ID NO: 7690 - protein, 449 aa, Escherichia coli K12; identical to SEQ ID NO: 4559

SEQ ID NO: 7691 - DNA, 7367 bp, Gallus gallus (chicken); identical to SEQ ID NO: 4560
  CDS (154)..(7128)

SEQ ID NO: 7692 - protein, 2324 aa, Gallus gallus (chicken); identical to SEQ ID NO: 4561

SEQ ID NO: 7693 - DNA, 7038 bp, Rattus norvegicus (Norway rat); identical to SEQ ID NO: 4562
  CDS (1)..(7038)

SEQ ID NO: 7694 - protein, 2345 aa, Rattus norvegicus (Norway rat); identical to SEQ ID NO: 4563

SEQ ID NO: 7695 - DNA, 6270 bp, Cyclotella cryptica; identical to SEQ ID NO: 4564
  CDS (1)..(6270)

SEQ ID NO: 7696 - protein, 2089 aa, Cyclotella cryptica; identical to SEQ ID NO: 4565

SEQ ID NO: 7697 - DNA, 7360 bp, Triticum aestivum (common wheat); identical to SEQ ID NO: 4566
  CDS (159)..(6932)

SEQ ID NO: 7698 - protein, 2257 aa, Triticum aestivum (common wheat); identical to SEQ ID NO: 4567

SEQ ID NO: 7699 - DNA, 1476 bp, Methanobacterium thermoautotrophicum; identical to SEQ ID NO: 4568
  CDS (1)..(1476)

SEQ ID NO: 7700 - protein, 491 aa, Methanobacterium thermoautotrophicum; identical to SEQ ID NO: 4569

SEQ ID NO: 7701 - DNA, 1353 bp, Bacillus subtilis; identical to SEQ ID NO: 4570
  CDS (1)..(1353)

SEQ ID NO: 7702 - protein, 450 aa, Bacillus subtilis; identical to SEQ ID NO: 4571

SEQ ID NO: 7703 - DNA, 1419 bp, Aquifex aeolicus; identical to SEQ ID NO: 4572
  CDS (1)..(1419)

SEQ ID NO: 7704 - protein, 472 aa, Aquifex aeolicus; identical to SEQ ID NO: 4573

SEQ ID NO: 7705 - DNA, 1377 bp, Pseudomonas aeruginosa; identical to SEQ ID NO: 4574
  CDS (1)..(1377)

SEQ ID NO: 7706 - protein, 458 aa, Pseudomonas aeruginosa; identical to SEQ ID NO: 4575

SEQ ID NO: 7707 - DNA, 3453 bp, Bacillus halodurans; identical to SEQ ID NO: 4576
  CDS (1)..(3453)

SEQ ID NO: 7708 - protein, 1150 aa, Bacillus halodurans; identical to SEQ ID NO: 4577

SEQ ID NO: 7709 - DNA, 1347 bp, Agrobacterium tumefaciens; identical to SEQ ID NO: 4578
  CDS (1)..(1347)

SEQ ID NO: 7710 - protein, 448 aa, Agrobacterium tumefaciens; identical to SEQ ID NO: 4579

SEQ ID NO: 7711 - DNA, 1731 bp, Agrobacterium tumefaciens; identical to SEQ ID NO: 4580
  CDS (1)..(1731)

SEQ ID NO: 7712 - protein, 576 aa, Agrobacterium tumefaciens; identical to SEQ ID NO: 4581

SEQ ID NO: 7713 - DNA, 1350 bp, Yersinia pestis; identical to SEQ ID NO: 4582
  CDS (1)..(1350)

SEQ ID NO: 7714 - protein, 449 aa, Yersinia pestis; identical to SEQ ID NO: 4583

SEQ ID NO: 7715 - DNA, 1365 bp, Listeria monocytogenes; identical to SEQ ID NO: 4584
  CDS (1)..(1365)

SEQ ID NO: 7716 - protein, 454 aa, Listeria monocytogenes; identical to SEQ ID NO: 4585

SEQ ID NO: 7717 - DNA, 3525 bp, Agrobacterium tumefaciens; identical to SEQ ID NO: 4586
  CDS (1)..(3525)

SEQ ID NO: 7718 - protein, 1174 aa, Agrobacterium tumefaciens; identical to SEQ ID NO: 4587

SEQ ID NO: 7719 - DNA, 1992 bp, Agrobacterium tumefaciens; identical to SEQ ID NO: 4588
  CDS (1)..(1992)

SEQ ID NO: 7720 - protein, 663 aa, Agrobacterium tumefaciens; identical to SEQ ID NO: 4589

SEQ ID NO: 7721 - DNA, 2037 bp, Brucella melitensis; identical to SEQ ID NO: 4590
  CDS (1)..(2037)

SEQ ID NO: 7722 - protein, 678 aa, Brucella melitensis; identical to SEQ ID NO: 4591

SEQ ID NO: 7723 - DNA, 1344 bp, Nostoc sp. PCC 7120; identical to SEQ ID NO: 4592
  CDS (1)..(1344)

SEQ ID NO: 7724 - protein, 447 aa, Nostoc sp. PCC 7120; identical to SEQ ID NO: 4593

SEQ ID NO: 7725 - DNA, 1350 bp, Salmonella enterica subsp. enterica serovar Typhi; identical to SEQ ID NO: 4594
  CDS (1)..(1350)

SEQ ID NO: 7726 - protein, 449 aa, Salmonella enterica subsp. enterica serovar Typhi; identical to SEQ ID NO: 4595

SEQ ID NO: 7727 - DNA, 1350 bp, Pseudomonas aeruginosa; identical to SEQ ID NO: 4596
  CDS (1)..(1350)

SEQ ID NO: 7728 - protein, 449 aa, Pseudomonas aeruginosa; identical to SEQ ID NO: 4597

SEQ ID NO: 7729 - DNA, 1965 bp, Mycobacterium tuberculosis; identical to SEQ ID NO: 4598
  CDS (1)..(1965)

SEQ ID NO: 7730 - protein, 654 aa, Mycobacterium tuberculosis; identical to SEQ ID NO: 4599

SEQ ID NO: 7731 - DNA, 1338 bp, Deinococcus radiodurans; identical to SEQ ID NO: 4600
  CDS (1)..(1338)

SEQ ID NO: 7732 - protein, 445 aa, Deinococcus radiodurans; identical to SEQ ID NO: 4601

SEQ ID NO: 7733 - DNA, 1446 bp, Campylobacter jejuni; identical to SEQ ID NO: 4602
  CDS (1)..(1446)

SEQ ID NO: 7734 - protein, 481 aa, Campylobacter jejuni; identical to SEQ ID NO: 4603

SEQ ID NO: 7735 - DNA, 3288 bp, Pseudomonas aeruginosa; identical to SEQ ID NO: 4604
  CDS (1)..(3288)

SEQ ID NO: 7736 - protein, 1095 aa, Pseudomonas aeruginosa; identical to SEQ ID NO: 4605

SEQ ID NO: 7737 - DNA, 1368 bp, Lactococcus lactis subsp. lactis; identical to SEQ ID NO: 4606
  CDS (1)..(1368)

SEQ ID NO: 7738 - protein, 455 aa, Lactococcus lactis subsp. lactis; identical to SEQ ID NO: 4607

SEQ ID NO: 7739 - DNA, 2010 bp, Caulobacter crescentus; identical to SEQ ID NO: 4608
  CDS (1)..(2010)

SEQ ID NO: 7740 - protein, 669 aa, Caulobacter crescentus; identical to SEQ ID NO: 4609

SEQ ID NO: 7741 - DNA, 1344 bp, Clostridium acetobutylicum; identical to SEQ ID NO: 4610
  CDS (1)..(1344)

SEQ ID NO: 7742 - protein, 447 aa, Clostridium acetobutylicum; identical to SEQ ID NO: 4611

SEQ ID NO: 7743 - DNA, 1335 bp, Aquifex aeolicus; identical to SEQ ID NO: 4612
  CDS (1)..(1335)

SEQ ID NO: 7744 - protein, 444 aa, Aquifex aeolicus; identical to SEQ ID NO: 4613

SEQ ID NO: 7745 - DNA, 2004 bp, Mycobacterium tuberculosis; identical to SEQ ID NO: 4614
  CDS (1)..(2004)

SEQ ID NO: 7746 - protein, 667 aa, Mycobacterium tuberculosis; identical to SEQ ID NO: 4615

SEQ ID NO: 7747 - DNA, 1998 bp, Rickettsia prowazekii; identical to SEQ ID NO: 4616
  CDS (1)..(1998)

SEQ ID NO: 7748 - protein, 665 aa, Rickettsia prowazekii; identical to SEQ ID NO: 4617

SEQ ID NO: 7749 - DNA, 3276 bp, Deinococcus radiodurans; identical to SEQ ID NO: 4618
  CDS (1)..(3276)

SEQ ID NO: 7750 - protein, 1091 aa, Deinococcus radiodurans; identical to SEQ ID NO: 4619

SEQ ID NO: 7751 - DNA, 1368 bp, Streptococcus pneumoniae; identical to SEQ ID NO: 4620
  CDS (1)..(1368)

SEQ ID NO: 7752 - protein, 455 aa, Streptococcus pneumoniae; identical to SEQ ID NO: 4621

SEQ ID NO: 7753 - DNA, 1506 bp, Methanococcus jannaschii; identical to SEQ ID NO: 4622
  CDS (1)..(1506)

SEQ ID NO: 7754 - protein, 501 aa, Methanococcus jannaschii; identical to SEQ ID NO: 4623

SEQ ID NO: 7755 - DNA, 1521 bp, Archaeoglobus fulgidus; identical to SEQ ID NO: 4624
  CDS (1)..(1521)

SEQ ID NO: 7756 - protein, 506 aa, Archaeoglobus fulgidus; identical to SEQ ID NO: 4625

SEQ ID NO: 7757 - DNA, 3384 bp, Mycobacterium tuberculosis; identical to SEQ ID NO: 4626
  CDS (1)..(3384)

SEQ ID NO: 7758 - protein, 1127 aa, Mycobacterium tuberculosis; identical to SEQ ID NO: 4627

SEQ ID NO: 7759 - DNA, 1374 bp, Chlamydia muridarum, Chlamydia trachomatis MoPn; identical to SEQ ID NO: 4628
  CDS (1)..(1374)

SEQ ID NO: 7760 - protein, 457 aa, Chlamydia muridarum, Chlamydia trachomatis MoPn; identical to SEQ ID NO: 4629

SEQ ID NO: 7761 - DNA, 1359 bp, Bacillus halodurans; identical to SEQ ID NO: 4630
  CDS (1)..(1359)

SEQ ID NO: 7762 - protein, 452 aa, Bacillus halodurans; identical to SEQ ID NO: 4631

SEQ ID NO: 7763 - DNA, 6774 bp, Arabidopsis thaliana (mouse-ear cress); identical to SEQ ID NO: 4632
  CDS (1)..(6774)

SEQ ID NO: 7764 - protein, 2257 aa, Arabidopsis thaliana (mouse-ear cress); identical to SEQ ID NO: 4633

SEQ ID NO: 7765 - DNA, 3237 bp, Caulobacter crescentus; identical to SEQ ID NO: 4634
  CDS (1)..(3237)

SEQ ID NO: 7766 - protein, 1078 aa, Caulobacter crescentus; identical to SEQ ID NO: 4635

SEQ ID NO: 7767 - DNA, 3435 bp, Clostridium acetobutylicum; identical to SEQ ID NO: 4636
  CDS (1)..(3435)

SEQ ID NO: 7768 - protein, 1144 aa, Clostridium acetobutylicum; identical to SEQ ID NO: 4637

SEQ ID NO: 7769 - DNA, 1335 bp, Bacillus subtilis; identical to SEQ ID NO: 4638
  CDS (1)..(1335)

SEQ ID NO: 7770 - protein, 444 aa, Bacillus subtilis; identical to SEQ ID NO: 4639

SEQ ID NO: 7771 - DNA, 1365 bp, Chlamydophila pneumoniae, Chlamydia pneumoniae; identical to SEQ ID NO: 4640
  CDS (1)..(1365)

SEQ ID NO: 7772 - protein, 454 aa, Chlamydophila pneumoniae, Chlamydia pneumoniae; identical to SEQ ID NO: 4641

SEQ ID NO: 7773 - DNA, 1410 bp, Xylella fastidiosa; identical to SEQ ID NO: 4642
  CDS (1)..(1410)

SEQ ID NO: 7774 - protein, 469 aa, Xylella fastidiosa; identical to SEQ ID NO: 4643

SEQ ID NO: 7775 - DNA, 7080 bp, Arabidopsis thaliana (mouse-ear cress); identical to SEQ ID NO: 4644
  CDS (1)..(7080)

SEQ ID NO: 7776 - protein, 2359 aa, Arabidopsis thaliana (mouse-ear cress); identical to SEQ ID NO: 4645

SEQ ID NO: 7777 - DNA, 3414 bp, Lactococcus lactis subsp. lactis; identical to SEQ ID NO: 4646
  CDS (1)..(3414)

SEQ ID NO: 7778 - protein, 1137 aa, Lactococcus lactis subsp. lactis; identical to SEQ ID NO: 4647

SEQ ID NO: 7779 - DNA, 1533 bp, Sulfolobus solfataricus; identical to SEQ ID NO: 4648
  CDS (1)..(1533)

SEQ ID NO: 7780 - protein, 510 aa, Sulfolobus solfataricus; identical to SEQ ID NO: 4649

SEQ ID NO: 7781 - DNA, 1347 bp, Haemophilus influenzae; identical to SEQ ID NO: 4650
  CDS (1)..(1347)

SEQ ID NO: 7782 - protein, 448 aa, Haemophilus influenzae; identical to SEQ ID NO: 4651

SEQ ID NO: 7783 - DNA, 3462 bp, Bacillus subtilis; identical to SEQ ID NO: 4652
  CDS (16)..(3462)

SEQ ID NO: 7784 - protein, 1148 aa, Bacillus subtilis; identical to SEQ ID NO: 4653

SEQ ID NO: 7785 - DNA, 1803 bp, Mycobacterium tuberculosis; identical to SEQ ID NO: 4654
  CDS (1)..(1803)

SEQ ID NO: 7786 - protein, 600 aa, Mycobacterium tuberculosis; identical to SEQ ID NO: 4655

SEQ ID NO: 7787 - DNA, 1344 bp, Vibrio cholerae; identical to SEQ ID NO: 4656
  CDS (1)..(1344)

SEQ ID NO: 7788 - protein, 447 aa, Vibrio cholerae; identical to SEQ ID NO: 4657

SEQ ID NO: 7789 - DNA, 1356 bp, Staphylococcus aureus; identical to SEQ ID NO: 4658
  CDS (1)..(1356)

SEQ ID NO: 7790 - protein, 451 aa, Staphylococcus aureus; identical to SEQ ID NO: 4659

SEQ ID NO: 7791 - DNA, 2004 bp, Agrobacterium tumefaciens; identical to SEQ ID NO: 4660
  CDS (1)..(2004)

SEQ ID NO: 7792 - protein, 667 aa, Agrobacterium tumefaciens; identical to SEQ ID NO: 4661

SEQ ID NO: 7793 - DNA, 1434 bp, Aquifex aeolicus; identical to SEQ ID NO: 4662
  CDS (1)..(1434)

SEQ ID NO: 7794 - protein, 477 aa, Aquifex aeolicus; identical to SEQ ID NO: 4663

SEQ ID NO: 7795 - DNA, 1368 bp, Helicobacter pylori; identical to SEQ ID NO: 4664
  CDS (1)..(1368)

SEQ ID NO: 7796 - protein, 455 aa, Helicobacter pylori; identical to SEQ ID NO: 4665

SEQ ID NO: 7797 - DNA, 1332 bp, Campylobacter jejuni; identical to SEQ ID NO: 4666
  CDS (1)..(1332)

SEQ ID NO: 7798 - protein, 443 aa, Campylobacter jejuni; identical to SEQ ID NO: 4667

SEQ ID NO: 7799 - DNA, 1833 bp, Halobacterium sp. NRC-1; identical to SEQ ID NO: 4668
  CDS (1)..(1833)

SEQ ID NO: 7800 - protein, 610 aa, Halobacterium sp. NRC-1; identical to SEQ ID NO: 4669

SEQ ID NO: 7801 - DNA, 1797 bp, Mycobacterium leprae; identical to SEQ ID NO: 4670
  CDS (1)..(1797)

SEQ ID NO: 7802 - protein, 598 aa, Mycobacterium leprae; identical to SEQ ID NO: 4671

SEQ ID NO: 7803 - DNA, 1347 bp, Caulobacter crescentus; identical to SEQ ID NO: 4672
  CDS (1)..(1347)

SEQ ID NO: 7804 - protein, 448 aa, Caulobacter crescentus; identical to SEQ ID NO: 4673

SEQ ID NO: 7805 - DNA, 1965 bp, Caulobacter crescentus; identical to SEQ ID NO: 4674
  CDS (1)..(1965)

SEQ ID NO: 7806 - protein, 654 aa, Caulobacter crescentus; identical to SEQ ID NO: 4675

SEQ ID NO: 7807 - DNA, 1989 bp, Sinorhizobium meliloti; identical to SEQ ID NO: 4676
  CDS (1)..(1989)

SEQ ID NO: 7808 - protein, 662 aa, Sinorhizobium meliloti; identical to SEQ ID NO: 4677

SEQ ID NO: 7809 - DNA, 1374 bp, Chlamydia trachomatis; identical to SEQ ID NO: 4678
  CDS (1)..(1374)

SEQ ID NO: 7810 - protein, 457 aa, Chlamydia trachomatis; identical to SEQ ID NO: 4679

SEQ ID NO: 7811 - DNA, 1362 bp, Neisseria meningitidis; identical to SEQ ID NO: 4680
  CDS (1)..(1362)

SEQ ID NO: 7812 - protein, 453 aa, Neisseria meningitidis; identical to SEQ ID NO: 4681

SEQ ID NO: 7813 - DNA, 3624 bp, Caulobacter crescentus; identical to SEQ ID NO: 4682
  CDS (1)..(3624)

SEQ ID NO: 7814 - protein, 1207 aa, Caulobacter crescentus; identical to SEQ ID NO: 4683

SEQ ID NO: 7815 - DNA, 2013 bp, Sinorhizobium meliloti; identical to SEQ ID NO: 4684
  CDS (1)..(2013)

SEQ ID NO: 7816 - protein, 670 aa, Sinorhizobium meliloti; identical to SEQ ID NO: 4685

SEQ ID NO: 7817 - DNA, 7041 bp, Homo sapiens (man); identical to SEQ ID NO: 4686
  CDS (1)..(7041)

SEQ ID NO: 7818 - protein, 2346 aa, Homo sapiens (man); identical to SEQ ID NO: 4687

SEQ ID NO: 7819 - DNA, 4201 bp, Saccharomyces cerevisiae; identical to SEQ ID NO: 4688
  CDS (430)..(3966)

SEQ ID NO: 7820 - protein, 1178 aa, Saccharomyces cerevisiae; identical to SEQ ID NO: 4689

SEQ ID NO: 7821 - DNA, 7020 bp, Homo sapiens (man); identical to SEQ ID NO: 4690
  CDS (1)..(7020)

SEQ ID NO: 7822 - protein, 2339 aa, Homo sapiens (man) [sequence omitted]

SEQ ID NO: 7823 - DNA, 6042 bp, Saccharomyces cerevisiae; identical to SEQ ID NO: 4692
  CDS (373)..(5880)

SEQ ID NO: 7824 - protein, 1835 aa, Saccharomyces cerevisiae; identical to SEQ ID NO: 4693

SEQ ID NO: 7825 - DNA, 4315 bp, Saccharomyces cerevisiae; identical to SEQ ID NO: 4694
  CDS (676)..(4218)

SEQ ID NO: 7826 - protein, 1180 aa, Saccharomyces cerevisiae; identical to SEQ ID NO: 4695

SEQ ID NO: 7827 - DNA, 6558 bp, Ustilago maydis (corn smut); identical to SEQ ID NO: 4696
  CDS (1)..(6558)

SEQ ID NO: 7828 - protein, 2185 aa, Ustilago maydis (corn smut); identical to SEQ ID NO: 4697

SEQ ID NO: 7829 - DNA, 8521 bp, Saccharomyces cerevisiae; identical to SEQ ID NO: 4698
  CDS (1539)..(8240)

SEQ ID NO: 7830 - protein, 2233 aa, Saccharomyces cerevisiae; identical to SEQ ID NO: 4699

SEQ ID NO: 7831 - DNA, 1794 bp, Saccharopolyspora erythraea; identical to SEQ ID NO: 4700
  CDS (1)..(1794)

SEQ ID NO: 7832 - protein, 597 aa, Saccharopolyspora erythraea; identical to SEQ ID NO: 4701

SEQ ID NO: 7833 - DNA, 1347 bp, Synechocystis sp; identical to SEQ ID NO: 4702
  CDS (1)..(1347)

SEQ ID NO: 7834 - protein, 448 aa, Synechocystis sp; identical to SEQ ID NO: 4703

SEQ ID NO: 7835 - DNA, 1970 bp, Arabidopsis thaliana (mouse-ear cress); identical to SEQ ID NO: 4704
  CDS (140)..(1753)

SEQ ID NO: 7836 - protein, 537 aa, Arabidopsis thaliana (mouse-ear cress); identical to SEQ ID NO: 4705

SEQ ID NO: 7837 - DNA, 1921 bp, Nicotiana tabacum (common tobacco); identical to SEQ ID NO: 4706
  CDS (85)..(1695)

SEQ ID NO: 7838 - protein, 536 aa, Nicotiana tabacum (common tobacco); identical to SEQ ID NO: 4707

SEQ ID NO: 7839 - DNA, 1998 bp, Leishmania major; identical to SEQ ID NO: 4708
  CDS (1)..(1998)

SEQ ID NO: 7840 - protein, 665 aa, Leishmania major; identical to SEQ ID NO: 4709

SEQ ID NO: 7841 - DNA, 6993 bp, Triticum aestivum (common wheat); identical to SEQ ID NO: 4710
  CDS (39)..(6974)

SEQ ID NO: 7842 - protein, 2311 aa, Triticum aestivum (common wheat); identical to SEQ ID NO: 4711

SEQ ID NO: 7843 - DNA, 6786 bp, Glycine max (soybean); identical to SEQ ID NO: 4712
  CDS (1)..(6786)

SEQ ID NO: 7844 - protein, 2261 aa, Glycine max (soybean); identical to SEQ ID NO: 4713

SEQ ID NO: 7845 - DNA, 2030 bp, Glycine max (soybean); identical to SEQ ID NO: 4714
  CDS (90)..(1709)

SEQ ID NO: 7846 - protein, 539 aa, Glycine max (soybean); identical to SEQ ID NO: 4715

SEQ ID NO: 7847 - DNA, 6915 bp, Brassica napus (rape); identical to SEQ ID NO: 4716
  CDS (1)..(6915)

SEQ ID NO: 7848 - protein, 2304 aa, Brassica napus (rape); identical to SEQ ID NO: 4717

SEQ ID NO: 7849 - DNA, 7175 bp, Medicago sativa (alfalfa); identical to SEQ ID NO: 4718
  CDS (70)..(6843)

SEQ ID NO: 7850 - protein, 2257 aa, Medicago sativa (alfalfa); identical to SEQ ID NO: 4719

SEQ ID NO: 7851 - DNA, 2175 bp, Caenorhabditis elegans; identical to SEQ ID NO: 4720
  CDS (1)..(2175)

SEQ ID NO: 7852 - protein, 724 aa, Caenorhabditis elegans; identical to SEQ ID NO: 4721

SEQ ID NO: 7853 - DNA, 3864 bp, Caenorhabditis elegans; identical to SEQ ID NO: 4722
  CDS (36)..(3563)

SEQ ID NO: 7854 - protein, 1175 aa, Caenorhabditis elegans; identical to SEQ ID NO: 4723

SEQ ID NO: 7855 - DNA, 4974 bp, Caenorhabditis elegans; identical to SEQ ID NO: 4724
  CDS (1)..(4974)

SEQ ID NO: 7856 - protein, 1657 aa, Caenorhabditis elegans; identical to SEQ ID NO: 4725

SEQ ID NO: 7857 - DNA, 6867 bp, Emericella nidulans, Aspergillus nidulans; identical to SEQ ID NO: 4726
  CDS (1)..(6867)

SEQ ID NO: 7858 - protein, 2288 aa, Emericella nidulans, Aspergillus nidulans; identical to SEQ ID NO: 4727

SEQ ID NO: 7859 - DNA, 6165 bp, Caenorhabditis elegans; identical to SEQ ID NO: 4728
  CDS (1)..(6165)

SEQ ID NO: 7860 - protein, 2054 aa, Caenorhabditis elegans; identical to SEQ ID NO: 4729

SEQ ID NO: 7861 - DNA, 6843 bp, Schizosaccharomyces pombe; identical to SEQ ID NO: 4730
  CDS (1)..(6843)

SEQ ID NO: 7862 - protein, 2280 aa, Schizosaccharomyces pombe; identical to SEQ ID NO: 4731

SEQ ID NO: 7863 - DNA, 1773 bp, Streptomyces coelicolor; identical to SEQ ID NO: 4732
  CDS (1)..(1773)

SEQ ID NO: 7864 - protein, 590 aa, Streptomyces coelicolor; identical to SEQ ID NO: 4733

SEQ ID NO: 7865 - DNA, 1773 bp, Streptomyces coelicolor; identical to SEQ ID NO: 4734
  CDS (1)..(1773)

SEQ ID NO: 7866 - protein, 590 aa, Streptomyces coelicolor; identical to SEQ ID NO: 4735

SEQ ID NO: 7867 - DNA, 3933 bp, Aedes aegypti (yellow fever mosquito); identical to SEQ ID NO: 4736
  CDS (69)..(3656)

SEQ ID NO: 7868 - protein, 1195 aa, Aedes aegypti (yellow fever mosquito); identical to SEQ ID NO: 4737

SEQ ID NO: 7869 - DNA, 1542 bp, Sulfolobus metallicus; identical to SEQ ID NO: 4738
  CDS (1)..(1542)

SEQ ID NO: 7870 - protein, 513 aa, Sulfolobus metallicus; identical to SEQ ID NO: 4739

SEQ ID NO: 7871 - DNA, 1335 bp, Bacillus subtilis; identical to SEQ ID NO: 4740
  CDS (1)..(1335)

SEQ ID NO: 7872 - protein, 444 aa, Bacillus subtilis; identical to SEQ ID NO: 4741

SEQ ID NO: 7873 - DNA, 6822 bp, Brassica napus; identical to SEQ ID NO: 4742
  CDS (1)..(6822)

SEQ ID NO: 7874 - protein, 2273 aa, Brassica napus; identical to SEQ ID NO: 4743

SEQ ID NO: 7875 - DNA, 1599 bp, Corynebacterium glutamicum; identical to SEQ ID NO: 4744
  CDS (1)..(1599)

SEQ ID NO: 7876 - protein, 532 aa, Corynebacterium glutamicum; identical to SEQ ID NO: 4745

SEQ ID NO: 7877 - DNA, 3728 bp, Corynebacterium glutamicum; identical to SEQ ID NO: 4746
  CDS (165)..(3587)

SEQ ID NO: 7878 - protein, 1140 aa, Corynebacterium glutamicum; identical to SEQ ID NO: 4747

SEQ ID NO: 7879 - DNA, 7371 bp, Rattus norvegicus; identical to SEQ ID NO: 4748
  CDS (1)..(7371)

SEQ ID NO: 7880 - protein, 2456 aa, Rattus norvegicus; identical to SEQ ID NO: 4749

SEQ ID NO: 7881 - DNA, 3916 bp, Aspergillus terreus; identical to SEQ ID NO: 4750
  CDS (139)..(3720)

SEQ ID NO: 7882 - protein, 1193 aa, Aspergillus terreus; identical to SEQ ID NO: 4751

SEQ ID NO: 7883 - DNA, 3195 bp, Corynebacterium glutamicum; identical to SEQ ID NO: 4752
  CDS (872)..(2647)

SEQ ID NO: 7884 - protein, 591 aa, Corynebacterium glutamicum; identical to SEQ ID NO: 4753

SEQ ID NO: 7885 - DNA, 3558 bp, Schizosaccharomyces pombe; identical to SEQ ID NO: 4754
  CDS (1)..(3558)

SEQ ID NO: 7886 - protein, 1185 aa, Schizosaccharomyces pombe; identical to SEQ ID NO: 4755

SEQ ID NO: 7887 - DNA, 1620 bp, Arabidopsis thaliana; identical to SEQ ID NO: 4756
  CDS (1)..(1620): n means a or g or c or t/u

SEQ ID NO: 7888 - protein, 539 aa, Arabidopsis thaliana; identical to SEQ ID NO: 4757
  misc_feature (351)..(351): Xaa can be Asp or Glu

SEQ ID NO: 7889 - DNA, 3727 bp, Bacillus stearothermophilus; identical to SEQ ID NO: 4758
  CDS (92)..(3535)

SEQ ID NO: 7890 - protein, 1147 aa, Bacillus stearothermophilus; identical to SEQ ID NO: 4759

SEQ ID NO: 7891 - DNA, 6765 bp, Arabidopsis thaliana; identical to SEQ ID NO: 4760
  CDS (1)..(6765)

SEQ ID NO: 7892 - protein, 2254 aa, Arabidopsis thaliana; identical to SEQ ID NO: 4761

SEQ ID NO: 7893 - DNA, 6783 bp, Triticum aestivum; identical to SEQ ID NO: 4762
  CDS (1)..(6783): y means t/u or c

SEQ ID NO: 7894 - protein, 2260 aa, Triticum aestivum; identical to SEQ ID NO: 4763
  misc_feature (1980)..(1980): Xaa can be Pro or Ser

SEQ ID NO: 7895 - DNA, 3375 bp, Mycobacterium tuberculosis; identical to SEQ ID NO: 4764
  CDS (1)..(3375)

SEQ ID NO: 7896 - protein, 1124 aa, Mycobacterium tuberculosis; identical to SEQ ID NO: 4765

SEQ ID NO: 7897 - DNA, 1362 bp, Synechococcus sp; identical to SEQ ID NO: 4766
  CDS (1)..(1362)

SEQ ID NO: 7898 - protein, 453 aa, Synechococcus sp; identical to SEQ ID NO: 4767

SEQ ID NO: 7899 - DNA, 3800 bp, Rhizobium etli; identical to SEQ ID NO: 4768
  CDS (150)..(3614)

SEQ ID NO: 7900 - protein, 1154 aa, Rhizobium etli; identical to SEQ ID NO: 4769

SEQ ID NO: 7901 - DNA, 1422 bp, Wolinella succinogenes; identical to SEQ ID NO: 4770
  CDS (1)..(1422)

SEQ ID NO: 7902 - protein, 473 aa, Wolinella succinogenes; identical to SEQ ID NO: 4771

SEQ ID NO: 7903 - DNA, 3603 bp, Wolinella succinogenes; identical to SEQ ID NO: 4772
  CDS (1)..(3603)

SEQ ID NO: 7904 - protein, 1200 aa, Wolinella succinogenes; identical to SEQ ID NO: 4773

SEQ ID NO: 7905 - DNA, 1347 bp, Wolinella succinogenes; identical to SEQ ID NO: 4774
  CDS (1)..(1347)

SEQ ID NO: 7906 - protein, 448 aa, Wolinella succinogenes; identical to SEQ ID NO: 4775

SEQ ID NO: 7907 - DNA, 1956 bp, Chromobacterium violaceum; identical to SEQ ID NO: 4776
  CDS (1)..(1956)

SEQ ID NO: 7908 - protein, 651 aa, Chromobacterium violaceum; identical to SEQ ID NO: 4777

SEQ ID NO: 7909 - DNA, 1779 bp, Photorhabdus luminescens; identical to SEQ ID NO: 4778
  CDS (1)..(1779)

SEQ ID NO: 7910 - protein, 592 aa, Photorhabdus luminescens; identical to SEQ ID NO: 4779

SEQ ID NO: 7911 - DNA, 1350 bp, Photorhabdus luminescens; identical to SEQ ID NO: 4780
  CDS (1)..(1350)

SEQ ID NO: 7912 - protein, 449 aa, Photorhabdus luminescens; identical to SEQ ID NO: 4781

SEQ ID NO: 7913 - DNA, 1350 bp, Gloeobacter violaceus; identical to SEQ ID NO: 4782
  CDS (1)..(1350)

SEQ ID NO: 7914 - protein, 449 aa, Gloeobacter violaceus; identical to SEQ ID NO: 4783

SEQ ID NO: 7915 - DNA, 3609 bp, Gloeobacter violaceus; identical to SEQ ID NO: 4784
  CDS (1)..(3609)

SEQ ID NO: 7916 - protein, 1202 aa, Gloeobacter violaceus; identical to SEQ ID NO: 4785

SEQ ID NO: 7917 - DNA, 1491 bp, Chromobacterium violaceum; identical to SEQ ID NO: 4786
  CDS (1)..(1491)

SEQ ID NO: 7918 - protein, 496 aa, Chromobacterium violaceum; identical to SEQ ID NO: 4787

SEQ ID NO: 7919 - DNA, 1965 bp, Chromobacterium violaceum; identical to SEQ ID NO: 4788
  CDS (1)..(1965)

SEQ ID NO: 7920 - protein, 654 aa, Chromobacterium violaceum; identical to SEQ ID NO: 4789

SEQ ID NO: 7921 - DNA, 1998 bp, Rickettsia sibirica; identical to SEQ ID NO: 4790
  CDS (1)..(1998)

SEQ ID NO: 7922 - protein, 665 aa, Rickettsia sibirica; identical to SEQ ID NO: 4791

SEQ ID NO: 7923 - DNA, 1164 bp, Anopheles gambiae str; identical to SEQ ID NO: 4792
  CDS (1)..(1164)

SEQ ID NO: 7924 - protein, 387 aa, Anopheles gambiae str; identical to SEQ ID NO: 4793

SEQ ID NO: 7925 - DNA, 8736 bp, Plasmodium yoelii yoelii; identical to SEQ ID NO: 4794
  CDS (1)..(8736): m means a or c

SEQ ID NO: 7926 - protein, 2911 aa, Plasmodium yoelii yoelii; identical to SEQ ID NO: 4795
  misc_feature (1554)..(1554): Xaa can be Asp or Glu

SEQ ID NO: 7927 - DNA, 6828 bp, Neurospora crassa; identical to SEQ ID NO: 4796
  CDS (1)..(6828)

SEQ ID NO: 7928 - protein, 2275 aa, Neurospora crassa; identical to SEQ ID NO: 4797

SEQ ID NO: 7929 - DNA, 2232 bp, Neurospora crassa; identical to SEQ ID NO: 4798
  CDS (1)..(2232)

SEQ ID NO: 7930 - protein, 743 aa, Neurospora crassa; identical to SEQ ID NO: 4799

SEQ ID NO: 7931 - DNA, 1347 bp, Synechococcus sp; identical to SEQ ID NO: 4800
  CDS (1)..(1347)

SEQ ID NO: 7932 - protein, 448 aa, Synechococcus sp; identical to SEQ ID NO: 4801

SEQ ID NO: 7933 - DNA, 3501 bp, Rhodopirellula baltica; identical to SEQ ID NO: 4802
  CDS (1)..(3501)

SEQ ID NO: 7934 - protein, 1166 aa, Rhodopirellula baltica; identical to SEQ ID NO: 4803

SEQ ID NO: 7935 - DNA, 1353 bp, Rhodopirellula baltica; identical to SEQ ID NO: 4804
  CDS (1)..(1353)

SEQ ID NO: 7936 - protein, 450 aa, Rhodopirellula baltica; identical to SEQ ID NO: 4805

SEQ ID NO: 7937 - DNA, 1350 bp, Prochlorococcus marinus subsp; identical to SEQ ID NO: 4806
  CDS (1)..(1350)

SEQ ID NO: 7938 - protein, 449 aa, Prochlorococcus marinus subsp; identical to SEQ ID NO: 4807

SEQ ID NO: 7939 - DNA, 1347 bp, Prochlorococcus marinus; identical to SEQ ID NO: 4808
  CDS (1)..(1347)

SEQ ID NO: 7940 - protein, 448 aa, Prochlorococcus marinus; identical to SEQ ID NO: 4809

SEQ ID NO: 7941 - DNA, 1350 bp, Prochlorococcus marinus; identical to SEQ ID NO: 4810
  CDS (1)..(1350)

SEQ ID NO: 7942 - protein, 449 aa, Prochlorococcus marinus; identical to SEQ ID NO: 4811

SEQ ID NO: 7943 - DNA, 1425 bp, Helicobacter hepaticus; identical to SEQ ID NO: 4812
  CDS (1)..(1425)

SEQ ID NO: 7944 - protein, 474 aa, Helicobacter hepaticus; identical to SEQ ID NO: 4813

SEQ ID NO: 7945 - DNA, 1353 bp, Candidatus Blochmannia floridanus; identical to SEQ ID NO: 4814
  CDS (1)..(1353)

SEQ ID NO: 7946 - protein, 450 aa, Candidatus Blochmannia floridanus; identical to SEQ ID NO: 4815

SEQ ID NO: 7947 - DNA, 2022 bp, Bordetella parapertussis; identical to SEQ ID NO: 4816
  CDS (1)..(2022)

SEQ ID NO: 7948 - protein, 673 aa, Bordetella parapertussis; identical to SEQ ID NO: 4817

SEQ ID NO: 7949 - DNA, 1371 bp, Bordetella parapertussis; identical to SEQ ID NO: 4818
  CDS (1)..(1371)

SEQ ID NO: 7950 - protein, 456 aa, Bordetella parapertussis; identical to SEQ ID NO: 4819

SEQ ID NO: 7951 - DNA, 1365 bp, Bordetella bronchiseptica; identical to SEQ ID NO: 4820
  CDS (1)..(1365)

SEQ ID NO: 7952 - protein, 454 aa, Bordetella bronchiseptica; identical to SEQ ID NO: 4821

SEQ ID NO: 7953 - DNA, 1347 bp, Bordetella bronchiseptica; identical to SEQ ID NO: 4822
  CDS (1)..(1347)

SEQ ID NO: 7954 - protein, 448 aa, Bordetella bronchiseptica; identical to SEQ ID NO: 4823

SEQ ID NO: 7955 - DNA, 1365 bp, Bordetella bronchiseptica; identical to SEQ ID NO: 4824
  CDS (1)..(1365)

SEQ ID NO: 7956 - protein, 454 aa, Bordetella bronchiseptica; identical to SEQ ID NO: 4825

SEQ ID NO: 7957 - DNA, 3504 bp, Bordetella bronchiseptica; identical to SEQ ID NO: 4826
  CDS (1)..(3504)

SEQ ID NO: 7958 - protein, 1167 aa, Bordetella bronchiseptica; identical to SEQ ID NO: 4827

SEQ ID NO: 7959 - DNA, 7327 bp, Zea mays; identical to SEQ ID NO: 4828
  CDS (8)..(6985)

SEQ ID NO: 7960 - protein, 2325 aa, Zea mays; identical to SEQ ID NO: 4829

SEQ ID NO: 7961 - DNA, 7324 bp, Zea mays; identical to SEQ ID NO: 4830
  CDS (8)..(6982)

SEQ ID NO: 7962 - protein, 2324 aa, Zea mays; identical to SEQ ID NO: 4831

SEQ ID NO: 7963 - DNA, 3537 bp, Sus scrofa; identical to SEQ ID NO: 4832
  CDS (1)..(3537)

SEQ ID NO: 7964 - protein, 1178 aa, Sus scrofa; identical to SEQ ID NO: 4833

SEQ ID NO: 7965 - DNA, 7041 bp, Homo sapiens; identical to SEQ ID NO: 4834
  CDS (1)..(7041)

SEQ ID NO: 7966 - protein, 2346 aa, Homo sapiens [sequence omitted]

SEQ ID NO: 7967 - DNA, 2467 bp, Mus musculus; identical to SEQ ID NO: 4836
  CDS (6)..(2180)

SEQ ID NO: 7968 - protein, 724 aa, Mus musculus; identical to SEQ ID NO: 4837

SEQ ID NO: 7969 - DNA, 1323 bp, Bacillus cereus; identical to SEQ ID NO: 4838
  CDS (1)..(1323)

SEQ ID NO: 7970 - protein, 440 aa, Bacillus cereus; identical to SEQ ID NO: 4839

SEQ ID NO: 7971 - DNA, 3447 bp, Bacillus cereus; identical to SEQ ID NO: 4840
  CDS (1)..(3447)

SEQ ID NO: 7972 - protein, 1148 aa, Bacillus cereus; identical to SEQ ID NO: 4841

SEQ ID NO: 7973 - DNA, 1353 bp, Bacillus anthracis; identical to SEQ ID NO: 4842
  CDS (1)..(1353)

SEQ ID NO: 7974 - protein, 450 aa, Bacillus anthracis; identical to SEQ ID NO: 4843

SEQ ID NO: 7975 - DNA, 3447 bp, Bacillus anthracis; identical to SEQ ID NO: 4844
  CDS (1)..(3447)

SEQ ID NO: 7976 - protein, 1148 aa, Bacillus anthracis; identical to SEQ ID NO: 4845

SEQ ID NO: 7977 - DNA, 3636 bp, Nitrosomonas europaea; identical to SEQ ID NO: 4846
  CDS (1)..(3636)

SEQ ID NO: 7978 - protein, 1211 aa, Nitrosomonas europaea; identical to SEQ ID NO: 4847

SEQ ID NO: 7979 - DNA, 1356 bp, Chlamydophila caviae; identical to SEQ ID NO: 4848
  CDS (1)..(1356)

SEQ ID NO: 7980 - protein, 451 aa, Chlamydophila caviae; identical to SEQ ID NO: 4849

SEQ ID NO: 7981 - DNA, 3516 bp, Streptomyces avermitilis; identical to SEQ ID NO: 4850
  CDS (1)..(3516)

SEQ ID NO: 7982 - protein, 1171 aa, Streptomyces avermitilis; identical to SEQ ID NO: 4851

SEQ ID NO: 7983 - DNA, 2103 bp, Streptomyces avermitilis; identical to SEQ ID NO: 4852
  CDS (1)..(2103)

SEQ ID NO: 7984 - protein, 700 aa, Streptomyces avermitilis; identical to SEQ ID NO: 4853

SEQ ID NO: 7985 - DNA, 1851 bp, Streptomyces avermitilis; identical to SEQ ID NO: 4854
  CDS (1)..(1851)

SEQ ID NO: 7986 - protein, 616 aa, Streptomyces avermitilis; identical to SEQ ID NO: 4855

SEQ ID NO: 7987 - DNA, 1773 bp, Streptomyces avermitilis; identical to SEQ ID NO: 4856
  CDS (1)..(1773)

SEQ ID NO: 7988 - protein, 590 aa, Streptomyces avermitilis; identical to SEQ ID NO: 4857

SEQ ID NO: 7989 - DNA, 1359 bp, Nitrosomonas europaea; identical to SEQ ID NO: 4858
  CDS (1)..(1359)

SEQ ID NO: 7990 - protein, 452 aa, Nitrosomonas europaea; identical to SEQ ID NO: 4859

SEQ ID NO: 7991 - DNA, 1371 bp, Enterococcus faecalis; identical to SEQ ID NO: 4860
  CDS (1)..(1371)

SEQ ID NO: 7992 - protein, 456 aa, Enterococcus faecalis; identical to SEQ ID NO: 4861

SEQ ID NO: 7993 - DNA, 3492 bp, Enterococcus faecalis; identical to SEQ ID NO: 4862
  CDS (64)..(3492)

SEQ ID NO: 7994 - protein, 1142 aa, Enterococcus faecalis; identical to SEQ ID NO: 4863

SEQ ID NO: 7995 - DNA, 1347 bp, Coxiella burnetii; identical to SEQ ID NO: 4864
  CDS (1)..(1347)

SEQ ID NO: 7996 - protein, 448 aa, Coxiella burnetii; identical to SEQ ID NO: 4865

SEQ ID NO: 7997 - DNA, 1986 bp, Coxiella burnetii; identical to SEQ ID NO: 4866
  CDS (1)..(1986)

SEQ ID NO: 7998 - protein, 661 aa, Coxiella burnetii; identical to SEQ ID NO: 4867

SEQ ID NO: 7999 - DNA, 3396 bp, Tropheryma whipplei; identical to SEQ ID NO: 4868
  CDS (1)..(3396)

SEQ ID NO: 8000 - protein, 1131 aa, Tropheryma whipplei; identical to SEQ ID NO: 4869

SEQ ID NO: 8001 - DNA, 1776 bp, Tropheryma whipplei; identical to SEQ ID NO: 4870
  CDS (1)..(1776)

SEQ ID NO: 8002 - protein, 591 aa, Tropheryma whipplei; identical to SEQ ID NO: 4871

SEQ ID NO: 8003 - DNA, 2004 bp, Methylobacterium extorquens; identical to SEQ ID NO: 4872
  CDS (1)..(2004)

SEQ ID NO: 8004 - protein, 667 aa, Methylobacterium extorquens; identical to SEQ ID NO: 4873

SEQ ID NO: 8005 - DNA, 7446 bp, Setaria italica; identical to SEQ ID NO: 4874
  CDS (59)..(7024)

SEQ ID NO: 8006 - protein, 2321 aa, Setaria italica; identical to SEQ ID NO: 4875

SEQ ID NO: 8007 - DNA, 3994 bp, Bos taurus; identical to SEQ ID NO: 4876
  CDS (69)..(3605)

SEQ ID NO: 8008 - protein, 1178 aa, Bos taurus; identical to SEQ ID NO: 4877

SEQ ID NO: 8009 - DNA, 1530 bp, Acidianus brierleyi; identical to SEQ ID NO: 4878
  CDS (1)..(1530)

SEQ ID NO: 8010 - protein, 509 aa, Acidianus brierleyi; identical to SEQ ID NO: 4879

SEQ ID NO: 8011 - DNA, 1368 bp, Xylella fastidiosa; identical to SEQ ID NO: 4880
  CDS (1)..(1368)

SEQ ID NO: 8012 - protein, 455 aa, Xylella fastidiosa; identical to SEQ ID NO: 4881

SEQ ID NO: 8013 - DNA, 2115 bp, Vibrio parahaemolyticus; identical to SEQ ID NO: 4882
  CDS (1)..(2115)

SEQ ID NO: 8014 - protein, 704 aa, Vibrio parahaemolyticus; identical to SEQ ID NO: 4883

SEQ ID NO: 8015 - DNA, 1344 bp, Vibrio parahaemolyticus; identical to SEQ ID NO: 4884
  CDS (1)..(1344)

SEQ ID NO: 8016 - protein, 447 aa, Vibrio parahaemolyticus; identical to SEQ ID NO: 4885

SEQ ID NO: 8017 - DNA, 1416 bp, Pseudomonas syringae; identical to SEQ ID NO: 4886
  CDS (1)..(1416)

SEQ ID NO: 8018 - protein, 471 aa, Pseudomonas syringae; identical to SEQ ID NO: 4887

SEQ ID NO: 8019 - DNA, 1740 bp, Pseudomonas syringae; identical to SEQ ID NO: 4888
  CDS (1)..(1740)

SEQ ID NO: 8020 - protein, 579 aa, Pseudomonas syringae; identical to SEQ ID NO: 4889

SEQ ID NO: 8021 - DNA, 1344 bp, Pseudomonas syringae; identical to SEQ ID NO: 4890
  CDS (1)..(1344)

SEQ ID NO: 8022 - protein, 447 aa, Pseudomonas syringae; identical to SEQ ID NO: 4891

SEQ ID NO: 8023 - DNA, 3681 bp, Pseudomonas syringae; identical to SEQ ID NO: 4892
  CDS (1)..(3681)

SEQ ID NO: 8024 - protein, 1226 aa, Pseudomonas syringae; identical to SEQ ID NO: 4893

SEQ ID NO: 8025 - DNA, 1353 bp, Pseudomonas syringae; identical to SEQ ID NO: 4894
  CDS (1)..(1353)

SEQ ID NO: 8026 - protein, 450 aa, Pseudomonas syringae; identical to SEQ ID NO: 4895

SEQ ID NO: 8027 - DNA, 1950 bp, Pseudomonas syringae; identical to SEQ ID NO: 4896
  CDS (1)..(1950)

SEQ ID NO: 8028 - protein, 649 aa, Pseudomonas syringae; identical to SEQ ID NO: 4897

SEQ ID NO: 8029 - DNA, 1416 bp, Pseudomonas putida; identical to SEQ ID NO: 4898
  CDS (1)..(1416)

SEQ ID NO: 8030 - protein, 471 aa, Pseudomonas putida; identical to SEQ ID NO: 4899

SEQ ID NO: 8031 - DNA, 1953 bp, Pseudomonas putida; identical to SEQ ID NO: 4900
  CDS (1)..(1953)

SEQ ID NO: 8032 - protein, 650 aa, Pseudomonas putida; identical to SEQ ID NO: 4901

SEQ ID NO: 8033 - DNA, 1356 bp, Pseudomonas putida; identical to SEQ ID NO: 4902
  CDS (1)..(1356)

SEQ ID NO: 8034 - protein, 451 aa, Pseudomonas putida; identical to SEQ ID NO: 4903

SEQ ID NO: 8035 - DNA, 3435 bp, Lactobacillus plantarum; identical to SEQ ID NO: 4904
  CDS (1)..(3435)

SEQ ID NO: 8036 - protein, 1144 aa, Lactobacillus plantarum; identical to SEQ ID NO: 4905

SEQ ID NO: 8037 - DNA, 1389 bp, Lactobacillus plantarum; identical to SEQ ID NO: 4906
  CDS (1)..(1389)

SEQ ID NO: 8038 - protein, 462 aa, Lactobacillus plantarum; identical to SEQ ID NO: 4907

SEQ ID NO: 8039 - DNA, 1341 bp, Clostridium tetani; identical to SEQ ID NO: 4908
  CDS (1)..(1341)

SEQ ID NO: 8040 - protein, 446 aa, Clostridium tetani; identical to SEQ ID NO: 4909

SEQ ID NO: 8041 - DNA, 3318 bp, Bradyrhizobium japonicum; identical to SEQ ID NO: 4910
  CDS (1)..(3318)

SEQ ID NO: 8042 - protein, 1105 aa, Bradyrhizobium japonicum; identical to SEQ ID NO: 4911

SEQ ID NO: 8043 - DNA, 2016 bp, Bradyrhizobium japonicum; identical to SEQ ID NO: 4912
  CDS (1)..(2016)

SEQ ID NO: 8044 - protein, 671 aa, Bradyrhizobium japonicum; identical to SEQ ID NO: 4913

SEQ ID NO: 8045 - DNA, 2064 bp, Bradyrhizobium japonicum; identical to SEQ ID NO: 4914
  CDS (1)..(2064)

SEQ ID NO: 8046 - protein, 687 aa, Bradyrhizobium japonicum; identical to SEQ ID NO: 4915

SEQ ID NO: 8047 - DNA, 1359 bp, Bradyrhizobium japonicum; identical to SEQ ID NO: 4916
  CDS (1)..(1359)

SEQ ID NO: 8048 - protein, 452 aa, Bradyrhizobium japonicum; identical to SEQ ID NO: 4917

SEQ ID NO: 8049 - DNA, 1356 bp, Bradyrhizobium japonicum; identical to SEQ ID NO: 4918
  CDS (1)..(1356)

SEQ ID NO: 8050 - protein, 451 aa, Bradyrhizobium japonicum; identical to SEQ ID NO: 4919

SEQ ID NO: 8051 - DNA, 1977 bp, Bradyrhizobium japonicum; identical to SEQ ID NO: 4920
  CDS (1)..(1977)

SEQ ID NO: 8052 - protein, 658 aa, Bradyrhizobium japonicum; identical to SEQ ID NO: 4921

SEQ ID NO: 8053 - DNA, 1512 bp, Bacteroides thetaiotaomicron; identical to SEQ ID NO: 4922
  CDS (1)..(1512)

SEQ ID NO: 8054 - protein, 503 aa, Bacteroides thetaiotaomicron; identical to SEQ ID NO: 4923

SEQ ID NO: 8055 - DNA, 1512 bp, Bacteroides thetaiotaomicron; identical to SEQ ID NO: 4924
  CDS (1)..(1512)

SEQ ID NO: 8056 - protein, 503 aa, Bacteroides thetaiotaomicron; identical to SEQ ID NO: 4925

SEQ ID NO: 8057 - DNA, 2748 bp, Pagrus major; identical to SEQ ID NO: 4926
  CDS (188)..(2341): n means a or g or c or t/u

SEQ ID NO: 8058 - protein, 717 aa, Pagrus major; identical to SEQ ID NO: 4927

SEQ ID NO: 8059 - DNA, 4010 bp, Pagrus major; identical to SEQ ID NO: 4928
  CDS (389)..(3928): n means a or g or c or t/u

SEQ ID NO: 8060 - protein, 1179 aa, Pagrus major; identical to SEQ ID NO: 4929

SEQ ID NO: 8061 - DNA, 1359 bp, Staphylococcus epidermidis; identical to SEQ ID NO: 4930
  CDS (1)..(1359)

SEQ ID NO: 8062 - protein, 452 aa, Staphylococcus epidermidis; identical to SEQ ID NO: 4931

SEQ ID NO: 8063 - DNA, 1359 bp, Staphylococcus epidermidis; identical to SEQ ID NO: 4932
  CDS (1)..(1359)

SEQ ID NO: 8064 - protein, 452 aa, Staphylococcus epidermidis; identical to SEQ ID NO: 4933

SEQ ID NO: 8065 - DNA, 3465 bp, Staphylococcus epidermidis; identical to SEQ ID NO: 4934
  CDS (4)..(3465)

SEQ ID NO: 8066 - protein, 1153 aa, Staphylococcus epidermidis; identical to SEQ ID NO: 4935

SEQ ID NO: 8067 - DNA, 1338 bp, Wigglesworthia glossinidia brevipalpis; identical to SEQ ID NO: 4936
  CDS (1)..(1338)

SEQ ID NO: 8068 - protein, 445 aa, Wigglesworthia glossinidia brevipalpis; identical to SEQ ID NO: 4937

SEQ ID NO: 8069 - DNA, 1362 bp, Synechococcus elongatus; identical to SEQ ID NO: 4938
  CDS (1)..(1362)

SEQ ID NO: 8070 - protein, 453 aa, Synechococcus elongatus; identical to SEQ ID NO: 4939

SEQ ID NO: 8071 - DNA, 1371 bp, Streptococcus mutans; identical to SEQ ID NO: 4940
  CDS (1)..(1371)

SEQ ID NO: 8072 - protein, 456 aa, Streptococcus mutans; identical to SEQ ID NO: 4941

SEQ ID NO: 8073 - DNA, 1371 bp, Streptococcus agalactiae; identical to SEQ ID NO: 4942
  CDS (1)..(1371)

SEQ ID NO: 8074 - protein, 456 aa, Streptococcus agalactiae; identical to SEQ ID NO: 4943

SEQ ID NO: 8075 - DNA, 2085 bp, Shewanella oneidensis; identical to SEQ ID NO: 4944
  CDS (1)..(2085)

SEQ ID NO: 8076 - protein, 694 aa, Shewanella oneidensis; identical to SEQ ID NO: 4945

SEQ ID NO: 8077 - DNA, 4554 bp, Shewanella oneidensis; identical to SEQ ID NO: 4946
  CDS (1)..(4554)

SEQ ID NO: 8078 - protein, 1517 aa, Shewanella oneidensis; identical to SEQ ID NO: 4947

SEQ ID NO: 8079 - DNA, 1368 bp, Oceanobacillus iheyensis; identical to SEQ ID NO: 4948
  CDS (1)..(1368)

SEQ ID NO: 8080 - protein, 455 aa, Oceanobacillus iheyensis; identical to SEQ ID NO: 4949

SEQ ID NO: 8081 - DNA, 1341 bp, Oceanobacillus iheyensis; identical to SEQ ID NO: 4950
  CDS (1)..(1341)

SEQ ID NO: 8082 - protein, 446 aa, Oceanobacillus iheyensis; identical to SEQ ID NO: 4951

SEQ ID NO: 8083 - DNA, 3444 bp, Oceanobacillus iheyensis; identical to SEQ ID NO: 4952
  CDS (1)..(3444)

SEQ ID NO: 8084 - protein, 1147 aa, Oceanobacillus iheyensis; identical to SEQ ID NO: 4953

SEQ ID NO: 8085 - DNA, 1464 bp, Leptospira interrogans; identical to SEQ ID NO: 4954
  CDS (1)..(1464)

SEQ ID NO: 8086 - protein, 487 aa, Leptospira interrogans; identical to SEQ ID NO: 4955

SEQ ID NO: 8087 - DNA, 2381 bp, Corynebacterium efficiens; identical to SEQ ID NO: 4956
  CDS (982)..(2352)

SEQ ID NO: 8088 - protein, 456 aa, Corynebacterium efficiens; identical to SEQ ID NO: 4957

SEQ ID NO: 8089 - DNA, 3609 bp, Corynebacterium efficiens; identical to SEQ ID NO: 4958
  CDS (1)..(3609)

SEQ ID NO: 8090 - protein, 1202 aa, Corynebacterium efficiens; identical to SEQ ID NO: 4959

SEQ ID NO: 8091 - DNA, 3507 bp, Corynebacterium efficiens; identical to SEQ ID NO: 4960
  CDS (1)..(3507)

SEQ ID NO: 8092 - protein, 1168 aa, Corynebacterium efficiens; identical to SEQ ID NO: 4961

SEQ ID NO: 8093 - DNA, 3477 bp, Brucella suis; identical to SEQ ID NO: 4962
  CDS (1)..(3477)

SEQ ID NO: 8094 - protein, 1158 aa, Brucella suis; identical to SEQ ID NO: 4963

SEQ ID NO: 8095 - DNA, 2004 bp, Brucella suis; identical to SEQ ID NO: 4964
  CDS (1)..(2004)

SEQ ID NO: 8096 - protein, 667 aa, Brucella suis; identical to SEQ ID NO: 4965

SEQ ID NO: 8097 - DNA, 1359 bp, Brucella suis; identical to SEQ ID NO: 4966
  CDS (1)..(1359)

SEQ ID NO: 8098 - protein, 452 aa, Brucella suis; identical to SEQ ID NO: 4967

SEQ ID NO: 8099 - DNA, 1965 bp, Bifidobacterium longum; identical to SEQ ID NO: 4968
  CDS (1)..(1965)

SEQ ID NO: 8100 - protein, 654 aa, Bifidobacterium longum; identical to SEQ ID NO: 4969

SEQ ID NO: 8101 - DNA, 10011 bp, Plasmodium falciparum; identical to SEQ ID NO: 4970
  CDS (1)..(10011)

SEQ ID NO: 8102 - protein, 3336 aa, Plasmodium falciparum; identical to SEQ ID NO: 4971

SEQ ID NO: 8103 - DNA, 1533 bp, Metallosphaera sedula; identical to SEQ ID NO: 4972
  CDS (1)..(1533)

SEQ ID NO: 8104 - protein, 510 aa, Metallosphaera sedula; identical to SEQ ID NO: 4973

SEQ ID NO: 8105 - DNA, 3559 bp, Gallus gallus; identical to SEQ ID NO: 4974
  CDS (1)..(3537): s means g or c

SEQ ID NO: 8106 - protein, 1178 aa, Gallus gallus; identical to SEQ ID NO: 4975
  misc_feature (566)..(566): Xaa can be Ala or Pro

SEQ ID NO: 8107 - DNA, 1365 bp, Streptococcus pyogenes; identical to SEQ ID NO: 4976
  CDS (1)..(1365)

SEQ ID NO: 8108 - protein, 454 aa, Streptococcus pyogenes; identical to SEQ ID NO: 4977

SEQ ID NO: 8109 - DNA, 1344 bp, Chlorobium tepidum; identical to SEQ ID NO: 4978
  CDS (1)..(1344)

SEQ ID NO: 8110 - protein, 447 aa, Chlorobium tepidum; identical to SEQ ID NO: 4979

SEQ ID NO: 8111 - DNA, 7589 bp, Alopecurus myosuroides; identical to SEQ ID NO: 4980
  CDS (157)..(7119)

SEQ ID NO: 8112 - protein, 2320 aa, Alopecurus myosuroides; identical to SEQ ID NO: 4981

SEQ ID NO: 8113 - DNA, 4439 bp, Drosophila melanogaster; identical to SEQ ID NO: 4982
  CDS (417)..(4010)

SEQ ID NO: 8114 - protein, 1197 aa, Drosophila melanogaster; identical to SEQ ID NO: 4983

SEQ ID NO: 8115 - DNA, 1362 bp, Staphylococcus aureus; identical to SEQ ID NO: 4984
  CDS (1)..(1362)

SEQ ID NO: 8116 - protein, 453 aa, Staphylococcus aureus; identical to SEQ ID NO: 4985

SEQ ID NO: 8117 - DNA, 3453 bp, Staphylococcus aureus; identical to SEQ ID NO: 4986
  CDS (1)..(3453)

SEQ ID NO: 8118 - protein, 1150 aa, Staphylococcus aureus; identical to SEQ ID NO: 4987

SEQ ID NO: 8119 - DNA, 2028 bp, Xanthomonas campestris; identical to SEQ ID NO: 4988
  CDS (1)..(2028)

SEQ ID NO: 8120 - protein, 675 aa, Xanthomonas campestris; identical to SEQ ID NO: 4989

SEQ ID NO: 8121 - DNA, 3648 bp, Xanthomonas axonopodis; identical to SEQ ID NO: 4990
  CDS (1)..(3648)

SEQ ID NO: 8122 - protein, 1215 aa, Xanthomonas axonopodis; identical to SEQ ID NO: 4991

SEQ ID NO: 8123 - DNA, 2028 bp, Xanthomonas axonopodis; identical to SEQ ID NO: 4992
  CDS (1)..(2028)

SEQ ID NO: 8124 - protein, 675 aa, Xanthomonas axonopodis; identical to SEQ ID NO: 4993

SEQ ID NO: 8125 - DNA, 1494 bp, Methanosarcina mazei; identical to SEQ ID NO: 4994
  CDS (1)..(1494)

SEQ ID NO: 8126 - protein, 497 aa, Methanosarcina mazei; identical to SEQ ID NO: 4995

SEQ ID NO: 8127 - DNA, 1897 bp, Amycolatopsis mediterranei; identical to SEQ ID NO: 4996
  CDS (101)..(1897)

SEQ ID NO: 8128 - protein, 598 aa, Amycolatopsis mediterranei; identical to SEQ ID NO: 4997

SEQ ID NO: 8129 - DNA, 2381 bp, Corynebacterium efficiens; identical to SEQ ID NO: 4998
  CDS (577)..(2352)

SEQ ID NO: 8130 - protein, 591 aa, Corynebacterium efficiens; identical to SEQ ID NO: 4999

SEQ ID NO: 8131 - DNA, 7223 bp, Oryza sativa; identical to SEQ ID NO: 5000
  CDS (1)..(6804)

SEQ ID NO: 8132 - protein, 2267 aa, Oryza sativa; identical to SEQ ID NO: 5001

SEQ ID NO: 8133 - DNA, 1482 bp, Methanosarcina acetivorans; identical to SEQ ID NO: 5002
  CDS (1)..(1482)

SEQ ID NO: 8134 - protein, 493 aa, Methanosarcina acetivorans; identical to SEQ ID NO: 5003

SEQ ID NO: 8135 - DNA, 2511 bp, Homo sapiens; identical to SEQ ID NO: 5004
  CDS (47)..(2233)

SEQ ID NO: 8136 - protein, 728 aa, Homo sapiens; identical to SEQ ID NO: 5005

SEQ ID NO: 8137 - DNA, 4190 bp, Pichia angusta; identical to SEQ ID NO: 5006
  CDS (275)..(3802)

SEQ ID NO: 8138 - protein, 1175 aa, Pichia angusta; identical to SEQ ID NO: 5007

SEQ ID NO: 8139 - DNA, 1353 bp, Clostridium perfringens; identical to SEQ ID NO: 5008
  CDS (1)..(1353)

SEQ ID NO: 8140 - protein, 450 aa, Clostridium perfringens; identical to SEQ ID NO: 5009

SEQ ID NO: 8141 - DNA, 1368 bp, Ralstonia solanacearum; identical to SEQ ID NO: 5010
  CDS (1)..(1368)

SEQ ID NO: 8142 - protein, 455 aa, Ralstonia solanacearum; identical to SEQ ID NO: 5011

SEQ ID NO: 8143 - DNA, 1371 bp, Ralstonia solanacearum; identical to SEQ ID NO: 5012
  CDS (1)..(1371)

SEQ ID NO: 8144 - protein, 456 aa, Ralstonia solanacearum; identical to SEQ ID NO: 5013

SEQ ID NO: 8145 - DNA, 2139 bp, Ralstonia solanacearum; identical to SEQ ID NO: 5014
  CDS (1)..(2139)

SEQ ID NO: 8146 - protein, 712 aa, Ralstonia solanacearum; identical to SEQ ID NO: 5015

SEQ ID NO: 8147 - DNA, 3459 bp, Rhizobium meliloti; identical to SEQ ID NO: 5016
  CDS (1)..(3459)

SEQ ID NO: 8148 - protein, 1152 aa, Rhizobium meliloti; identical to SEQ ID NO: 5017

SEQ ID NO: 8149 - DNA, 1350 bp, Rhizobium meliloti; identical to SEQ ID NO: 5018
  CDS (1)..(1350)

SEQ ID NO: 8150 - protein, 449 aa, Rhizobium meliloti; identical to SEQ ID NO: 5019

SEQ ID NO: 8151 - DNA, 1677 bp, Brassica napus; identical to SEQ ID NO: 5020
  CDS (34)..(1641)

SEQ ID NO: 8152 - protein, 535 aa, Brassica napus; identical to SEQ ID NO: 5021

SEQ ID NO: 8153 - DNA, 1542 bp, Sulfolobus tokodaii; identical to SEQ ID NO: 5022
  CDS (1)..(1542)

SEQ ID NO: 8154 - protein, 513 aa, Sulfolobus tokodaii; identical to SEQ ID NO: 5023

SEQ ID NO: 8155 - DNA, 2085 bp, Rhizobium loti; identical to SEQ ID NO: 5024
  CDS (1)..(2085)

SEQ ID NO: 8156 - protein, 694 aa, Rhizobium loti; identical to SEQ ID NO: 5025

SEQ ID NO: 8157 - DNA, 1962 bp, Rhizobium loti; identical to SEQ ID NO: 5026
  CDS (1)..(1962)

SEQ ID NO: 8158 - protein, 653 aa, Rhizobium loti; identical to SEQ ID NO: 5027

SEQ ID NO: 8159 - DNA, 3459 bp, Rhizobium loti; identical to SEQ ID NO: 5028
  CDS (1)..(3459)

SEQ ID NO: 8160 - protein, 1152 aa, Rhizobium loti; identical to SEQ ID NO: 5029

SEQ ID NO: 8161 - DNA, 2013 bp, Rhizobium loti; identical to SEQ ID NO: 5030
  CDS (1)..(2013)

SEQ ID NO: 8162 - protein, 670 aa, Rhizobium loti; identical to SEQ ID NO: 5031

SEQ ID NO: 8163 - DNA, 1347 bp, Pasteurella multocida; identical to SEQ ID NO: 5032
  CDS (1)..(1347)

SEQ ID NO: 8164 - protein, 448 aa, Pasteurella multocida; identical to SEQ ID NO: 5033

SEQ ID NO: 8165 - DNA, 4000 bp, Brachydanio rerio; identical to SEQ ID NO: 5034
  CDS (25)..(3567)

SEQ ID NO: 8166 - protein, 1180 aa, Brachydanio rerio; identical to SEQ ID NO: 5035

SEQ ID NO: 8167 - DNA, 1386 bp, Streptomyces sp; identical to SEQ ID NO: 5036
  CDS (1)..(1386)

SEQ ID NO: 8168 - protein, 461 aa, Streptomyces sp; identical to SEQ ID NO: 5037

SEQ ID NO: 8169 - DNA, 1344 bp, Gamma; identical to SEQ ID NO: 5038
  CDS (1)..(1344)

SEQ ID NO: 8170 - protein, 447 aa, Gamma; identical to SEQ ID NO: 5039

SEQ ID NO: 8171 - DNA, 4218 bp, Mycobacterium smegmatis; identical to SEQ ID NO: 5040
  CDS (600)..(3983)

SEQ ID NO: 8172 - protein, 1127 aa, Mycobacterium smegmatis; identical to SEQ ID NO: 5041

SEQ ID NO: 8173 - DNA, 1722 bp, Myxococcus xanthus; identical to SEQ ID NO: 5042
  CDS (1)..(1722)

SEQ ID NO: 8174 - protein, 573 aa, Myxococcus xanthus; identical to SEQ ID NO: 5043

SEQ ID NO: 8175 - DNA, 6966 bp, Brassica napus; identical to SEQ ID NO: 5044
  CDS (1)..(6966)

SEQ ID NO: 8176 - protein, 2321 aa, Brassica napus; identical to SEQ ID NO: 5045

SEQ ID NO: 8177 - DNA, 7128 bp, Arabidopsis thaliana; identical to SEQ ID NO: 5046
  CDS (1)..(7128)

SEQ ID NO: 8178 - protein, 2375 aa, Arabidopsis thaliana; identical to SEQ ID NO: 5047

SEQ ID NO: 8179 - DNA, 3579 bp, Aspergillus niger; identical to SEQ ID NO: 5048
  CDS (1)..(3579)

SEQ ID NO: 8180 - protein, 1192 aa, Aspergillus niger; identical to SEQ ID NO: 5049

SEQ ID NO: 8181 - DNA, 1482 bp, Methanosarcina barkeri; identical to SEQ ID NO: 5050
  CDS (1)..(1482)

SEQ ID NO: 8182 - protein, 493 aa, Methanosarcina barkeri; identical to SEQ ID NO: 5051

SEQ ID NO: 8183 - DNA, 1845 bp, Streptomyces coelicolor; identical to SEQ ID NO: 5052
  CDS (1)..(1845)

SEQ ID NO: 8184 - protein, 614 aa, Streptomyces coelicolor; identical to SEQ ID NO: 5053

SEQ ID NO: 8185 - DNA, 1941 bp, Streptomyces coelicolor; identical to SEQ ID NO: 5054
  CDS (1)..(1941)

SEQ ID NO: 8186 - protein, 646 aa, Streptomyces coelicolor; identical to SEQ ID NO: 5055

SEQ ID NO: 8187 - DNA, 1293 bp, Bacillus subtilis; identical to SEQ ID NO: 5056
  CDS (1)..(1293)

SEQ ID NO: 8188 - protein, 430 aa, Bacillus subtilis; identical to SEQ ID NO: 5057

SEQ ID NO: 8189 - DNA, 1323 bp, Lactobacillus plantarum; identical to SEQ ID NO: 5058
  CDS (1)..(1323)

SEQ ID NO: 8190 - protein, 440 aa, Lactobacillus plantarum; identical to SEQ ID NO: 5059

SEQ ID NO: 8191 - DNA, 1620 bp, Glycine max; identical to SEQ ID NO: 5060
  CDS (1)..(1620)

SEQ ID NO: 8192 - protein, 539 aa, Glycine max; identical to SEQ ID NO: 5061

SEQ ID NO: 8193 - DNA, 3622 bp, Lactococcus lactis; identical to SEQ ID NO: 5062
  CDS (105)..(3518)

SEQ ID NO: 8194 - protein, 1137 aa, Lactococcus lactis; identical to SEQ ID NO: 5063

SEQ ID NO: 8195 - DNA, 3375 bp, Streptomyces coelicolor; identical to SEQ ID NO: 5064
  CDS (1)..(3375)

SEQ ID NO: 8196 - protein, 1124 aa, Streptomyces coelicolor; identical to SEQ ID NO: 5065

SEQ ID NO: 8197 - DNA, 8001 bp, Drosophila melanogaster; identical to SEQ ID NO: 5066
  CDS (177)..(7625)

SEQ ID NO: 8198 - protein, 2482 aa, Drosophila melanogaster; identical to SEQ ID NO: 5067

SEQ ID NO: 8199 - DNA, 2397 bp, Drosophila melanogaster; identical to SEQ ID NO: 5068
  CDS (74)..(2170)

SEQ ID NO: 8200 - protein, 698 aa, Drosophila melanogaster; identical to SEQ ID NO: 5069

SEQ ID NO: 8201 - DNA, 4311 bp, Pseudomonas fluorescens; identical to SEQ ID NO: 5070
  CDS (125)..(3766)

SEQ ID NO: 8202 - protein, 1213 aa, Pseudomonas fluorescens; identical to SEQ ID NO: 5071

SEQ ID NO: 8203 - DNA, 1755 bp, Streptomyces venezuelae; identical to SEQ ID NO: 5072
  CDS (1)..(1755)

SEQ ID NO: 8204 - protein, 584 aa, Streptomyces venezuelae; identical to SEQ ID NO: 5073

SEQ ID NO: 8205 - DNA, 4391 bp, Drosophila melanogaster; identical to SEQ ID NO: 5074
  CDS (417)..(3962)

SEQ ID NO: 8206 - protein, 1181 aa, Drosophila melanogaster; identical to SEQ ID NO: 5075

SEQ ID NO: 8207 - DNA, 9422 bp, Ovis aries; identical to SEQ ID NO: 5076
  CDS (320)..(7360)

SEQ ID NO: 8208 - protein, 2346 aa, Ovis aries; identical to SEQ ID NO: 5077

SEQ ID NO: 8209 - DNA, 7452 bp, Homo sapiens; identical to SEQ ID NO: 5078
  CDS (1)..(7452)

SEQ ID NO: 8210 - protein, 2483 aa, Homo sapiens; identical to SEQ ID NO: 5079

SEQ ID NO: 8211 - DNA, 2546 bp, Homo sapiens; identical to SEQ ID NO: 5080
  CDS (133)..(2310)

SEQ ID NO: 8212 - protein, 725 aa, Homo sapiens; identical to SEQ ID NO: 5081

SEQ ID NO: 8213 - DNA, 3953 bp, Homo sapiens; identical to SEQ ID NO: 5082
  CDS (39)..(3575)

SEQ ID NO: 8214 - protein, 1178 aa, Homo sapiens; identical to SEQ ID NO: 5083

SEQ ID NO: 8215 - DNA, 4456 bp, Pichia pastoris; identical to SEQ ID NO: 5084
  CDS (700)..(4269)

SEQ ID NO: 8216 - protein, 1189 aa, Pichia pastoris; identical to SEQ ID NO: 5085

SEQ ID NO: 8217 - DNA, 3945 bp, Rattus norvegicus; identical to SEQ ID NO: 5086
  CDS (35)..(3571)

SEQ ID NO: 8218 - protein, 1178 aa, Rattus norvegicus; identical to SEQ ID NO: 5087

SEQ ID NO: 8219 - DNA, 3858 bp, Xenopus laevis; identical to SEQ ID NO: 5088
  CDS (33)..(3566)

SEQ ID NO: 8220 - protein, 1177 aa, Xenopus laevis; identical to SEQ ID NO: 5089

SEQ ID NO: 8221 - DNA, 3468 bp, Agrobacterium vitis; identical to SEQ ID NO: 5090
  CDS (1)..(3468)

SEQ ID NO: 8222 - protein, 1155 aa, Agrobacterium vitis; identical to SEQ ID NO: 5091

SEQ ID NO: 8223 - DNA, 1341 bp, Geobacter sulfurreducens; identical to SEQ ID NO: 5092
  CDS (1)..(1341)

SEQ ID NO: 8224 - protein, 446 aa, Geobacter sulfurreducens; identical to SEQ ID NO: 5093

SEQ ID NO: 8225 - DNA, 3447 bp, Geobacter sulfurreducens; identical to SEQ ID NO: 5094
  CDS (1)..(3447)

SEQ ID NO: 8226 - protein, 1148 aa, Geobacter sulfurreducens; identical to SEQ ID NO: 5095

SEQ ID NO: 8227 - DNA, 7496 bp, Homo sapiens; identical to SEQ ID NO: 5096
  CDS (120)..(7496)

SEQ ID NO: 8228 - protein, 2458 aa, Homo sapiens [sequence omitted]

SEQ ID NO: 8229 - DNA, 2172 bp, Emericella nidulans; identical to SEQ ID NO: 5098
  CDS (1)..(2172)

SEQ ID NO: 8230 - protein, 723 aa, Emericella nidulans; identical to SEQ ID NO: 5099

SEQ ID NO: 8231 - DNA, 3384 bp, Mycobacterium paratuberculosis; identical to SEQ ID NO: 5100
  CDS (1)..(3384)

SEQ ID NO: 8232 - protein, 1127 aa, Mycobacterium paratuberculosis; identical to SEQ ID NO: 5101

SEQ ID NO: 8233 - DNA, 1992 bp, Mycobacterium paratuberculosis; identical to SEQ ID NO: 5102
  CDS (1)..(1992)

SEQ ID NO: 8234 - protein, 663 aa, Mycobacterium paratuberculosis; identical to SEQ ID NO: 5103

SEQ ID NO: 8235 - DNA, 2016 bp, Mycobacterium paratuberculosis; identical to SEQ ID NO: 5104
  CDS (1)..(2016)

SEQ ID NO: 8236 - protein, 671 aa, Mycobacterium paratuberculosis; identical to SEQ ID NO: 5105

SEQ ID NO: 8237 - DNA, 3228 bp, Mycobacterium paratuberculosis; identical to SEQ ID NO: 5106
  CDS (1)..(3228)

SEQ ID NO: 8238 - protein, 1075 aa, Mycobacterium paratuberculosis; identical to SEQ ID NO: 5107

SEQ ID NO: 8239 - DNA, 1824 bp, Mycobacterium paratuberculosis; identical to SEQ ID NO: 5108
  CDS (1)..(1824)

SEQ ID NO: 8240 - protein, 607 aa, Mycobacterium paratuberculosis; identical to SEQ ID NO: 5109

SEQ ID NO: 8241 - DNA, 1320 bp, Treponema denticola; identical to SEQ ID NO: 5110
  CDS (1)..(1320)

SEQ ID NO: 8242 - protein, 439 aa, Treponema denticola; identical to SEQ ID NO: 5111

SEQ ID NO: 8243 - DNA, 2076 bp, Wolbachia pipientis wMel; identical to SEQ ID NO: 5112
  CDS (1)..(2076)

SEQ ID NO: 8244 - protein, 691 aa, Wolbachia pipientis wMel; identical to SEQ ID NO: 5113

SEQ ID NO: 8245 - DNA, 1338 bp, Bacillus cereus; identical to SEQ ID NO: 5114
  CDS (1)..(1338)

SEQ ID NO: 8246 - protein, 445 aa, Bacillus cereus; identical to SEQ ID NO: 5115

SEQ ID NO: 8247 - DNA, 6696 bp, Ashbya gossypii; identical to SEQ ID NO: 5116
  CDS (1)..(6696)

SEQ ID NO: 8248 - protein, 2231 aa, Ashbya gossypii; identical to SEQ ID NO: 5117

SEQ ID NO: 8249 - DNA, 3516 bp, Ashbya gossypii; identical to SEQ ID NO: 5118
  CDS (1)..(3516)

SEQ ID NO: 8250 - protein, 1171 aa, Ashbya gossypii; identical to SEQ ID NO: 5119

SEQ ID NO: 8251 - DNA, 5460 bp, Ashbya gossypii; identical to SEQ ID NO: 5120
  CDS (1)..(5460)

SEQ ID NO: 8252 - protein, 1819 aa, Ashbya gossypii; identical to SEQ ID NO: 5121

SEQ ID NO: 8253 - DNA, 1347 bp, uncultured marine gamma proteobacterium EBAC20E09; identical to SEQ ID NO: 5122
  CDS (1)..(1347)

SEQ ID NO: 8254 - protein, 448 aa, uncultured marine gamma proteobacterium EBAC20E09; identical to SEQ ID NO: 5123

SEQ ID NO: 8255 - DNA, 1338 bp, Thermus thermophilus; identical to SEQ ID NO: 5124
  CDS (1)..(1338)

SEQ ID NO: 8256 - protein, 445 aa, Thermus thermophilus; identical to SEQ ID NO: 5125

SEQ ID NO: 8257 - DNA, 3678 bp, Desulfovibrio vulgaris; identical to SEQ ID NO: 5126
  CDS (1)..(3678)

SEQ ID NO: 8258 - protein, 1225 aa, Desulfovibrio vulgaris; identical to SEQ ID NO: 5127

SEQ ID NO: 8259 - DNA, 1416 bp, Desulfovibrio vulgaris; identical to SEQ ID NO: 5128
  CDS (1)..(1416)

SEQ ID NO: 8260 - protein, 471 aa, Desulfovibrio vulgaris; identical to SEQ ID NO: 5129

SEQ ID NO: 8261 - DNA, 3441 bp, Listeria monocytogenes str; identical to SEQ ID NO: 5130
  CDS (1)..(3441)

SEQ ID NO: 8262 - protein, 1146 aa, Listeria monocytogenes str; identical to SEQ ID NO: 5131

SEQ ID NO: 8263 - DNA, 3516 bp, Oleomonas sagaranensis; identical to SEQ ID NO: 5132
  CDS (1)..(3516)

SEQ ID NO: 8264 - protein, 1171 aa, Oleomonas sagaranensis; identical to SEQ ID NO: 5133

SEQ ID NO: 8265 - DNA, 2016 bp, Caenorhabditis elegans; identical to SEQ ID NO: 5134
  CDS (1)..(2016)

SEQ ID NO: 8266 - protein, 671 aa, Caenorhabditis elegans; identical to SEQ ID NO: 5135

SEQ ID NO: 8267 - DNA, 1350 bp, Bacillus amyloliquefaciens; identical to SEQ ID NO: 5136
  CDS (1)..(1350)

SEQ ID NO: 8268 - protein, 449 aa, Bacillus amyloliquefaciens; identical to SEQ ID NO: 5137

SEQ ID NO: 8269 - DNA, 3549 bp, Rhodopseudomonas palustris; identical to SEQ ID NO: 5138
  CDS (1)..(3549)

SEQ ID NO: 8270 - protein, 1182 aa, Rhodopseudomonas palustris; identical to SEQ ID NO: 5139

SEQ ID NO: 8271 - DNA, 3312 bp, Rhodopseudomonas palustris; identical to SEQ ID NO: 5140
  CDS (1)..(3312)

SEQ ID NO: 8272 - protein, 1103 aa, Rhodopseudomonas palustris; identical to SEQ ID NO: 5141

SEQ ID NO: 8273 - DNA, 1983 bp, Rhodopseudomonas palustris; identical to SEQ ID NO: 5142
  CDS (1)..(1983)

SEQ ID NO: 8274 - protein, 660 aa, Rhodopseudomonas palustris; identical to SEQ ID NO: 5143

SEQ ID NO: 8275 - DNA, 1353 bp, Rhodopseudomonas palustris; identical to SEQ ID NO: 5144
  CDS (1)..(1353)

SEQ ID NO: 8276 - protein, 450 aa, Rhodopseudomonas palustris; identical to SEQ ID NO: 5145

SEQ ID NO: 8277 - DNA, 2016 bp, Rhodopseudomonas palustris; identical to SEQ ID NO: 5146
  CDS (1)..(2016)

SEQ ID NO: 8278 - protein, 671 aa, Rhodopseudomonas palustris; identical to SEQ ID NO: 5147

SEQ ID NO: 8279 - DNA, 2016 bp, Rhodopseudomonas palustris; identical to SEQ ID NO: 5148
  CDS (1)..(2016)

SEQ ID NO: 8280 - protein, 671 aa, Rhodopseudomonas palustris; identical to SEQ ID NO: 5149

SEQ ID NO: 8281 - DNA, 3426 bp, Corynebacterium diphtheriae; identical to SEQ ID NO: 5150
  CDS (1)..(3426)

SEQ ID NO: 8282 - protein, 1141 aa, Corynebacterium diphtheriae; identical to SEQ ID NO: 5151

SEQ ID NO: 8283 - DNA, 1785 bp, Corynebacterium diphtheriae; identical to SEQ ID NO: 5152
  CDS (1)..(1785)

SEQ ID NO: 8284 - protein, 594 aa, Corynebacterium diphtheriae; identical to SEQ ID NO: 5153

SEQ ID NO: 8285 - DNA, 1479 bp, Bdellovibrio bacteriovorus; identical to SEQ ID NO: 5154
  CDS (1)..(1479)

SEQ ID NO: 8286 - protein, 492 aa, Bdellovibrio bacteriovorus; identical to SEQ ID NO: 5155

SEQ ID NO: 8287 - DNA, 1503 bp, Bdellovibrio bacteriovorus; identical to SEQ ID NO: 5156
  CDS (1)..(1503)

SEQ ID NO: 8288 - protein, 500 aa, Bdellovibrio bacteriovorus; identical to SEQ ID NO: 5157

SEQ ID NO: 8289 - DNA, 1362 bp, Parachlamydia sp; identical to SEQ ID NO: 5158
  CDS (1)..(1362)

SEQ ID NO: 8290 - protein, 453 aa, Parachlamydia sp; identical to SEQ ID NO: 5159

SEQ ID NO: 8291 - DNA, 1506 bp, Methanococcus maripaludis; identical to SEQ ID NO: 5160
  CDS (1)..(1506)

SEQ ID NO: 8292 - protein, 501 aa, Methanococcus maripaludis; identical to SEQ ID NO: 5161

SEQ ID NO: 8293 - DNA, 1719 bp, Streptomyces antibioticus; identical to SEQ ID NO: 5162
  CDS (1)..(1719)

SEQ ID NO: 8294 - protein, 572 aa, Streptomyces antibioticus; identical to SEQ ID NO: 5163

SEQ ID NO: 8295 - DNA, 1344 bp, Photobacterium profundum; identical to SEQ ID NO: 5164
  CDS (1)..(1344)

SEQ ID NO: 8296 - protein, 447 aa, Photobacterium profundum; identical to SEQ ID NO: 5165

SEQ ID NO: 8297 - DNA, 26 bp, artificial sequence
  primer
ttatttttcctgaagaccgagttttt

SEQ ID NO: 8298 - DNA, 24 bp, artificial sequence
  primer
atgctggataaaattgttattgcc

SEQ ID NO: 8299 - DNA, 693 bp, Saccharomyces cerevisiae
  CDS (1)..(693)
atgcctgtcccatctgttactgtcactaccgataatgaatatgaagacatatcgtccttttcttctattgactcttacaaaccggagccctttactgggttcaaagattctgaagctccagaacagcctcttttaaaaaacgataccattgttggaaaggggcaactggaagatgatagtaatgtagatgatcaacaccgtcattcagatgtgcattctcatcacagttctagtactttaaaaaggccaacttcaaattcgatagaaaagatggttacccacaatgctttagagggcaactcagaaacagttgattccttaaaagaagatggtttaaatttgaacaagaaagctcttccggatattaccgccccagtaacaaactcagctcacgatgctgcatttccagaagagtatcgtttagaaactgaaaccgggttggtcaaattgaagacgcttgaaagtttgaagagggaggactctcgcgtatcctcaactaaaaaagagcatattaacgaccatacagatatgcattcgacacgatccaaggttactacaaattctcaaggttcttctctagaaccaaacaagttgaacatggcagtagagaagaataagaagaggatcgaaaaatatcaaaaacataaatcagaaaaggggatcaaggggttttttcatagaattttcgattaa

SEQ ID NO: 8300 - protein, 230 aa, Saccharomyces cerevisiae
MPVPSVTVTTDNEYEDISSFSSIDSYKPEPFTGFKDSEAPEQPLLKNDTIVGKGQLEDDSNVDDQHRHSDVHSHHSSSTLKRPTSNSIEKMVTHNALEGNSETVDSLKEDGLNLNKKALPDITAPVTNSAHDAAFPEEYRLETETGLVKLKTLESLKREDSRVSSTKKEHINDHTDMHSTRSKVTTNSQGSSLEPNKLNMAVEKNKKRIEKYQKHKSEKGIKGFFHRIFD

SEQ ID NO: 8301 - DNA, 23 bp, artificial sequence
  primer
atgcctgtcccatctgttactgt

SEQ ID NO: 8302 - DNA, 27 bp, artificial sequence
  primer
ttaatcgaaaattctatgaaaaaaccc

SEQ ID NO: 8303 - DNA, 549 bp, Saccharomyces cerevisiae
  CDS (1)..(549)
atgttaaaaagacgctctaatgctctcattactttgagtagaactaaattgtttcccataacaaccgttgcctattaccacaggcgcctcctcaaccaacaacgaagagctgtttcaacgtcaccgaagaaagaaatcaagagcctagaagacttggctaatttggattctttggatggtgttgatactgaactgatacgcgatttgattaatgagcatactacaaaattaaatatcaaaaaggagttagatatgctcaaaaaattctcgcaagaggaagaatcaggacatgagatccctgtaaaaagatttattaggcctctttggatgttcattctaatgggatcttccgtttatttactgcttcacttctcttggtggaaactagagcatgaggagagagaaagtcagctaaagaaagaggtagaaatcctggaacaccaattaaatgagttaattgtacaggataaaacccacaatactagtaggggaaagggcagtaatgaatcaacacatatgaagccttggtataggagatggttttggtga

SEQ ID NO: 8304 - protein, 182 aa, Saccharomyces cerevisiae
MLKRRSNALITLSRTKLFPITTVAYYHRRLLNQQRRAVSTSPKKEIKSLEDLANLDSLDGVDTELIRDLINEHTTKLNIKKELDMLKKFSQEEESGHEIPVKRFIRPLWMFILMGSSVYLLLHFSWWKLEHEERESQLKKEVEILEHQLNELIVQDKTHNTSRGKGSNESTHMKPWYRRWFW

SEQ ID NO: 8305 - DNA, 651 bp, Ashbya gossypii
  CDS (1)..(651)
atgcatggaaactgcgggcacaatacggcctttacaggcgtgattaggtgtacaatgttgtgtattgaactttttatgtgtaatgagttactatgtgcggggcgtggtgcccaagacggcgcttcacccaccgcaaagcactctctgtgcaggccgtttcacgagcaagccatgatccgttacgcactgctaaggagcggaaggcggacactgcagactcggccctcgccacagacactagaggaactcgctcgtctgaagagcctagaggacgtggatagtagtgttattcggaagctaattaaccaacgtacagaggaggtaaacgcacagaatgaggctcagatgctaaagaagctatccgcggaaggccgggacttacagaacgtcccgggcagtcgctatgctaggccgctatggctgctgctgattggatgtgcatcggtgtatctagtgcgggattggctaagaatgaaggccgagtacgatgcgcgtgaaactactctggaaactcgcgtggaggggctagaggcggagctgaaatatttgttggaacctaagcctggagtgctagaggtagaagtcgttcaaacagaggttgcatcttctgcgccctggtataaacgctggctctggtccggttctcgctga

SEQ ID NO: 8306 - protein, 216 aa, Ashbya gossypii
MHGNCGHNTAFTGVIRCTMLCIELFMCNELLCAGRGAQDGASPTAKHSLCRPFHEQAMIRYALLRSGRRTLQTRPSPQTLEELARLKSLEDVDSSVIRKLINQRTEEVNAQNEAQMLKKLSAEGRDLQNVPGSRYARPLWLLLIGCASVYLVRDWLRMKAEYDARETTLETRVEGLEAELKYLLEPKPGVLEVEVVQTEVASSAPWYKRWLWSGSR

SEQ ID NO: 8307 - DNA, 25 bp, artificial sequence
  primer
atgttaaaaagacgctctaatgctc

SEQ ID NO: 8308 - DNA, 25 bp, artificial sequence
  primer
tcaccaaaaccatctcctataccaa

SEQ ID NO: 8309 - DNA, 976 bp, Escherichia coli K12
  CDS (280)..(969)
ccagtcaagaaaagcctgatgttcagcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctcctcgactggatgttacctggcggctccggtatccagttcatcaaacacctcaagcgcgagtcgatgacccgggatattccagtggtgatgttgaccgccagaggggaagaagaagatcgcgtgcgcggccttgaaaccggcgcggatgactatatcaccaagccgttttcgccgaaggagctggtggcgcgaatcaaagcggtaatgcgccgtatttcgccaatggcggtggaagaggtgattgagatgcagggattaagtctcgacccgacatctcaccgagtgatggcgggcgaagagccgctggagatggggccgacagaatttaaactgctgcacttttttatgacgcatcctgagcgcgtgtacagccgcgagcagctgttaaaccacgtctggggaactaacgtgtatgtggaagaccgcacggtcgatgtccacattcgtcgcctgcgtaaagcactggagcccggcgggcatgaccgcatggtgcagaccgtgcgcggtacaggatatcgtttttcaacccgcttttaacgccttg

SEQ ID NO: 8310 - protein, 229 aa, Escherichia coli K12
MARRILVVEDEAPIREMVCFVLEQNGFQPVEAEDYDSAVNQLNEPWPDLILLDWMLPGGSGIQFIKHLKRESMTRDIPVVMLTARGEEEDRVRGLETGADDYITKPFSPKELVARIKAVMRRISPMAVEEVIEMQGLSLDPTSHRVMAGEEPLEMGPTEFKLLHFFMTHPERVYSREQLLNHVWGTNVYVEDRTVDVHIRRLRKALEPGGHDRMVQTVRGTGYRFSTRF

SEQ ID NO: 8311 - DNA, 690 bp, Pseudomonas aeruginosa
  CDS (1)..(690)
atggttggcaagacaatcctcatcgttgatgacgaagcaccgattcgcgagatgatcgccgtggccctggagatggccggctacgagtgcctggaggcggaaaatacccagcaggcgcacgcggtgatcgtcgaccgcaagccggacctgatcctgctcgactggatgctccccggcacttccggcatcgaactggcgcgacgcctgaagcgtgacgaactgaccgtcgacatcccgatcatcatgctcaccgccaagggcgaggaggacaacaagatccagggcctggaggtcggcgccgacgactacatcaccaagccgttctcgccccgcgagctggtcgcccgcctgaaggccgtgctgcgccgcaccgggcctggcgacagcgaggcgccgatcgaggtcggcggcctgctgctggacccgatcagccaccgcgtgaccatcgacggcaagccggccgagatgggccccaccgagtaccgcctgctgcagttcttcatgactcaccaggaacgcgcctatacccgcggccaactgctggaccaggtctggggcggcaacgtctatgtcgaggagcgcaccgtcgacgtgcatatccgccgcctgcgcaaggcgctcggcgaggtctacgaaaatctggttcagactgtccgcgggaccggctatcgtttctccaccaagagctga

SEQ ID NO: 8312 - protein, 229 aa, Pseudomonas aeruginosa
MVGKTILIVDDEAPIREMIAVAVEMAGYECLEAENTQQAHAVIVDRKPHLILLDWMLPGTSGIELARRLKRDELTLDIPIIMLTAKGEEDNKIQGLEAGADDYITKPFSPRELVARLKAVLRRTGPGHSEAPIEVGGLLLDPISHRVTIDGKPAEMGPTEYGLLQFFMTHQERAYTRGQRRDQVWGGNVYVEERTVDMDIRRLRKALGEVYENLVQTVRGTGYRFSTKS

SEQ ID NO: 8313 - DNA, 699 bp, Sinorhizobium meliloti
  CDS (1)..(699)
atggcggaacgggtcttgattgttgacgacgacacgcgcctgtccgccatgctctccgactatctctccggaaatggctacaccgttcataccgcggcgaccgccacggcgggcatcgccgaactcgggcaccgcacccctgacgtcgtcatcctcgacgtcatgctgccggatttcgacggcttcgagacctgccgacgcatacgcgcggtctcggacgtccccgtcttgatgctcacggctaaaggcgaggagacggaccgcatcgtcgggctggagctcggggccgacgactatctgcccaagcccttcaatccgcgcgagcttctggcgcggctgaaggcgatcctgcgccgccgaaacggcagcgccgcggttgcgcggacccttcgcttcggacggctcgagatcgatcccggttcccgctccgtcaggatcgacggccgcgagtgtacgctgaccagctaccagttcgatgtgcttgtggcgctcgccgaaaatcccggccgcacgctctcgcgcgaacagttgatggatgcagtcaagggcgaggagctggatgctttcgaccgctcgatcgacgtccatatttcgcgcatcagggcggccatcgagagcgatcccaagcatccgaggcgcatcattaccgtgcgcggcgccggctatgtcttcgcccgctatcaggacgatacgagatag

SEQ ID NO: 8314 - protein, 232 aa, Sinorhizobium meliloti
MAERVLIVDDDTRLSAMLSDYLSGNGYTVHTAATATAGIAELGHRTPDVVILDVMLPDFDGFETCRRIRAVSDVPVLMLTAKGEETDRIVGLELGADDYLPKPFNPRELLARLKAILRRRNGSAAVARTLRFGRLEIDPGSRSVRIDGRECTLTSYQFDVLVALAENPGRTLSREQLMDAVKGEELDAFDRSIDVHISRIRAAIESDPKHPRRIITVRGAGYVFARYQDDTR

SEQ ID NO: 8315 - DNA, 687 bp, Clostridium acetobutylicum
  CDS (1)..(687)
atggatagttcattagctaaggttttaatagtggatgatgatgaaaatatatgtgaagtaataaaattatatcttgaaagcagtgggtatgctacaaaaatatccaatgatggaaaaagcgcacagaatgtgtttgtagagtataaacctgatattgttttacttgatataatgcttccacaagaagatggtatagatgttttaaagtggataagaaaagcggacaatacgcctgttataatgcttacagctaaaggagaaacttttgataaggttttaacattagaacttggagcagatgattacatagtgaaaccatttgaaccaaaagaattagtagcaagagttaaagcagtcttaagaagagctaattctgaaaatgtatcaagccaagtattgaattttaatggacttaaaatagatatgggttcatatacagtaatatataatgaaaaagatatcaagatgccacctaaggagttcgaacttctctattatcttgcgaataacaagaacaaggtctttacacgtgaacaattgctttgtgaagtatggggatatgattacccaggcgattcaagaacagtggatgtgcatgttaaaaggcttagagaaaaacttcatgaaggtaatggatgggatattcaaactgtttggggtgttggatataaatttgaggtgaaataa

SEQ ID NO: 8316 - protein, 228 aa, Clostridium acetobutylicum
MDSSLAKVLIVDDDENICEVIKLYLESSGYATKISNDGKSAQNVFVEYKPDIVLLDIMLPQEDGIDVLKWIRKADNTPVIMLTAKGETFDKVLTLELGADDYIVKPFEPKELVARVKAVLRRANSENVSSQVLNFNGLKIDMGSYTVIYNEKDIKMPPKEFELLYYLANNKNKVFTREQLLCEVWGYDYPGDSRTVDVHVKRLREKLHEGNGWDIQTVWGVGYKFEVK

SEQ ID NO: 8317 - DNA, 768 bp, Brucella melitensis
  CDS (1)..(768)
atgagtgtacggcatggcggcacgcggtcgataggggctggtatcctgcgctcgcctgaaatctcgagagggaaagattgcatgtcccaagtaccccgaattgctgtggttgaagacgaagaagcactgagcgtgctgctgcgctataatctcgaagctgagggctatcaggtcgatacgatgttgcgcggggatgaagccgaaatcgcgctgcgtgaaagcgtgcccgatcttctgatcctggactggatgctgccgggcgtctccggcatcgagctttgccgccgcctgcggcaaagaccggaaacggaacgcctgccgatcatcatgctgacggcgcgcggcgaggagagcgagcgtgtacggggcctgagtgtcggcgcggatgattatgtggtgaagcctttctccacgccggagctgcttgcccgcgtcaaggcgatgctgcgccgcgcgaaccccagcatcctgtcccatgtgctgaaggtcggcgaccttttgctggaccgccagcagcaccgcgtctatcggaaggaaaaggaagtccaccttggcccgacggaattccgtctgctcgaatatttcatgatgtcgccgggccgcgttttctcgcgcagccagcttctggatggtgtctgggggccggatatctacgtcgatgaccgcacggtagacgtccatgtgggccgtctgcgcaaggccatcaatgtcggccgcgccgccgattcgatccgcaccgtacgcggcgcgggatattcgttcggctga

SEQ ID NO: 8318 - protein, 255 aa, Brucella melitensis
MSVRHGGTRSIGAGILRSPEISRGKDCMSQVPRIAVVEDEEALSVLLRYNLEAEGYQVDTMLRGDEAEIALRESVPDLLILDWMLPGVSGIELCRRLRQRPETERLPIIMLTARGEESERVRGLSVGADDYVVKPFSTPELLARVKAMLRRANPSILSHVLKVGDLLLDRQQHRVYRKEKEVHLGPTEFRLLEYFMMSPGRVFSRSQLLDGVWGPDIYVDDRTVDVHVGRLRKAINVGRAADSIRTVRGAGYSFG

SEQ ID NO: 8319 - DNA, 690 bp, Salmonella enterica subsp. enterica serovar Typhi
  CDS (1)..(690)
atggcgagacgtattctggtcgtagaagatgaggcgccgatccgtgaaatggtgtgcttcgtgctcgaacaaaatggctttcagcccgtagaagccgaagattatgacagtgcggtgaataaacttaatgaaccctggccggatctcatccttcttgactggatgttgcccggcgggtcagggttacagtttattaaacatctcaaacgtgaagccatgacccgggatattcctgtggttatgctgaccgcaagaggtgaggaagaagatcgtgtgcgcgggctggaaaccggcgctgacgattacattaccaagccgttttcccccaaggagttggtggcgcgcattaaagccgttatgcggcgcatctcgccgatggcggtcgaagaggtgatcgagatgcagggactgagccttgatcccggctctcaccgcgtgatgaccggcgacagcccgctggatatggggccgaccgaatttaaattactccatttctttatgacgcacccggaacgggtttacagtcgcgagcagctactcaatcatgtctggggcaccaatgtgtacgttgaagaccggacggtcgacgtgcatattcgccgtttgcgtaaggcgctggagcacagcggccacgaccggatggtgcaaacggtacgcgggacagggtatcgtttttcgacccgcttttaa

SEQ ID NO: 8320 - protein, 229 aa, Salmonella enterica subsp. enterica serovar Typhi
MARRILVVEDEAPIREMVCFVLEQNGFQPVEAEDYDSAVNKLNEPWPDLILLDWMLPGGSGLQFIKHLKREAMTRDIPVVMLTARGEEEDRVRGLETGADDYITKPFSPKELVARIKAVMRRISPMAVEEVIEMQGLSLDPGSHRVMTGDSPLDMGPTEFKLLHFFMTHPERVYSREQLLNHVWGTNVYVEDRTVDVHIRRLRKALEHSGHDRMVQTVRGTGYRFSTRF

SEQ ID NO: 8321 - DNA, 714 bp, Listeria innocua
  CDS (1)..(714)
atggcagaaaagaaaattcttgtagtagatgacgaaaaaccgattgcggatatagttaagtttaatctaaataaagaaggctttgatgtatattgcgcctatgatggcgatgaagcgttagaacttgtagaagaagttcagccagatttaattttactggatattatgcttccaggtcgtgatggtattgaggtatgtcgtgaagtacgtaaaaaatatgatatgccaataattatggtaacagcgaaagattcagagattgacaaagttatcggactagaacttggtgcagatgactacgtaacgaaaccatttagtaatcgcgagttaattgctcgagtgaaagccaatttgcgccgtcacagccaagtcagctcaaatgcagccgaggaagaagaaaacagcgaactagaaattggttctttgattattcatccggatgcatatgtggcttctaaacgtggagaaacaatcgaactaacacatcgtgaattcgaattactacattatttagcaaaacatatgggacaagtcatgacacgtgaacatttacttcaaaccgtttggggctatgactacttcggcgatgttcgtacggtggatgttaccgttcgtcgtttacgtgagaaaattgaagataacccaagtcacccagcatggttagtaactagacgcggagttggctattatttacgcaatccagaacaagaatga

SEQ ID NO: 8322 - protein, 237 aa, Listeria innocua
MAEKKILVVDDEKPIADIVKFNLNKEGFDVYCAYDGDEALELVEEVQPDLILLDIMLPGRDGIEVCREVRKKYDMPIIMVTAKDSEIDKVIGLELGADDYVTKPFSNRELIARVKANLRRHSQVSSNAAEEEENSELEIGSLIIHPDAYVASKRGETIELTHREFELLHYLAKHMGQVMTREHLLQTVWGYDYFGDVRTVDVTVRRLREKIEDNPSHPAWLVTRRGVGYYLRNPEQE

SEQ ID NO: 8323 - DNA, 717 bp, Listeria innocua
  CDS (1)..(717)
atgagtgaacaagttagagtgcttgttgtggatgatgaggaccggatacgccgccttcttaagatgtatcttgaaagagaaaactatcgtattgaagaagctagtgatggtgatcaagcattaaacatggcactgaacaacaattatgaagtgatcctgcttgatttaatgatgccaggtaaagatggtatcgaagtttgtcgtgaattaagggaatataaatctacaccagttgttatgttgactgcaaaaggagaagaagctaaccgtgtgcaaggctttgaagtgggagcagatgattacatcgttaaaccattcagccctcgggaagtagtgctacgcgttaaagctgttcttcgtcgtgcaaaacaatcatctgaagaagctgctggaggtacaccaggagacattattacattcccacatttgaaaattgataatgaagctcatcgtgttattgtagatggaaaagaaattggcctaacaccgaaagaatatgatttactttattatttagctaaatctccagataaagttttcgaccgtgaatcacttttaaaagaagtgtggcgttatgaattctttggtgatttacgtacaattgatacgcacgtaaaacgccttcgtgaaaaactacatgatgtatctgaagacgctgctagaatgattgttacagtatggggccttggctataaattcgaagttccagaagattaa

SEQ ID NO: 8324 - protein, 238 aa, Listeria innocua
MSEQVRVLVVDDEDRIRRLLKMYLERENYRIEEASDGDQALNMALNNNYEVILLDLMMPGKDGIEVCRELREYKSTPVVMLTAKGEEANRVQGFEVGADDYIVKPFSPREVVLRVKAVLRRAKQSSEEAAGGTPGDIITFPHLKIDNEAHRVIVDGKEIGLTPKEYDLLYYLAKSPDKVFDRESLLKEVWRYEFFGDLRTIDTHVKRLREKLHDVSEDAARMIVTVWGLGYKFEVPED

SEQ ID NO: 8325 - DNA, 711 bp, Listeria innocua
  CDS (1)..(711)
atggtaaaaattcttgtagttgatgatgaggcttctattgttaccttgttgcaatttaatattgaaaaagctgggtttgatgtagtcacagctgaagatggtagaactgggtacgaacttgctctatcggaaaaaccagatttaattgtacttgatttaatgcttcctgaaatggacggaattgaagtaacgaaaaaactccgccaagataaagttggagttccaatactaatgttaactgccaaagatgaagaactagataagatcattggtttagagttaggtgcagacgattatatgacaaagccgtttagccctagagaagttgtcgcaaggattaaagccattttaagacggacagaaggcaaggccgaagttaccgaagaaaaaacggaagatacagaagcgactattttaattggtgatttgaaaattttaccggatagttatgaagtatatttgcaagatgatttattagatttaacgccgaaagaatttgagctgctcttattcctagccaatcatcgcggcaaagttttttcgagagatcaattgcttgatacggtttggaattatgattatgtaggtgaaacgcggattgtagatgttcacgttagccatttacgcgataaaattgaactagatactaaacaaccgaaatacattaaaacaatacgtggattcggttataaaatggagaatgtaaaataa

SEQ ID NO: 8326 - protein, 236 aa, Listeria innocua
MVKILVVDDEASIVTLLQFNIEKAGFDVVTAEDGRTGYELALSEKPDLIVLDLMLPEMDGIEVTKKLRQDKVGVPILMLTAKDEELDKIIGLELGADDYMTKPFSPREVVARIKAILRRTEGKAEVTEEKTEDTEATILIGDLKILPDSYEVYLQDDLLDLTPKEFELLLFLANHRGKVFSRDQLLDTVWNYDYVGETRIVDVHVSHLRDKIELDTKQPKYIKTIRGFGYKMENVK

SEQ ID NO: 8327 - DNA, 687 bp, Nostoc sp. PCC 7120
  CDS (1)..(687)
atgacaacacacattcttttggttgaagatgaagttaaattagcgcgatttgtcgaattggaactaagtagtgaaggttacaaagttagtgtcgctcatgatggaattactggactaaccttggcgcgagagtcaacacccgatttagcggttcttgattggatgttaccaggactatcaggtttagaaatttgtcgccgtctgcgagcaacgggtaattcaatacctgtaattttgttaactgccagagacgaagtgagcgatcgcgtggcaggattagatgcaggagctgatgattatgtagtcaaacccttcagtattgaggaattattagcaagaattcgcgcccatctgcgccgcactcaagaaacagatgaagacttgttgcagtttgaagacctaagtttaaatcgccgcactcgtgaagtgtttcgaggtaaccgagcggttgaattaacagcaaaagagtttgatttattagagtatcttctttcctatccccgtcaggtttttaccagagatcaaattctcgaaaaagtttggggttatgattttatgggagattccaacatcatcgaggtttatatccgttatttgcggcttaaattggaagaaaataacgaaaagcggctggttcatacagtacgtggcgtaggatatgcactacgggagtatcccaacaaataa

SEQ ID NO: 8328 - protein, 228 aa, Nostoc sp. PCC 7120
MTTHILLVEDEVKLARFVELELSSEGYKVSVAHDGITGLTLARESTPDLAVLDWMLPGLSGLEICRRLRATGNSIPVILLTARDEVSDRVAGLDAGADDYVVKPFSIEELLARIRAHLRRTQETDEDLLQFEDLSLNRRTREVFRGNRAVELTAKEFDLLEYLLSYPRQVFTRDQILEKVWGYDFMGDSNIIEVYIRYLRLKLEENNEKRLVHTVRGVGYALREYPNK

SEQ ID NO: 8329 - DNA, 729 bp, Nostoc sp. PCC 7120
  CDS (1)..(729)
atggaaagtcataaagaaaaaatcctggtagtagacgacgaagctagcattcgccgaattttagaaacgcgcctttcaatgattggctacgatgtagtcacagcaggggatggcgaagaagctttagacacattccgcaaatctgaccccgatttagtggttttggatgtaatgatgccaaaactagatggttacggtgtttgtcaagaactacgtaaagaatcggatgtccccataattatgctaacagccttaggggacgttgccgatcgcatcactggtctagagttaggtgctgatgactacgtagttaaaccattttcacccaaagaactagaagcaagaattcgctcagtattacgacgggtagataaaactggtgcctctggtattcccagttctggagtgattcacgttggcaatatcaaaattgataccaacaagcgccaagtttacaaaggcgatgagcgtatccgcttgacaggtatggaattcagtttactagagttgctagtcagccgttctggagaagctttttcccgttcggaaattttacaagaagtctggggttatactcccgaacgccatgtagatacccgcgtggtggatgtgcatatctcccgcttacgggcaaaattagaagatgaccccagcaacccagaattaattctcacagcaaggggtactggttatttgtttcaacgcataattgagccaggagaagaatag

SEQ ID NO: 8330 - protein, 242 aa, Nostoc sp. PCC 7120
MESHKEKILVVDDEASIRRILETRLSMIGYDVVTAGDGEEALDTFRKSDPDLVVLDVMMPKLDGYGVCQELRKESDVPIIMLTALGDVADRITGLELGADDYVVKPFSPKELEARIRSVLRRVDKTGASGIPSSGVIHVGNIKIDTNKRQVYKGDERIRLTGMEFSLLELLVSRSGEAFSRSEILQEVWGYTPERHVDTRVVDVHISRLRAKLEDDPSNPELILTARGTGYLFQRIIEPGEE

SEQ ID NO: 8331 - DNA, 762 bp, Nostoc sp. PCC 7120
  CDS (1)..(762)
atgatatcaatgtacaccagtgaatcgatcaagtattcggctagaacagagattggacaaaccagtcggattctggtagtggaagatgaagaactcatccaagaaatgctagcagtagcactggaagaggaaggttatggggtagtaacggctgctgatggcaggtcagctgtagagtatctcaaaagttttgacccaaacggaggagattttccctttgatttggtgattctcgatttgatgttaccccaaattaatggcttagatatctgccgtttgttgcgtcatcaaggcaacccagtaccgattttgatgctcagtgccaaaggtagtgaaaccgatcgcgtgttaggtttagaagtaggggcagatgactatttaactaaaccctttagtatgcgggagttggtggcacgttgtcgcgctttactccgtcgtcagcgtctcatcactttaccccaattacctgtactgaaattcaaagatgtgactttaaatcctcaagagtgtcgggtcttggtacgaggacaagaggtaaatctttcacccaaagagtttcgcttgttggaactgttcatgagttacgcccgtcgagtatggtcacgggaacagttgctagaccaggtttgggggccggattttgtcggcgatagcaaaacagtggatgttcacattcgttggttgcgagagaaattggaacaagaccccagtcacccagaatatattgtgactgtaagaggatttggatatcgattcggataa

SEQ ID NO: 8332 - protein, 253 aa, Nostoc sp. PCC 7120
MISMYTSESIKYSARTEIGQTSRILVVEDEELIQEMLAVALEEEGYGVVTAADGRSAVEYLKSFDPNGGDFPFDLVILDLMLPQINGLDICRLLRHQGNPVPILMLSAKGSETDRVLGLEVGADDYLTKPFSMRELVARCRALLRRQRLITLPQLPVLKFKDVTLNPQECRVLVRGQEVNLSPKEFRLLELFMSYARRVWSREQLLDQVWGPDFVGDSKTVDVHIRWLREKLEQDPSHPEYIVTVRGFGYRFG

SEQ ID NO: 8333 - DNA, 717 bp, Nostoc sp. PCC 7120
  CDS (1)..(717)
atggacattctaattgttgaggatgaatcagaaattgctcagttaattcaacattctttagaaaaagagggcttttcctgtcggactagccgcgatgggatcaatgctctacaaatgtttcacgaacgaccaccagatttaatcatcctagacctgatgattcctgggctggatgggttggaagtttgcgcgagaattcgccagaaacctggggcaaaagacccttatatactaatgctcacagctaaaggtgaggaaatagaccgggtaatcggcttgtctacgggtgctgatgactatatggttaaacccttcagccctagagagttggtggcgcgtgtcagggcgcttctacggcgcagcttacgtcaagggggacaaaatcaggtaaatcggactcaacactttatagtagatttagaccaacgaactgccagtcgtcaaatagattcccatcaaccagaagctttagatttaaccactttagaatttaatttattaagcacttttgtcagcaatcctgggcgagtgtggaaccgtacccaactaattgacaaattgtggggagataatttttttggtgatgagcgtgttgtagatactcatgtagctaggctcaggaaaaaaattgaacctgatcccaccaatcccagttttattaaaactgttgtcggagttggctataaatttgaagactctcctgtaatttccgcatga

SEQ ID NO: 8334 - protein, 238 aa, Nostoc sp. PCC 7120
MDILIVEDESEIAQLIQHSLEKEGFSCRTSRDGINALQMFHERPPDLIILDLMIPGLDGLEVCARIRQKPGAKDPYILMLTAKGEEIDRVIGLSTGADDYMVKPFSPRELVARVRALLRRSLRQGGQNQVNRTQHFIVDLDQRTASRQIDSHQPEALDLTTLEFNLLSTFVSNPGRVWNRTQLIDKLWGDNFFGDERVVDTHVARLRKKIEPDPTNPSFIKTVVGVGYKFEDSPVISA

SEQ ID NO: 8335 - DNA, 723 bp, Salmonella enterica subsp. enterica serovar Typhi
  CDS (1)..(723)
atgactgaattacccattgatgaaaacacgccgcgcattttgattgttgaagatgaacccaagctgggacagctgcttattgactacttacgcgcggcgagttacgcccccacgctcatcaatcatggcgacaaggtactgccgtatgtgcgtcaaacgccgccggatctgatcctgctggatctgatgctgccgggtatcgatggtctgacgctatgccgggagattcgccgtttttccgacatccccattgtgatggtcacggccaaaattgaagagatcgaccggctgcttgggctggaaatcggcgccgatgattatatctgtaagccttacagcccacgcgaagtcgtggcccgcgtgaaaaccattttgcgccgctgtaaaccgcagcgcgaactccagcagcaggatgccgaaagcccgttaatgattgatgaaagccgctttcaggcctcctggtgtggtaaagcgctggatttaacccccgctgaattccgtctgctaaaaaccttatcgcttgaaccgggtaaagttttttcccgcgagcagttgttaaaccacctctacgacgactaccgtgtggtgaccgatcgtactatcgacagccacattaaaaacctgcgccgtaaactggaatcgctggatgccgaacagtcatttatacgcgcggtctacggggtgggatatcgctgggaagcggatgcgtgtcgcctggtataa

SEQ ID NO: 8336 - protein, 240 aa, Salmonella enterica subsp. enterica serovar Typhi
MTELPIDENTPRILIVEDEPKLGQLLIDYLRAASYAPTLINHGDKVLPYVRQTPPDLILLDLMLPGIDGLTLCREIRRFSDIPIVMVTAKIEEIDRLLGLEIGADDYICKPYSPREVVARVKTILRRCKPQRELQQQDAESPLMIDESRFQASWCGKALDLTPAEFRLLKTLSLEPGKVFSREQLLNHLYDDYRVVTDRTIDSHIKNLRRKLESLDAEQSFIRAVYGVGYRWEADACRLV

SEQ ID NO: 8337 - DNA, 708 bp, Staphylococcus aureus
  CDS (1)..(708)
atgcaaatggctagaaaagttgttgtagttgatgatgaaaaaccgattgctgatattttagaatttaacttaaaaaaagaaggatacgatgtttactgtgcatacgatggtaatgatgcagtcgacttaatttatgaagaagaaccagacatcgtattattagatatcatgttacctggtcgtgatggtatggaagtatgtcgtgaagtgcgcaaaaaatacgaaatgccaattataatgcttactgctaaagattcagaaattgataaagtgcttggtttagaactaggtgcagatgactatgtaacgaaaccgtttagtacgcgtgaattaatcgcacgtgtgaaagcgaacttacgtcgtcattactcacaaccagcacaagacactggaaatgtaacgaatgaaatcacaattaaagatattgtgatttatccagacgcatattctattaaaaaacgtggcgaagatattgaattaacacatcgtgaatttgaattgttccactatttatcaaaacatatgggacaagtaatgacacgtgaacatttattacaaacagtatggggctatgattactttggcgatgtacgtacggtcgatgtaacgattcgtcgtttacgtgaaaagattgaagatgatccgtcacatcctgaatacattgtgacgcgtagaggcgttggatatttcctccaacaacatgagtag

SEQ ID NO: 8338 - protein, 235 aa, Staphylococcus aureus
MQMARKVVVVDDEKPIADILEFNLKKEGYDVYCAYDGNDAVDLIYEEEPDIVLLDIMLPGRDGMEVCREVRKKYEMPIIMLTAKDSEIDKVLGLELGADDYVTKPFSTRELIARVKANLRRHYSQPAQDTGNVTNEITIKDIVIYPDAYSIKKRGEDIELTHREFELFHYLSKHMGQVMTREHLLQTVWGYDYFGDVRTVDVTIRRLREKIEDDPSHPEYIVTRRGVGYFLQQHE

SEQ ID NO: 8339 - DNA, 675 bp, Clostridium acetobutylicum
  CDS (1)..(675)
atgtctgagagtattcttatagttgaagatgaagatagaatgagagagctcataaaagcctatttaagaagagagggatacagtgtacttgaagcggcggatgggaaagaggcactagagatgtttgacagaaattcaatttcgcttgtcattttagatataatgctgcctcttttggatggatggactgtatgcacaaatataagagagaagtcagaggttccaataataatgttaacagctaagagtgaagaggatgataaacttttaggatatgagcttggtgcagatgactatgttactaaaccatgtagtccaaaggtacttactgctaaggttaaagttctattaaaaagaattcagccaaatgaaaagtctaaggttcaaaattttgatgggctcaagatagacgctatttctcatgaggttactattgaagataaggaaatttatctttctccaaaagagtatgatcttttaatatatttttctaataataaaggtataacgcttacgagagataagattttagataatgtttggggagaagattattatggggatcttagaacagtagatactcatgtgaaaaggcttagagaaaaactacaagataaggcatatttagtagcaacagtaagaggaagcggatacaaatttgaggtgaaaaaatga

SEQ ID NO: 8340 - protein, 224 aa, Clostridium acetobutylicum
MSESILIVEDEDRMRELIKAYLRREGYSVLEAADGKEALEMFDRNSISLVILDIMLPLLDGWTVCTNIREKSEVPIIMLTAKSEEDDKLLGYELGADDYVTKPCSPKVLTAKVKVLLKRIQPNEKSKVQNFDGLKIDAISHEVTIEDKEIYLSPKEYDLLIYFSNNKGITLTRDKILDNVWGEDYYGDLRTVDTHVKRLREKLQDKAYLVATVRGSGYKFEVKK

SEQ ID NO: 8341 - DNA, 756 bp, Streptococcus pneumoniae
  CDS (1)..(756)
atgtgtcttctgactattttttggtataatagtagagaaaaaggtgaacatatgaaaaaaatactaattgtagatgatgagaaaccaatctcggatattatcaagtttaatatgaccaaggaaggttatgaagttgtaactgcttttaatggtcgtgaagcgctagagcaatttgaagcagagcaaccagatattattattctggatttgatgcttccagaaattgatggtttagaagttgctaagaccattcgtaagacaagcagtgtgcccattcttatgctttcagccaaagatagtgaatttgataaggttatcggtttggaacttggggcagatgactatgtaacgaaacccttctccaatcgtgagttgcaggcgcgtgttaaagctcttctgcgtcgttctcaacctatgccagtagatggtcaggaagcagatagtaaacctcaacctatccaaattggggatttagaaattgttccagacgcctacgtggctaaaaaatatggcgaagaactagacttaacccatcgtgaatttgagcttttgtatcatttagcatcgcatacaggtcaagtcatcacgcgcgaacacttgcttgagactgtctggggttatgactattttggtgatgtccgcacagttgatgtgactgtacgacgtctgcgtgagaagattgaagatacgcccagccgaccagagtatatcttgacgcgccgtggtgtagggtattacatgagaaataatgcttga

SEQ ID NO: 8342 - protein, 251 aa, Streptococcus pneumoniae
MCLLTIFWYNSREKGEHMKKILIVDDEKPISDIIKFNMTKEGYEVVTAFNGREALEQFEAEQPDIIILDLMLPEIDGLEVAKTIRKTSSVPILMLSAKDSEFDKVIGLELGADDYVTKPFSNRELQARVKALLRRSQPMPVDGQEADSKPQPIQIGDLEIVPDAYVAKKYGEELDLTHREFELLYHLASHTGQVITREHLLETVWGYDYFGDVRTVDVTVRRLREKIEDTPSRPEYILTRRGVGYYMRNNA

SEQ ID NO: 8343 - DNA, 690 bp, Pseudomonas aeruginosa; identical to SEQ ID NO: 8311
  CDS (1)..(690)

SEQ ID NO: 8344 - protein, 229 aa, Pseudomonas aeruginosa
MVGKTILIVDDEAPIREMIAVALEMAGYECLEAENTQQAHAVIVDRKPDLILLDWMLPGTSGIELARRLKRDELTVDIPIIMLTAKGEEDNKIQGLEVGADDYITKPFSPRELVARLKAVLRRTGPGDSEAPIEVGGLLLDPISHRVTIDGKPAEMGPTEYRLLQFFMTHQERAYTRGQLLDQVWGGNVYVEERTVDVHIRRLRKALGEVYENLVQTVRGTGYRFSTKS

SEQ ID NO: 8345 - DNA, 711 bp, Bacillus halodurans
  CDS (1)..(711)
atggaaaataaaaaaattctagttgttgacgacgaaaagccaattgcagatatactgaaattcaatttagaaaaagaagggtttaccgtcatatgtgcctatgatggagctgaagctgtggaacaggtgaatcaggaaaagccggatttaattttgctagatatcatgctaccgaataaagacggtatggaagtgtgccgagaggttcgtaagcaatttgagatgccgatcatcatgctgaccgcaaaagactcggaaatcgataaagtgttaggccttgaattaggggccgatgactacgtgacaaagccatttagtacccgagagctattagcgagagtgaaggcgaatttgcgtcgtcaccaaacatctggcgacgatcaactctcgtataaggaaatctcagtcggagatttatcgatccacccagaggcctatctcgtgaaaaaacgcggagaatccatcgaactcactcatcgagaatttgagcttatacattacttagccaagcatctaggccaagtgatgacccgtgagcacctgctgcaggctgtatggggctatgattacttcggagatgtccgcacagtcgatgtcaccgttcgtcgcctcagagagaaagtagaggacaatcctagctatccaacgtggattattacacgccgtggagtcgggtactatttgcgtcaccctgagcaggagaatgcttaa

SEQ ID NO: 8346 - protein, 236 aa, Bacillus halodurans
MENKKILVVDDEKPIADILKFNLEKEGFTVICAYDGAEAVEQVNQEKPDLILLDIMLPNKDGMEVCREVRKQFEMPIIMLTAKDSEIDKVLGLELGADDYVTKPFSTRELLARVKANLRRHQTSGDDQLSYKEISVGDLSIHPEAYLVKKRGESIELTHREFELIHYLAKHLGQVMTREHLLQAVWGYDYFGDVRTVDVTVRRLREKVEDNPSYPTWIITRRGVGYYLRHPEQENA

SEQ ID NO: 8347 - DNA, 744 bp, Thermotoga maritima
  CDS (1)..(744)
atgtaccccctcgggggatcgaagatggcgaaaaagaagattctggtggttgacgacgacccggcaattcttgagctggtaggatataacctttccaaggaaggatacgaggtgctcaaggcttatgatggagaggaagcactcaaaattgccaacgacgaagacgtggacatgttcatagtggatatcatgcttcctggaatcgacggcttcgagctggtcaggaagatcagatccatggagaaatacaagaacacccccgtgatcttcctgagcgcaaagggagaagaattcgacaaggtgcttgggctggagctcggtgcggacgactacatcaccaagccgttcagcgtgagagagcttcttgcgagggtgaaggctatattcagaaggctttccaccgctactcagagcaaggaagaaaggcctaagaagatcatagccaaggatcttgaaatcgatgtggaaaagtacgaagtgaaagtgagagggaaaaaagtgaacctcactcctctcgaatttgaactgctccgattcctcgcggaaaacgaaggaaaagttttcagcagggatgttcttctggacaaactctggggatacgattactacggagatacgagaactgtagatgttcacataagaaggctgagaacgaagatagaagaagatccttcgaatccgaaatacataatcactgtgagaggaaagggatacaaattcagagaccccggaaaggaagactga

SEQ ID NO: 8348 - protein, 247 aa, Thermotoga maritima
MYPLGGSKMAKKKILVVDDDPAILELVGYNLSKEGYEVLKAYDGEEALKIANDEDVDMFIVDIMLPGIDGFELVRKIRSMEKYKNTPVIFLSAKGEEFDKVLGLELGADDYITKPFSVRELLARVKAIFRRLSTATQSKEERPKKIIAKDLEIDVEKYEVKVRGKKVNLTPLEFELLRFLAENEGKVFSRDVLLDKLWGYDYYGDTRTVDVHIRRLRTKIEEDPSNPKYIITVRGKGYKFRDPGKED

SEQ ID NO: 8349 - DNA, 717 bp, Bacillus halodurans
  CDS (1)..(717)
atggaaaaagaagcaaaaattttagtcgttgatgatgaagatcgtattcgtaacttattgaaaatgtaccttgagcgagaagcctatgatgtggaagaggcatcagacggaaaggaagcgctcgaaaaagcgcttgcattcgattatgatgtcattttacttgacctcatgatgcctgaaatggatggaattgaagtgtgtcaaaagcttcgcaaacaaaaagcaacgccgatcattatgcttacagcaaaaggagaagaagccaaccgcgttcaagggtttgaagtcggaacggatgactatattgtgaagccattcagtccgcgtgaggtggtcctacgtgtaaaagcgttattgcgtcgctcgtcttcaacgaagtttttacagacggatacgcaagcgaaagatgtgctcgtttttccgcatttatctatcgacaatgatgcgcaccgggtaacggtggctgatcaagaaattaatttaacaccgaaagaatacgagcttctctattatttagcccagtcaccagataaagtcttttcaagggagcagctattgaaagatgtatggaactatgacttctttggggatttgcgcaccgtcgatacgcatattaaacgactgcgtgagaaattaaaccgagtgtccccacaggcggccagtatgatttcgactgtttggggagtgggctacaaatttgaggtcgtgaaagagtaa

SEQ ID NO: 8350 - protein, 238 aa, Bacillus halodurans
MEKEAKILVVDDEDRIRNLLKMYLEREAYDVEEASDGKEALEKALAFDYDVILLDLMMPEMDGIEVCQKLRKQKATPIIMLTAKGEEANRVQGFEVGTDDYIVKPFSPREVVLRVKALLRRSSSTKFLQTDTQAKDVLVFPHLSIDNDAHRVTVADQEINLTPKEYELLYYLAQSPDKVFSREQLLKDVWNYDFFGDLRTVDTHIKRLREKLNRVSPQAASMISTVWGVGYKFEVVKE

SEQ ID NO: 8351 - DNA, 726 bp, Staphylococcus aureus
  CDS (1)..(726)
atgtcgaacgaaatacttatcgtagatgatgaggatagaatcagaaggttacttaaaatgtatttagaaagagaatcttttgaaatccatgaggcaagtaatggccaagaggcttatgaacttgcaatggagaataattatgcttgcatactactagatttaatgttgcctgaaatggatggtatccaggtggcaactaaattgcgtgaacataaacaaacaccgattattatgttgactgctaaaggtgaagaaacaaaccgtgttgaaggttttgagtctggtgcagatgattatatcgtcaaaccattttcaccaagagaagtagtcttaagagttaaagcacttctaagaagaacgcaatctacaactgtagaacaaagcgaacctcacgcacgtgatgtgattgaatttaaacatttagaaatagataatgatgcacatcgcgtacttgctgataatcaagaagttaatttgactcctaaagagtacgaattattaatatatttagctaaaacaccaaataaagtatttgaccgtgaacaattattaaaagaagtttggcattatgaattctatggtgatttaagaacagttgatactcatgttaaacgacttagagaaaagttaaatcgtgtgtctagcgaagctgcgcatatgattcaaacagtctggggcgttgggtataaatttgaggttaaatctaatgatgagccggctaaatag

SEQ ID NO: 8352 - protein, 241 aa, Staphylococcus aureus
MSNEILIVDDEDRIRRLLKMYLERESFEIHEASNGQEAYELAMENNYACILLDLMLPEMDGIQVATKLREHKQTPIIMLTAKGEETNRVEGFESGADDYIVKPFSPREVVLRVKALLRRTQSTTVEQSEPHARDVIEFKHLEIDNDAHRVLADNQEVNLTPKEYELLIYLAKTPNKVFDREQLLKEVWHYEFYGDLRTVDTHVKRLREKLNRVSSEAAHMIQTVWGVGYKFEVKSNDEPAK

SEQ ID NO: 8353 - DNA, 687 bp, Aquifex aeolicus
  CDS (1)..(687)
atgaggaggaagatggaaaggatagctctaattgaggacgacaaggatttagcctttctcgtgaaactgaatttagaaagggaggggtttgaagtagagcactttgaacgtgccactcccttctttaagttcatttctgaaaacagtgtagaccttatcctcatagacattatgcttcccgacctagatggattcaggatagctaacttcttaaagagcagggcggatttaaaagaaattcccgttatattcataaccgcaaaaggggaggaagaggacaaactaaagggctttgaactgggagcggacgattacataactaaacccttttccatgaaagagttaatagcaagagtaagagccgttctaaagaggtataaaaaggtttccgagagcaaagttttaaagtacgagggcgttgagctggacacggaaagacaaaaacttttcgtggacggtagggaggtatacctgactcctgcggagtttaaaatcctgaaaaccttgatggaaaacttcggaagacctgtcagtcgttcgtccctcgttgaaaagctctgggattacgagagggaaaccacggagagggctatagacgttcacgtaaagcacataagagacaagctcggaaagtataagggtcttataaaaactgtgaggggtgtcggatacaagttcgaaaattaa

SEQ ID NO: 8354 - protein, 228 aa, Aquifex aeolicus
MRRKMERIALIEDDKDLAFLVKLNLEREGFEVEHFERATPFFKFISENSVDLILIDIMLPDLDGFRIANFLKSRADLKEIPVIFITAKGEEEDKLKGFELGADDYITKPFSMKELIARVRAVLKRYKKVSESKVLKYEGVELDTERQKLFVDGREVYLTPAEFKILKTLMENFGRPVSRSSLVEKLWDYERETTERAIDVHVKHIRDKLGKYKGLIKTVRGVGYKFEN

SEQ ID NO: 8355 - DNA, 720 bp, Bacillus halodurans
  CDS (1)..(720)
atgacacaaagattgttagtagtagacgatgaagaatcaattgtgacgttattgcaatttaatcttgaacagtcaggctacgaggtcgtgacagcaatggatggagcttctgggctacaactagctaagacgcaaacgttcgatcttattattttagacctcatgttacctgaaatggatggactcgatgtatgtaaacaactccgccaaagtaaagtgatgaccccgatccttatgctgactgcaaaagacgacgaatttgataaagttcttgggctggagctaggagccgatgattatatgacaaagcctttcagtccccgagaggttgtggcgagagtgcgcgccattttacggagagtgggacatgctcaaaataaccatgaagacaatagccgttccacttcaaccctatcattcggcaacgtggaaatttaccctgataattacgaagtctacttaaaaggtcagcctcttgagttaacaccaaaagaatttgaacttcttctttatttagcgaatcataaaggtcgagtgcttacgagggatcaactgctgaatgcggtttggaattatgaattcgttggtgatactcgaattgtggatgtacacattagtcatttaagagaaaagattgaaccaaatactaaaaagccgatttacattaaaacgattcgtggcttaggctataagctagaggagccgcagttgaatgactaa

SEQ ID NO: 8356 - protein, 239 aa, Bacillus halodurans
MTQRLLVVDDEESIVTLLQFNLEQSGYEVVTAMDGASGLQLAKTQTFDLIILDLMLPEMDGLDVCKQLRQSKVMTPILMLTAKDDEFDKVLGLELGADDYMTKPFSPREVVARVRAILRRVGHAQNNHEDNSRSTSTLSFGNVEIYPDNYEVYLKGQPLELTPKEFELLLYLANHKGRVLTRDQLLNAVWNYEFVGDTRIVDVHISHLREKIEPNTKKPIYIKTIRGLGYKLEEPQLND

SEQ ID NO: 8357 - DNA, 693 bp, Caulobacter crescentus
  CDS (1)..(693)
atgactccctacgttttggtggtcgaagacgaagacgctctggccactctgctccactacaacctcgacaaggagggctaccgcgtcggcgtcgccggcgacggtgaggaagccctgatcatggccaatgagcgggccccggacctggtcatcctcgactggatgctgcccaaggtctcgggcatcgaggtctgccgccgcctgcgcggccgcgccgagacgcgcaatgtgccgatcatcatgctgacggcccgcggcgaggaaactgatcgcatccgcggtctcgacaccggcgccgacgactatgtggtcaagccgttctcgatggtcgagctgaccgcccgggtccgcgccgtgctgcgccgcatccgcccgggtctggccgatgaccgcatcaccgtcggcgacatcatcatcgaccgcgtcgcccacagggtgaagcgcagcggcaaggagatccaccttggcccgaccgagttccgtctgctcgactacctgatgcagcacccgggccgggtgttcagccgcgagcagctgctggacgcggtctgggggtcggacgtctatgtcgaggcccgcacggtcgacgttcacatcggccgtcttcgcaaggcgctgaacgggacgacggacgccgatcccatccgcaccgtgcgttcggcgggctactcgctggacatggatgcggcctga

SEQ ID NO: 8358 - protein, 230 aa, Caulobacter crescentus
MTPYVLVVEDEDALATLLHYNLDKEGYRVGVAGDGEEALIMANERAPDLVILDWMLPKVSGIEVCRRLRGRAETRNVPIIMLTARGEETDRIRGLDTGADDYVVKPFSMVELTARVRAVLRRIRPGLADDRITVGDIIIDRVAHRVKRSGKEIHLGPTEFRLLDYLMQHPGRVFSREQLLDAVWGSDVYVEARTVDVHIGRLRKALNGTTDADPIRTVRSAGYSLDMDAA

SEQ ID NO: 8359 - DNA, 696 bp, Haemophilus influenzae
  CDS (1)..(696)
atgacgagaaaaattctgatagttgaagatgaatgtgcaatccgtgaaatgatcgcactgtttttatctcaaaaatactatgatgtgattgaagcgagcgatttcaaaacagcgataaacaagataaaagaaaatcctaaactaatattattggattggatgctacctggtcgttcaggtatacaatttatacagtatattaaaaagcaagaaagctatgctgcgattcccattattatgctcacagctaaaagtacagaagaagattgtattgcctgtttaaatgcaggggctgatgactacatcactaaacccttttcacctcaaattttattagctcgcattgaggcagtatggaggagaatttatgaacaacaaagtcaatttatacaaatcgatgaactttccattgatgaaaatgctcagagagtgtttttccaacagcaggaaattaatttaagtagtacagaatttaaattgttacatttttttatgaggcaccctgaaaaagtttattctagagaacaattgttaaatcgtatttggcataatgatctagaagttgaatatcgcactgttgatagctatattcgccgtttacgccgtaatttagccccttttcaatgtgaacattacatccaaacagttcgaggatctggttatcgattttctagttatttacgagataaacaatga

SEQ ID NO: 8360 - protein, 231 aa, Haemophilus influenzae
MTRKILIVEDECAIREMIALFLSQKYYDVIEASDFKTAINKIKENPKLILLDWMLPGRSGIQFIQYIKKQESYAAIPIIMLTAKSTEEDCIACLNAGADDYITKPFSPQILLARIEAVWRRIYEQQSQFIQIDELSIDENAQRVFFQQQEINLSSTEFKLLHFFMRHPEKVYSREQLLNRIWHNDLEVEYRTVDSYIRRLRRNLAPFQCEHYIQTVRGSGYRFSSYLRDKQ

SEQ ID NO: 8361 - DNA, 705 bp, Mycobacterium tuberculosis
  CDS (1)..(705)
atgcggcgcgccgatggccaaccggtcactgtgctggtggtcgacgacgaacccgttctggccgagatggtgtccatggcattgcggtatgaaggttggaacatcaccaccgccggtgacggatcgtcggcgattgcggcggcccgccgccagcggcccgatgtggttgtgctcgacgtgatgttgcctgacatgagcggtcttgacgtgctgcacaagttgcgcagcgagaatccaggcctgccggttctactgctgacggccaaggacgcggtggaagatcgtatagctgggttgaccgcggggggcgacgactacgtcaccaagccgtttagcatcgaggaggtcgtgcttcggctgcgggcgttactgcgtcgcacgggggtgacgacagtcgacagcggtgcccagctagtggtcggagacttggtgctggacgaagacagccacgaggtgatgcgcgccggcgaaccggtgtcgttgacgtccaccgagttcgagctgctgcggttcatgatgcacaactccaagcgggtgctgagcaaagcccagattctggaccgcgtctggagttacgacttcggcggccggtccaatatcgtggagctgtacatctcgtacctgcgcaaaaagatcgacaacggtcgcgaacccatgattcacacgctgcgcggcgccggctatgtgctcaagccggcccgctag

SEQ ID NO: 8362 - protein, 234 aa, Mycobacterium tuberculosis
MRRADGQPVTVLVVDDEPVLAEMVSMALRYEGWNITTAGDGSSAIAAARRQRPDVVVLDVMLPDMSGLDVLHKLRSENPGLPVLLLTAKDAVEDRIAGLTAGGDDYVTKPFSIEEVVLRLRALLRRTGVTTVDSGAQLVVGDLVLDEDSHEVMRAGEPVSLTSTEFELLRFMMHNSKRVLSKAQILDRVWSYDFGGRSNIVELYISYLRKKIDNGREPMIHTLRGAGYVLKPAR

SEQ ID NO: 8363 - DNA, 690 bp, Thermotoga maritima
  CDS (1)..(690)
atgttgagagtgggagtgaaggtgctgatagctgaagacgacgaagacataaggagcgtgttgaagagatacctggaaaccgaaggatacgagtgcgacgaagcagagtcccttttcgatctcaagaaaaaactctctgaaggaacgtacaacgtgcttctcctcgatctcatgtttcccgacggtgtggcgatggacgaaattcccgagatgaaagtttctcacccggaaatggccatcatcatcatctcggcaagggacagggacatggaccgcatctttggaatagagctcggagcggatgattacgtgacaaaacctttcaatccaagggaagttctcgcacgtgtgaaagcggttctgagaaggatggggaaagaacagaaggtactgagatttggaagactcgagatctttccagaggattacatagtcagatacgatggaaaaaacgttgagatgacagccaaagagttcgagcttttgaaactcctcgccacgaccccgaacaaggtcttttcaagagaggagatcctgaacagggtgtggggagacgattacgtctctgacagggtagtggatgtccacatcagcgccattcgatcgaagataggaaagggatggataaaaacggtgaggggattgggatacaagttttcaacacggggtgatgagggtgatagagcttga

SEQ ID NO: 8364 - protein, 229 aa, Thermotoga maritima
MLRVGVKVLIAEDDEDIRSVLKRYLETEGYECDEAESLFDLKKKLSEGTYNVLLLDLMFPDGVAMDEIPEMKVSHPEMAIIIISARDRDMDRIFGIELGADDYVTKPFNPREVLARVKAVLRRMGKEQKVLRFGRLEIFPEDYIVRYDGKNVEMTAKEFELLKLLATTPNKVFSREEILNRVWGDDYVSDRVVDVHISAIRSKIGKGWIKTVRGLGYKFSTRGDEGDRA

SEQ ID NO: 8365 - DNA, 801 bp, Xylella fastidiosa
  CDS (1)..(801)
atgatccggatttggatcgatgatctctgtgtgtcatatcagccatatttttgtcatgaatttgtagtttactggcgaacatccgaagtaaggcggtgtctgagcgtgcaaaaacgcgtcttgattgtcgatgatgaggtagcgattcgtgacatggttgctttcgctttgcgtaagggtgaatttgaatccttgcaggccagtgatgcgcgcgaggctcaggccgttatcgcagattgcgttccggatttgattttgttggattggatgctgcctggtaccagtggcctggagttgacacgtcgttggcgtaaagcgtcgctgacccgtgaaatacctatcatcatgctgaccgcgcgtagtgaggagaatgatcgggttggtggtttggaagcgggggtggatgattatatggtcaagccgttctcggcacgcgaactgttggcgcgcatccgcgcggtgatgcgccgtactcgtgatgatgatgaggatggcagtgttgccattggcaaattacgcattgatggtgctgcgcaccgtgtgtatgccggtcatgtgcaagtgccaattggtccgactgaataccgcttactgcattttttcatgacacattcggagcgcgtgtactcgcgtactcaacttttagatcatgtttggggtagcggcgtatatatagaggagcgcacgattgatgtgcatatccgccgtttgcgtagaacgttggagccatacggccttgacgatatggtgcagacggtacgtagtgccggttatcgcttctccggggcgatccagatctga

SEQ ID NO: 8366 - protein, 266 aa, Xylella fastidiosa
MIRIWIDDLCVSYQPYFCHEFVVYWRTSEVRRCLSVQKRVLIVDDEVAIRDMVAFALRKGEFESLQASDAREAQAVIADCVPDLILLDWMLPGTSGLELTRRWRKASLTREIPIIMLTARSEENDRVGGLEAGVDDYMVKPFSARELLARIRAVMRRTRDDDEDGSVAIGKLRIDGAAHRVYAGHVQVPIGPTEYRLLHFFMTHSERVYSRTQLLDHVWGSGVYIEERTIDVHIRRLRRTLEPYGLDDMVQTVRSAGYRFSGAIQI

SEQ ID NO: 8367 - DNA, 684 bp, Agrobacterium tumefaciens
  CDS (1)..(684)
atggtgccgaagattgcagttgtggaagacgaggaagcgctgagcgtcctgcttcgttacaatctcgaggctgagggatacgacgtcgacacgataccccgtggcgacgaggcggaaatcaggttgcaggagcgtattccggatcttctcatcctggactggatgctgcctggcgtctccggcatcgaactttgccggaggctcagaatgcggccggaaacggaacgcctgcccatcatcatgctgacggcgcgtggcgaagagagcgagcgcgttcgtggccttgccaccggcgccgacgattatgtcgtcaagccgttctcgacgccggaactcatggcccgcgtcaaggccatgctgcgccgggcgcgtcccgaggttctgtcttcggtgctgaaatgtggtgatatcgaactggatcgcgagacccatcgcgttcaccgcaaaagccgcgaagtgcgcctcggcccgacggaattccgcctgctggagttcctgatgacctcgccgggccgggtgttctcccgctcgcaattgctggatggcgtctggggccacgatatctacgtcgacgagcgtaccgttgacgtgcatgtcggacgcctgcgcaaggcgctcaatttctcccatatgcaggatgtcatccgcaccgtgcgtggtgccggatattcgatggaagcctga

SEQ ID NO: 8368 - protein, 227 aa, Agrobacterium tumefaciens
MVPKIAVVEDEEALSVLLRYNLEAEGYDVDTIPRGDEAEIRLQERIPDLLILDWMLPGVSGIELCRRLRMRPETERLPIIMLTARGEESERVRGLATGADDYVVKPFSTPELMARVKAMLRRARPEVLSSVLKCGDIELDRETHRVHRKSREVRLGPTEFRLLEFLMTSPGRVFSRSQLLDGVWGHDIYVDERTVDVHVGRLRKALNFSHMQDVIRTVRGAGYSMEA

SEQ ID NO: 8369 - DNA, 723 bp, Bacillus subtilis
  CDS (1)..(723)
atggaccaaacgaacgaaacaaaaatattagtagttgatgacgaagccagaattcgccgccttttaagaatgtatcttgaacgtgaaaattatgctatagatgaagctgaaaatggtgatgaagccattgccaaagggcttgaagccaattatgacttaattttgcttgatctgatgatgccggggactgatggaattgaagtgtgccggcaaattcgtgaaaaaaaagcgacacccattattatgctgaccgcaaaaggagaagaagcaaaccgggtgcaggggtttgaagcgggaacagatgattatattgttaagccgttcagcccgagagaagtcgtgctgcgtgtaaaggcccttttgagaagagcatcccaaacctcttatttcaatgccaatacaccgacgaaaaatgtgctcgtgttttcacatctgtcaatagaccatgatgctcaccgcgtaacagctgatggaacagaagtgagcctgacgccaaaagtgtatgagcttctatatttcttagcgaaaacgcctgacaaggtgtatgatcgggaaaagcttctgaaagaagtgtggcaatatgagttttttggtgatttacggacagtggacactcacgtcaaacgcttgagagagaagctgaacaaggtatctccggaagctgcgaaaaaaattgtcaccgtatggggtgtaggttataaatttgaggtcggcgctgaatga

SEQ ID NO: 8370 - protein, 240 aa, Bacillus subtilis
MDQTNETKILVVDDEARIRRLLRMYLERENYAIDEAENGDEAIAKGLEANYDLILLDLMMPGTDGIEVCRQIREKKATPIIMLTAKGEEANRVQGFEAGTDDYIVKPFSPREVVLRVKALLRRASQTSYFNANTPTKNVLVFSHLSIDHDAHRVTADGTEVSLTPKVYELLYFLAKTPDKVYDREKLLKEVWQYEFFGDLRTVDTHVKRLREKLNKVSPEAAKKIVTVWGVGYKFEVGAE

SEQ ID NO: 8371 - DNA, 684 bp, Bacillus subtilis
  CDS (1)..(684)
atgaaaatattaatgatagaagataatgttagtgtatgtacgatgacggagatgttcttttttaaagaaggttttgaagccgaattcgttcatgacgggttagaagggtaccagcgttttacggaagaaaattgggatctaatcattttggatatcatgcttccatctatggacggcgtgaccatctgcagaaaaataagagagacaagcacggtgccgattatcatgctgactgccaaagacactgaatcagatcaggtcatcggttttgagatgggggcggacgattatgtcacaaagccgttcagcccgctgacattggttgcccgcatcaaagccgtcatcagaagatataaggcgacaggcaaagcggttattgatgaagatatgattgaaacggaatgctttaccattaataagaagacgagagaagtattattaaacggagagcctgtagaaaatctcacgccgaaggaattcgatctgctttattaccttgtccaaaatccgcggcaggtgttctccagagaacagctgcttgagcaggtatggggctatcaattttatggagatgagcgaacggttgacgttcatatcaaacggctgcggaaaaagcttgccagcgaggacaagcctttcctgtatactgtgtggggagtagggtataaatttgatgaagattaa

SEQ ID NO: 8372 - protein, 227 aa, Bacillus subtilis
MKILMIEDNVSVCTMTEMFFFKEGFEAEFVHDGLEGYQRFTEENWDLIILDIMLPSMDGVTICRKIRETSTVPIIMLTAKDTESDQVIGFEMGADDYVTKPFSPLTLVARIKAVIRRYKATGKAVIDEDMIETECFTINKKTREVLLNGEPVENLTPKEFDLLYYLVQNPRQVFSREQLLEQVWGYQFYGDERTVDVHIKRLRKKLASEDKPFLYTVWGVGYKFDED

SEQ ID NO: 8373 - DNA, 717 bp, Deinococcus radiodurans
  CDS (1)..(717)
atgagccatgtcgttgtcattgaggatgagagcacggtccgcgacgtgctgcgctttcatctggagcgcgcgggcctgcgcgtctcggcctacgccagcacccaggccgccgaggaagcgggcgcgctggcgggggccgacgcgctggtgctcgattggatgctgccgggcgagagcggcatcggcttcctgcgccgcctgcgcaccgacaacgacctgcgccgcttgccagtattgatgctcacggcccgcgccgccgaggccgagcgcgtcgagggtctggagacgggtgccgacgactacctcaccaagcccttttcggcggcggaactcgtggcccgcgtgcgcgccctgctgcgccgggcccagcccgagacgccgcagcacctcggcaacggcccgctgacggtggacctcgcggcggcggaggcgcaactggccgggcgcaccctgaacctgacgcggcgcgagttcgacctgctggcgtttctgaccgccaacgccgggcgggtctactcgcgcaccgagctgctcgaccgggtgtggggcgccgactttctgggcggcgagcgcacggtggaccagcacgtcacgcagttgcgggcgcacctcggcgacgaccccggcaagccgagctttctggaaacggtgcgcggcaagggctaccgcatgcgcgcctggaatgccgacgcggcccgcgccgaggccccgaagtga

SEQ ID NO: 8374 - protein, 238 aa, Deinococcus radiodurans
MSHVVVIEDESTVRDVLRFHLERAGLRVSAYASTQAAEEAGALAGADALVLDWMLPGESGIGFLRRLRTDNDLRRLPVLMLTARAAEAERVEGLETGADDYLTKPFSAAELVARVRALLRRAQPETPQHLGNGPLTVDLAAAEAQLAGRTLNLTRREFDLLAFLTANAGRVYSRTELLDRVWGADFLGGERTVDQHVTQLRAHLGDDPGKPSFLETVRGKGYRMRAWNADAARAEAPK

SEQ ID NO: 8375 - DNA, 699 bp, Clostridium acetobutylicum
  CDS (1)..(699)
atggcaggcgaaaaaatacttgttgtagatgatgaggagcatatagtcaagcttataaaatttaaccttgaaaacaatggatataaggttattacggcagcagatggtggtgaagcactagaaaaggcaaagggagaagtgcctcaactggttcttctagatttaatgcttccagttatggatggctacgatgtttgtagagaaatacgaagggatcaatccatttcaaacatgcctgtaattatgataacagcaaagggagaagaattggacaaaatattaggcttggagcttggagcagatgattatataactaaacctttttcagttagagaattagttgcaagggtgaaggcagtattaagaaggactaaggttgattatatagataaaacttttaaatttggtaatattcaaatagattttcaaaggcataatgttaccaaagagggagaaaaggtagagcttacccttaaggaatttgaacttcttcaagtacttataaagaataagggcagagtaatgacaagggattttttacttgataaaatatggggatatgaatacattggagaaacacgtacggtagatgttcacgtgaggcatttaaggcaaaaaattgaagatgatgataaaaatccaaaatatatagaaactataagaggaatagggtatagatttaactatagtggtgattaa

SEQ ID NO: 8376 - protein, 232 aa, Clostridium acetobutylicum
MAGEKILVVDDEEHIVKLIKFNLENNGYKVITAADGGEALEKAKGEVPQLVLLDLMLPVMDGYDVCREIRRDQSISNMPVIMITAKGEELDKILGLELGADDYITKPFSVRELVARVKAVLRRTKVDYIDKTFKFGNIQIDFQRHNVTKEGEKVELTLKEFELLQVLIKNKGRVMTRDFLLDKIWGYEYIGETRTVDVHVRHLRQKIEDDDKNPKYIETIRGIGYRFNYSGD

SEQ ID NO: 8377 - DNA, 687 bp, Mycobacterium tuberculosis
  CDS (1)..(687)
atggacaccatgaggcaaaggattttggtcgttgacgacgacgcttcgttggctgagatgctcaccatcgtgctgcggggggaaggcttcgacaccgcggtcatcggcgacggtactcaggctctgaccgcggtgcgcgagctgcgccccgatctggtgttattggatttgatgctgcccggtatgaacggcatcgacgtgtgccgggtgttgcgcgccgattccggtgttccgatcgtgatgctcaccgcaaagaccgacaccgtggatgtggtgctgggtctggagtcgggcgccgacgactacatcatgaagccgttcaagcccaaggagctggttgcgcgggtgcgggcgcggctgcgccgcaacgacgacgaacccgccgagatgctgtccatcgccgacgtagaaatcgacgtaccggcgcacaaggtcactcgcaacggtgagcagatctcgttgacaccgctggaattcgacctgttggtcgcattggcgcgcaagccgcgccaggtgtttactcgtgatgtgctgctcgaacaggtatggggttaccggcacccagccgataccaggctggtgaacgtgcatgtccagcgtctgcgggccaaggtcgaaaaggatcccgagaacccgactgtggtgctgaccgttcgaggagtggggtacaaggccggacctccgtga

SEQ ID NO: 8378 - protein, 228 aa, Mycobacterium tuberculosis
MDTMRQRILVVDDDASLAEMLTIVLRGEGFDTAVIGDGTQALTAVRELRPDLVLLDLMLPGMNGIDVCRVLRADSGVPIVMLTAKTDTVDVVLGLESGADDYIMKPFKPKELVARVRARLRRNDDEPAEMLSIADVEIDVPAHKVTRNGEQISLTPLEFDLLVALARKPRQVFTRDVLLEQVWGYRHPADTRLVNVHVQRLRAKVEKDPENPTVVLTVRGVGYKAGPP

SEQ ID NO: 8379 - DNA, 690 bp, Bacillus halodurans
  CDS (1)..(690)
atgaacaagcggcataatattttgattgtagatgatgaactagatctacgcgaactcgtaacgtcctatttacgaaaagaagggtttgctgtttatacagcagagacgggagatgaagcaatcaaacggcttgaacaggagccaatggatcttgtcgtccttgatgtcatgatggatgaaatggacggctttactgcttgtaaagaaatccgtgcgttttcgcaaataccgattattatgctgacagcaagaggtggagaagacgacaaagtcatgggcttacaaatcggagccgatgattacattgtcaaaccgtttagtccccgtgagctcgtcgcccgaatcgaagttgccttgcgaagaacgcaaggaatccagcaagtggatgataccggatatcgcttcaacgagcttcgcatccagcctagcggtcgcaaggtgtttgtgaatggtcaagagatctcactaacaaaaaaagagtacgatttgctagtttttctattggaacatcgtggacgtgtgtttacacgagagcatctccatgaccgcttgtggggaatggatacccagcaagggacgcttcggacagttgatactcacatcaaaacgttacgcttaaaactaaagccagctgatcgattcatcaaaaccgtttggggtgtcgggtataagttcgaggtagactcatga

SEQ ID NO: 8380 - protein, 229 aa, Bacillus halodurans
MNKRHNILIVDDELDLRELVTSYLRKEGFAVYTAETGDEAIKRLEQEPMDLVVLDVMMDEMDGFTACKEIRAFSQIPIIMLTARGGEDDKVMGLQIGADDYIVKPFSPRELVARIEVALRRTQGIQQVDDTGYRFNELRIQPSGRKVFVNGQEISLTKKEYDLLVFLLEHRGRVFTREHLHDRLWGMDTQQGTLRTVDTHIKTLRLKLKPADRFIKTVWGVGYKFEVDS

SEQ ID NO: 8381 - DNA, 723 bp, Bacillus subtilis
  CDS (1)..(723)
atgaacaagaaaattttagttgtggatgatgaagaatctattgttactcttttacagtacaatttggaacggtcaggctatgatgtcattaccgcctcggatggggaagaagcactcaaaaaagcggaaacagagaaacctgatttgattgtgcttgatgtgatgcttccaaaattggacggaatcgaagtatgcaagcagctgagacagcaaaaactgatgtttcccattttaatgctgacagcgaaggatgaggaattcgacaaagtattagggctggagctcggtgctgatgattatatgaccaagccgttcagtccaagggaagtaaatgcgagagtcaaagcgattttaaggcgttcggaaatacgtgcgccctctagtgagatgaagaacgatgaaatggaaggccagatcgtaatcggcgatctgaaaatcctgcctgatcattatgaagcgtactttaaagaaagtcagcttgaactgacaccgaaagaattcgaactgctgctctatttaggcagacataaaggcagagttctgacaagagacctgctgctgagcgcagtctggaattatgattttgccggagatacgagaattgttgatgtgcacatcagccatcttcgcgacaaaattgaaaacaataccaaaaaaccgatctacattaaaacgattaggggattggggtataaactggaggagccaaaaatgaatgaataa

SEQ ID NO: 8382 - protein, 240 aa, Bacillus subtilis
MNKKILVVDDEESIVTLLQYNLERSGYDVITASDGEEALKKAETEKPDLIVLDVMLPKLDGIEVCKQLRQQKLMFPILMLTAKDEEFDKVLGLELGADDYMTKPFSPREVNARVKAILRRSEIRAPSSEMKNDEMEGQIVIGDLKILPDHYEAYFKESQLELTPKEFELLLYLGRHKGRVLTRDLLLSAVWNYDFAGDTRIVDVHISHLRDKIENNTKKPIYIKTIRGLGYKLEEPKMNE

SEQ ID NO: 8383 - DNA, 774 bp, Synechococcus sp
  CDS (1)..(774)
atgacctccaacccactcgatgaatccatggaatcgctgaccgtcgtgcccccagccgcgtcaccggcgtcgcgcatcctggtggttgaagatgaagccgtgattcgggacatggtggcgttagtgctgcagcaggagggcttcacggtcgatgtggcagcggacggccgaactgctctcaattacttccgcagcgatagtcctgaggccggatcggtgactgaaaaccccgatctcgttgtccttgacctgatgttgccggcagtcaatggcctagatttctgccgattattgcggcggcagggggtgacagtgccgattttgatgctcagcgccaaggatacggaaaccgatcgcgtggttgggcttgaaattggagccgatgattatttgacaaaacccttcggtacccgcgagttggtggcgcggtgtcgagcgctgctgcggcgcagccaaaatcagcccgccgagactcctgccgtgttgcgctacgaaggcttaaaactttttccagaagaatgtcgggtcttgctagacgatcgcgagctgaccttgtcgcccaaggagtttcggttattagagctcttcatgcgccacccgcgtcgggtttggtcgcgcgatcagttgctcgaaaaaatttggggtatcgatttcatgggggatagcaaaacgatcgatgtgcatatccgctggctacgcgaaaagattgaagccaatcccagcaaccccagctatctgctcaccgttcgaggctttggctaccgcctaggttag

SEQ ID NO: 8384 - protein, 257 aa, Synechococcus sp
MTSNPLDESMESLTVVPPAASPASRILVVEDEAVIRDMVALVLQQEGFTVDVAADGRTALNYFRSDSPEAGSVTENPDLVVLDLMLPAVNGLDFCRLLRRQGVTVPILMLSAKDTETDRVVGLEIGADDYLTKPFGTRELVARCRALLRRSQNQPAETPAVLRYEGLKLFPEECRVLLDDRELTLSPKEFRLLELFMRHPRRVWSRDQLLEKIWGIDFMGDSKTIDVHIRWLREKIEANPSNPSYLLTVRGFGYRLG

SEQ ID NO: 8385 - DNA, 708 bp, Bacillus subtilis
  CDS (1)..(708)
atggataaaaagatccttgtagtagatgatgaaaaaccgattgcagatatattggaatttaacttaagaaaagaaggctatgaagtgcactgtgcccacgacggaaacgaagccgttgaaatggtagaagagcttcagcctgatttaattcttttagatattatgctcccaaataaagacggcgttgaagtatgccgcgaagtcagaaagaaatacgatatgccaatcattatgctgacggctaaggattcagaaattgacaaggttatcgggcttgaaatcggtgctgatgactatgtcacaaaaccattcagcacacgcgagctcttggcgcgtgtaaaagcgaacctgcgccgccagctgacaacagcgcctgcggaggaagagccttcctctaacgagattcatatcggctctctcgtcatcttccctgacgcgtacgttgtatcaaaacgagacgaaacaatcgaattgactcatcgtgagttcgaattgcttcattatttagcaaaacatatcggacaagtgatgacccgtgaacatttgcttcaaaccgtttggggctatgattacttcggcgatgtcagaacggttgacgtaacagtccgccggcttcgtgaaaaaatcgaggacaacccgagccatccaaattggatcgtcacacgccgtggtgtaggttattacttgagaaacccagaacaggactaa

SEQ ID NO: 8386 - protein, 235 aa, Bacillus subtilis
MDKKILVVDDEKPIADILEFNLRKEGYEVHCAHDGNEAVEMVEELQPDLILLDIMLPNKDGVEVCREVRKKYDMPIIMLTAKDSEIDKVIGLEIGADDYVTKPFSTRELLARVKANLRRQLTTAPAEEEPSSNEIHIGSLVIFPDAYVVSKRDETIELTHREFELLHYLAKHIGQVMTREHLLQTVWGYDYFGDVRTVDVTVRRLREKIEDNPSHPNWIVTRRGVGYYLRNPEQD

SEQ ID NO: 8387 - DNA, 738 bp, Synechocystis sp
  CDS (1)..(738)
atgtgggggaacaggactgaatttattgccatgcccaacattttaatcgtggaagatgaccaggaaatcgcccagctaatcagggaaacgttggagcgagaacagtttacctgcattgtcaccaatgatggagaaactggtttaagaattttccaggaacaggttccagatttaattgtgttggatttgatgttacccaaattggatggactggaagtttgtacccgcattcgccaacaaccgggcagcaaagacccctatattctgatgttgaccgccaaaggggaggagatcgaccgcattattggcctctccaccggggccgatgattatttggtcaaacccttcagtccgagggaattggtcgctagggtacgggccctattgcggcggcaattgcgccaggggcaaccagtgggacaaatttatcgtacaaaccattttcaggtggacctagaccaacatcaggcgagtcgttaccagggcgatcgccaggaagagttggagttgaccgggttggaatttaatttattagctacgtttatgagctatccggggcgggtctggaatcggacccaattaattgaaaagttgtggggcaatgatttttttggcgatgaacgggtggtggatacccacattcgtcgattacgcaagaaaattgaaccggaccccgctaatcctacttttattaaaacggtgatcggtttgggctataagtttgaagaccctgattaa

SEQ ID NO: 8388 - protein, 245 aa, Synechocystis sp
MWGNRTEFIAMPNILIVEDDQEIAQLIRETLEREQFTCIVTNDGETGLRIFQEQVPDLIVLDLMLPKLDGLEVCTRIRQQPGSKDPYILMLTAKGEEIDRIIGLSTGADDYLVKPFSPRELVARVRALLRRQLRQGQPVGQIYRTNHFQVDLDQHQASRYQGDRQEELELTGLEFNLLATFMSYPGRVWNRTQLIEKLWGNDFFGDERVVDTHIRRLRKKIEPDPANPTFIKTVIGLGYKFEDPD

SEQ ID NO: 8389 - DNA, 705 bp, Synechocystis sp
  CDS (1)..(705)
atggtcgatgacgaggccagcatccgacgcatactggaaacccgtttatccatgattggctatgaagtggtgaccgctgccgacggtgaagaggcgatcgccactttccatgagagcgaccccgatttggtggtgttggatgtgatgatgcccaagctggacggctacggcgtttgccaagaactacgtaaagaatcggacattcccattattatgcttaccgccctgggggatgtggccgatcgcattaccggtttggaactgggggccgatgattatgtggtgaagcccttttcccccaaggaattggaagctagaatccggtccgtgctacggcgggtggacaaaaacggtatgccgggcattcccagttcgggcgtgttgcaaattgccaccattcgcattgataccaacaagcgtcaagtgtataaaggggatgagcgcatccgcctaacaggaatggaatttagcctgttggaattgttggtgagtcgctccggagagcccttttcccgttcggaaattctccaggaagtgtggggctacacccccgaacgccatgtggataccagggtggtggacgtgcatatttcccgcctgcgggccaaactagaggaagaccccagcaatcccgaattaattcttactgcccggggcaccggttacctgttccaacgcattctggaaccgggggaagaaccgtaa

SEQ ID NO: 8390 - protein, 234 aa, Synechocystis sp
MVDDEASIRRILETRLSMIGYEVVTAADGEEAIATFHESDPDLVVLDVMMPKLDGYGVCQELRKESDIPIIMLTALGDVADRITGLELGADDYVVKPFSPKELEARIRSVLRRVDKNGMPGIPSSGVLQIATIRIDTNKRQVYKGDERIRLTGMEFSLLELLVSRSGEPFSRSEILQEVWGYTPERHVDTRVVDVHISRLRAKLEEDPSNPELILTARGTGYLFQRILEPGEEP

SEQ ID NO: 8391 - DNA, 675 bp, Synechocystis sp
  CDS (1)..(675)
atgagtcaccgtgttctagttgtggaagaggaagaaaagttagcccgatttatggagttggaactcaaatatgaaggctacgatgtcagtgtggctagggatggcctaaagggctttacccaagcccaggaatttccccccgatttaatcattgtgaatggagccctgccgggcatgtccggtttagagctatgccggaggttaagggaaatgggcagtcgcattcccattattctgatcaccgccaaggacgacgtggaagaacgggtgatggggttagatgccggtgccgatgactacattgtcaaaccctttaactccgatgaattttttgctcgcatccgggtgcaattgcgccgcacccacaccaccagcgatgaagtattgcaattcgccgatctacgtttcaatcgcagtacgagggaaatccaacggggcgatcgcctgattgatctcaccgccaaagaattcgagctgttggactatctgctctcccatgcccgccaggtgttgactagggaacaaattttagagcgggtctggggctacgactttatgggggattccaacatcattgaggtctatatccgttatctgcggttgaagttggaggcggcgggggaacctcgtttgattcagacagtgcggggggtgggctacgtactaagggattag

SEQ ID NO: 8392 - protein, 224 aa, Synechocystis sp
MSHRVLVVEEEEKLARFMELELKYEGYDVSVARDGLKGFTQAQEFPPDLIIVNGALPGMSGLELCRRLREMGSRIPIILITAKDDVEERVMGLDAGADDYIVKPFNSDEFFARIRVQLRRTHTTSDEVLQFADLRFNRSTREIQRGDRLIDLTAKEFELLDYLLSHARQVLTREQILERVWGYDFMGDSNIIEVYIRYLRLKLEAAGEPRLIQTVRGVGYVLRD

SEQ ID NO: 8393 - DNA, 789 bp, Synechocystis sp
  CDS (1)..(789)
atgttggttaaataccatctagtaggtttcccaatggcaacgctagaagcccccccccatagtctgcaacaccaggaaattccccccagccatcgtattttggtcgttgaagacgaggtttccattcgtgaaaccattgtcctatcactgcaggaagaaggttatgaagtttatgcggtggacgatggacgtgatgccttagctctgttgcaagaatttagcgaagaccccggtcaggccgccgtagacctgatcattctggacatcatgcttccccaggtaaacggcttagatgtatgtcgtagtttgcgctttggtggcgataataccccgattttaattgtcagtgccaaaggcagtgaaatggaaaaagtaactggcttggaagtgggggccgatgactacatcactaagccctttagcctgaaggaattggtggcccgttgccgcgccatgatccgtcgccagggcttggctggtaataacattgccccattccgcaaatttagggatttggtgctttatccccaggagtgtcgggtgttaatgcggggagaagaagtgagtttggccccgaaggaatttcgcctattggaattgttcatgagctatccccgtcgagtctggtctagggaacagttaattgaacatatttggggcattgattttatgggagacagcaaaacggtggatgtccatatccgctggctacgggaaaagctggaacaggaccccagtcagccggaatatttagtcacagtgcggggctttggctatcgttttggttag

SEQ ID NO: 8394 - protein, 262 aa, Synechocystis sp
MLVKYHLVGFPMATLEAPPHSLQHQEIPPSHRILVVEDEVSIRETIVLSLQEEGYEVYAVDDGRDALALLQEFSEDPGQAAVDLIILDIMLPQVNGLDVCRSLRFGGDNTPILIVSAKGSEMEKVTGLEVGADDYITKPFSLKELVARCRAMIRRQGLAGNNIAPFRKFRDLVLYPQECRVLMRGEEVSLAPKEFRLLELFMSYPRRVWSREQLIEHIWGIDFMGDSKTVDVHIRWLREKLEQDPSQPEYLVTVRGFGYRFG

SEQ ID NO: 8395 - DNA, 717 bp, Bacillus licheniformis
  CDS (1)..(717)
atggaagccattcgagtgttcatagcggatgatgaaaaagaaatcagagatttattgaaaacctatttaaaaagagagtgttatgaggttgacgtggcagttgacggagaagatgcgttaaggctgtttgaacaaaaccattaccacctcgtgatattggatgtgatgatgccgaaaatcgacggcatcgaggtttgcagaaggatgaggaatcatacgaatgttccgatcctgatgctgaccgccaaagaccttgaaggcgataaaattttaggactgtccatcggtgctgacgattatataacaaagcccttcagcgtgaacgaagtgcttgcgcggatcaaagccatgctgaggcgctttttggtcctcggcagcgaaagccgctccgatgaacaatcgttgattcaatttaaaggattgaccatcgatttgaaaacatatacggtcaccgcaggcggacaggagatctccctgacggcgaaggagtttgaactgctgaaatttttcgcctcaaatccggggcaggtatttacgaaaacgcagctgtttcgaaacgcatggagcgatcaatacatagaagatgataatacggtcatggtgcatatcagaaggctgagaaaaaaaatagagccggacccttccgatccgcaatttattcaaaccgtttggggaattggctataagtttgtaggtgagaaagatgctgaccgataa

SEQ ID NO: 8396 - protein, 238 aa, Bacillus licheniformis
MEAIRVFIADDEKEIRDLLKTYLKRECYEVDVAVDGEDALRLFEQNHYHLVILDVMMPKIDGIEVCRRMRNHTNVPILMLTAKDLEGDKILGLSIGADDYITKPFSVNEVLARIKAMLRRFLVLGSESRSDEQSLIQFKGLTIDLKTYTVTAGGQEISLTAKEFELLKFFASNPGQVFTKTQLFRNAWSDQYIEDDNTVMVHIRRLRKKIEPDPSDPQFIQTVWGIGYKFVGEKDADR

SEQ ID NO: 8397 - DNA, 900 bp, unidentified
  CDS (40)..(771)
gatataatacttttgtaaagaaaagcatgtgtgggaggtatgacctgtatgtcgaacgaaatacttatcgtagatgatgaggatagaatcagaagattacttaaaatgtatttagaaagagaatcttttgaaatccatgaagcaagtaatggccaagaggcttatgaacttgcaatggagaataattatgcttgcatactactagatttaatgttgcctgaaatggatggtatccaggtggcaactaaattgcgtgaacataaacaaacaccgattattatgttgactgctaaggtgaagaaaccacaccgtgttgaaggttttgaatctggtgcagatgataatatcgtcaaaccattttcaccaagagaagtagtcttaagagttaaagcacttctaagaagaacgcaatctacaactgtagaacaaagcgaacctcacgcacgtgatgtgattgtatttaaacatttagaaatagataatgatgcacatgcacttgctgataatcaagaagttaatttgactcctaaagagtacgaattattaatatatttagctaaaacaccaaataaagtatttgaccgtgaacaattattaaaagaagtttggcattatgaattctatggtgatttaagaacagttgatactcatgttaaacgacttagagaaaagttaaatcgtgtgtctagcgaagctgcgcatatgattcaaacagtctggggcgttgggtataaatttgaggttaaatctaatgatgagccggctaaatagtgtcgtaattaaactgtggttaactattattttaatagtgacgacagttttaattttattaagtattgctttaattacctttatgcaatactatttcacacaagaaaccgaaaatgccataagagaaga

SEQ ID NO: 8398 - protein, 243 aa, unidentified
MTCMSNEILIVDDEDRIRRLLKMYLERESFEIHEASNGQEAYELAMENNYACILLDLMLPEMDGIQVATKLREHKQTPIIMLTAKVKKPHRVEGFESGADDNIVKPFSPREVVLRVKALLRRTQSTTVEQSEPHARDVIVFKHLEIDNDAHALADNQEVNLTPKEYELLIYLAKTPNKVFDREQLLKEVWHYEFYGDLRTVDTHVKRLREKLNRVSSEAAHMIQTVWGVGYKFEVKSNDEPAK

SEQ ID NO: 8399 - DNA, 708 bp, Bradyrhizobium japonicum
  CDS (1)..(708)
atgggcgcacgcattatggtggttgaggacgaggaagctctcaccgagcttctccgctacaacctcgaaggcgacggctatgatgtggagacggtgatgcgcggcgacgacgccgacacccgcctcaaggaacacatccccgatctgatcgtactcgactggatgctgccgggactgtcaggcatcgagctgtgccgccggctgcggacccggcccgagaccaagcagctcccgatcatcatgctcaccgcgcgcggcgaggagagcgagcgggtgcggggtcttgcgaccggcgccgacgactacatcgtcaagccgttctcggtgccggagctcctggcgcgcgtgaagggcctgctgcggcgcgcaagcccggagcggctcgcaacggtgctggcctatggtgacatcgagctcgatcgcgacaagcgccgcgtcgcgcgctcgggccggccgatcgacctcggcccgaccgaatatcgcctcttggagttcttcctggagcatcccggccgcgtgttctcgcgcgagcagctgctcgacagcgtctggggccgcgacatctacatcgacgagcgcaccgtcgacgtccacatcggccgcctgcgcaagctgctcaatctcggccgcgagcaggatcccatccgcaccgtccgcggcgccggctacgcgctggatgatcgctttgcgaaggcggagcagacgtag

SEQ ID NO: 8400 - protein, 235 aa, Bradyrhizobium japonicum
MGARIMVVEDEEALTELLRYNLEGDGYDVETVMRGDDADTRLKEHIPDLIVLDWMLPGLSGIELCRRLRTRPETKQLPIIMLTARGEESERVRGLATGADDYIVKPFSVPELLARVKGLLRRASPERLATVLAYGDIELDRDKRRVARSGRPIDLGPTEYRLLEFFLEHPGRVFSREQLLDSVWGRDIYIDERTVDVHIGRLRKLLNLGREQDPIRTVRGAGYALDDRFAKAEQT

SEQ ID NO: 8401 - DNA, 690 bp, Vibrio cholerae
  CDS (1)..(690)
atgtctagaaggattctggttgttgaagacgaagcaccgattcgtgaaatgttgtgtttcgtgcttgaacaaaagggctatcaggcggttgaggctgaagattatgattcggcgatgagtaagctggctgagccttttcctgatctcgtcctgcttgactggatgttgcctggtggtagtggcatcaacctcatcaagcatatgaagcgcgaagagatgacgcgcaacattcctgttgtgatgctcaccgcccgtggtgaagaagaagataaagttcgcggcttagaagtgggcgcggatgattacattaccaaaccgttttcacctaaagagttggttgcccgtttaaaagcggtgatccgccgtgtcactccgacggcgttggaggatgtgattgatgttcaaggtttgaagttagatccggtctcacaccgtgtgaccgctaacgatcagccgttggatatgggaccgactgaattcaaaatgttacacttcttcatgacacaccaagagcgtgtgtatagccgcgagcagctactcaataatgtttggggcaccaacgtgtatgtggaagatcgcacggtagacgtccacattcgtcctctacgtaacgccttagaagacgctggacatgataagctgatccagacggtgcgcggcgcggggtatcgtttttcaaccaaagcctaa

SEQ ID NO: 8402 - protein, 229 aa, Vibrio cholerae
MSRRILVVEDEAPIREMLCFVLEQKGYQAVEAEDYDSAMSKLAEPFPDLVLLDWMLPGGSGINLIKHMKREEMTRNIPVVMLTARGEEEDKVRGLEVGADDYITKPFSPKELVARLKAVIRRVTPTALEDVIDVQGLKLDPVSHRVTANDQPLDMGPTEFKMLHFFMTHQERVYSREQLLNNVWGTNVYVEDRTVDVHIRPLRNALEDAGHDKLIQTVRGAGYRFSTKA

SEQ ID NO: 8403 - DNA, 702 bp, Lactococcus lactis
  CDS (1)..(702)
atgaaaaaaattcttgttgttgatgatgaaaaaccaatctcagatatcgtaaaatttaatttaaccaaagaaggttttgaagtctttacagcttttgatggtgaagaagctcttgaagcatttaaagaagtacaacctgaccttattctgcttgatttgatgttacctaaacttgatggtcttgatgttgcacgtgaaatccgtaaaacttctgacactccaattattatggtgtcagctaaagatagtgaatttgacaaagtaattggtcttgaacttggtgctgatgattatgtcacaaaaccattctcaaaccgtgaactattagctcgtattaaagcaaacttgcgtcgtatcaatgtcgcacctgctgaatctactgacaatgtcaagaaagaattgattatcggaaacctccgtatcaatccagcacactatgcggcttataaaaatggtaaacaactcgaccttacacaccgtgagtttgaattgctttactaccttgctcaacaccttggcgaagtgatcactcgtgaaaaccttttggaaaccgtttggggttatgactactttggagatgttcgtacagttgacgttactgttcgtcgtttacgtgaaaaagttgaagatactccaagccgtccacaatacgtttcaacacgccgcggggttggctactacatgagcaacccacatgattaa

SEQ ID NO: 8404 - protein, 233 aa, Lactococcus lactis
MKKILVVDDEKPISDIVKFNLTKEGFEVFTAFDGEEALEAFKEVQPDLILLDLMLPKLDGLDVAREIRKTSDTPIIMVSAKDSEFDKVIGLELGADDYVTKPFSNRELLARIKANLRRINVAPAESTDNVKKELIIGNLRINPAHYAAYKNGKQLDLTHREFELLYYLAQHLGEVITRENLLETVWGYDYFGDVRTVDVTVRRLREKVEDTPSRPQYVSTRRGVGYYMSNPHD

SEQ ID NO: 8405 - DNA, 867 bp, Rhodella violacea
  CDS (100)..(843)
aagcttcggggttttcttattcaaattttataaacactttaaatcggcattaatgctaaatattactatttacaaaaatataatgaggtgaaaacaacaatgcaaaataataataacaataaaaataataaaaccatcttgattgttgatgatgaagctagtatgagaagattgttggagtatagactttctattattggttataatgttataagcgcttctgatggagaagaagccctcaatatttttcgaaaagagcatcccaacttaatagttttagatataatgatgccaaagttagatggatttggagtctgtcaagagattagaaaagaatctgacattccaattataatgttgaccggtctgggggatattgtagatcgtattacaggtttagagctaggagctgatgattatttagtgaaacctttttctcctaaagaattagaagctagaattaaatctgtgttacgacgttctgatcgcatgacagtgaactcaaatattcctacttccggaattaatcaaataggattcttaactatagatactaatcgtagacaagtatacaaaaataacgaaagagtccgactaactggcatagaattctgcttgctagaattactaatcagtcgtgcgggttctcctttttcaagagcagtaatattgcaaaaggtttggggatatacacctgaacgacatattgatactcgtgtggtagatgttcatatctcacgcttgcgcgctaaactagaagatgatccaagcaatccagatcttattttaacggcaagaggaacaggatatctatttcagcgcattacacaaattaatcaatagtaataattcttcaatgcaaaattc

SEQ ID NO: 8406 - protein, 247 aa, Rhodella violacea
MQNNNNNKNNKTILIVDDEASMRRLLEYRLSIIGYNVISASDGEEALNIFRKEHPNLIVLDIMMPKLDGFGVCQEIRKESDIPIIMLTGLGDIVDRITGLELGADDYLVKPFSPKELEARIKSVLRRSDRMTVNSNIPTSGINQIGFLTIDTNRRQVYKNNERVRLTGIEFCLLELLISRAGSPFSRAVILQKVWGYTPERHIDTRVVDVHISRLRAKLEDDPSNPDLILTARGTGYLFQRITQINQ

SEQ ID NO: 8407 - DNA, 705 bp, Synechococcus sp
  CDS (1)..(705)
atgggcacggcgaagctgctggtggtggaagacgatgattcgatcagagaaaccgtggaagaagcccttcgcgccgaaggcttcgaggtgaagtcttgcggcaatggtgccgacgccatggctttgctttccgctccaaacactgagggagttgacctgctggtgctcgacctgatgcttcctggtctgggcgggctcgatctctgccgacaactgcgcaaactcaacaaccacacccctgtgctggtgatcagtgcgcgagacagcgaaaccgacagggtgctcggccttgaagtgggcgctgacgactatctggtcaagccctttggcctgcgagaactggtcgcgcgctgccgggccttgctgcgacgctcccaacagatcgcatccgtccccagtgaggatcgccaagtggtccagacgggcaatctctgcctttacgcccaggagtgccgcgtcacccgcgatggggaagacctcacgctttcaccgaaggagtacaaaatcctcgaactgctgatccgcaatcccaagagggtctggagcagagaccagttgctggagcgaatctggggaatcgattttgttggagacaccaaaacagtggatgtccacatccgttggttgagagaaaagattgaggaggagccttcctcgccgcaacacatccgcaccgtcaggggattcggctaccgcttcggctaa

SEQ ID NO: 8408 - protein, 234 aa, Synechococcus sp
MGTAKLLVVEDDDSIRETVEEALRAEGFEVKSCGNGADAMALLSAPNTEGVDLLVLDLMLPGLGGLDLCRQLRKLNNHTPVLVISARDSETDRVLGLEVGADDYLVKPFGLRELVARCRALLRRSQQIASVPSEDRQVVQTGNLCLYAQECRVTRDGEDLTLSPKEYKILELLIRNPKRVWSRDQLLERIWGIDFVGDTKTVDVHIRWLREKIEEEPSSPQHIRTVRGFGYRFG

SEQ ID NO: 8409 - DNA, 690 bp, Photorhabdus luminescens
  CDS (1)..(690)
atggcaagacgcattctggtagttgaagatgaagctccgattcgtgagatggtctgttttgttctggaaaaaaacgggtatcagccggtagaagcagaggattatgattctgcgttggcatgtttatctgaaccctatcctgatttagtgttattggattggatgctccccggtggttctggtttgcagataattaagcagatgaaacggaataataatattcgcgatattccggtgatgatgttgactgcccgtggtgaagaggaagatcgggtgcgtggcctcgaagttggggcagatgactatatcactaagcctttctctcctaaagagctggttgccagagttaaagcggtattacggcgtatttcaccgatggtcatggaagatatcatcgaaatggatggtttagttttggattcaacgtcccatcgggtgaccagccgggataaagcactggatatggggccgacggaatttaaattactgcacttctttatgactcaccctgagcgagtctatagccgtgaacagttgcttaattatgtttggggagcaaatgtttatgttgaagatagaactgttgatgttcatattcgccgtttacgtaaagtattagagattggcggccatgataaaatggtgcagaccgttcgtggtacgggctatcgtttttctacccgttactaa

SEQ ID NO: 8410 - protein, 229 aa, Photorhabdus luminescens
MARRILVVEDEAPIREMVCFVLEKNGYQPVEAEDYDSALACLSEPYPDLVLLDWMLPGGSGLQIIKQMKRNNNIRDIPVMMLTARGEEEDRVRGLEVGADDYITKPFSPKELVARVKAVLRRISPMVMEDIIEMDGLVLDSTSHRVTSRDKALDMGPTEFKLLHFFMTHPERVYSREQLLNYVWGANVYVEDRTVDVHIRRLRKVLEIGGHDKMVQTVRGTGYRFSTRY

SEQ ID NO: 8411 - DNA, 705 bp, Photorhabdus luminescens
  CDS (1)..(705)
atgagtacagaatttgagcattatactgttttgattgttgaagatgagccaaaacttgggcaattgctggttgattacttgcaggcggctgattacgaaacccagtggctactgcgaggtgatgaagctgtctcccatgtacagcaacataatccagatattattttgctggatttgatgcttccaggctgtgatggcatcactatttgtcgggaaattcgccgcttctctgatgtaccgattattatggtcaccgccaaaacggaagaaattgaccgtttacttggattggaaatcggggcagatgattatatttgtaaaccttacagcccacgtgaaattgtcgcgcgagttaaaacgattcttcgtcgctgttaccgaccacaagatattgtcaaacaaagcgatttacacattgatgaagcctgtttccaggcgcgttaccgcgataaaatactggatttgaccccggttgaattccggttattaaaaacgatggcaagtcgccctgggcaagtattttcccgcgataagttattgaataacctatatgatgatcaccgaatcgtgacagaccgtaccattgatagccacattaaaaatttacgccgtaaactggaacaattggataacagtaaaacattcattcgttctatttatggacttggttaccgatgggaagcagatatatgccgtttgttataa

SEQ ID NO: 8412 - protein, 234 aa, Photorhabdus luminescens
MSTEFEHYTVLIVEDEPKLGQLLVDYLQAADYETQWLLRGDEAVSHVQQHNPDIILLDLMLPGCDGITICREIRRFSDVPIIMVTAKTEEIDRLLGLEIGADDYICKPYSPREIVARVKTILRRCYRPQDIVKQSDLHIDEACFQARYRDKILDLTPVEFRLLKTMASRPGQVFSRDKLLNNLYDDHRIVTDRTIDSHIKNLRRKLEQLDNSKTFIRSIYGLGYRWEADICRLL

SEQ ID NO: 8413 - DNA, 741 bp, Gloeobacter violaceus
  CDS (1)..(741)
atgccacgtgtgcttgtcatagacgacgaccctgcaattctggaacttgtcgctttcaacctggagatgtccgggtacgaggtgcttgaggcaccggacgggcacaagggccaggcgttcgctctgcagatgctgccggatctgattgtgctcgatttgatgctgccgcaggtcgacggtctaaccatctgtcagcgtctgcgccgcgacgagcgcaccgcagagattccgattttgatgcttacggccctcggtcagatcaaggacaaagtcggcggcttcaacgccggggccgacgattacatgaccaagccgttcgagatcgaggagctcctggtgcgggtgcgggccttgttgcggcgcaccgaccggatgccccaggcggcacgccacgccgagatcctctcgctgggacctctgacgctcattccggagcgcttcgagtgcatctggttcaacaagcccattaagctcacccaccttgaatttgagctgctgcactgcctgttgcagcggcacggccagaccgtttctccgagcgagattctgcgcgaagtctgggggtacgacccggacgacgatatcgagactatccgcgtgcacatccgccacctgcgcaccaagctcgaaccggatccgcgccacccgcagttcatcaagaccgtctacggtgccggctactgcctcgaggttccccaggctatccaagacggccagatgatccaccagcctgcggaataa

SEQ ID NO: 8414 - protein, 246 aa, Gloeobacter violaceus
MPRVLVIDDDPAILELVAFNLEMSGYEVLEAPDGHKGQAFALQMLPDLIVLDLMLPQVDGLTICQRLRRDERTAEIPILMLTALGQIKDKVGGFNAGADDYMTKPFEIEELLVRVRALLRRTDRMPQAARHAEILSLGPLTLIPERFECIWFNKPIKLTHLEFELLHCLLQRHGQTVSPSEILREVWGYDPDDDIETIRVHIRHLRTKLEPDPRHPQFIKTVYGAGYCLEVPQAIQDGQMIHQPAE

SEQ ID NO: 8415 - DNA, 705 bp, Gloeobacter violaceus
  CDS (1)..(705)
atggatgcaacgatgcgccaccagacggtactggtggtcgacgacgcagaactcatccgcgaaacggtgggcatggcccttggcgaggaaggctacagcgtcgtgctggccgaggacggccgccaggcgctcgatttggtccgcaactccgataaagtcgatttgatcgtgctcgacttgatgttgccccatctcaacggccttgatctgtgccgtttgctgcgccgcgagggtaacgccgtgccgattttgatgctcaccgccaagggcaccgagaccgaccgggtcgtgggcctcgaagtgggtgccgacgactatctacccaagccctttgggatgcgcgagctgattgcccgctgccgggcggtgctgcgccgccatacccgcacccagacccaggacaacagcgctgtcctgcgctgcggcgatctgtgcatgaatacgcaagagtgccgggtgcgcgtgcgcgacgtcgaagtcgatctttctcctaaagaatttcgtctgttggaactattcatgcgcaacccgcgccgggtatggtcgcgcgagcagctcatcgagcgggtctggggaccggatttcatgggcgacagcaaaaccgtcgatgtccatattcgctggctgcgcgagaagctcgaggccgatcccagccatcccgaatatctggtgacggtgcggggcttcggctaccgcttcggctaa

SEQ ID NO: 8416 - protein, 234 aa, Gloeobacter violaceus
MDATMRHQTVLVVDDAELIRETVGMALGEEGYSVVLAEDGRQALDLVRNSDKVDLIVLDLMLPHLNGLDLCRLLRREGNAVPILMLTAKGTETDRVVGLEVGADDYLPKPFGMRELIARCRAVLRRHTRTQTQDNSAVLRCGDLCMNTQECRVRVRDVEVDLSPKEFRLLELFMRNPRRVWSREQLIERVWGPDFMGDSKTVDVHIRWLREKLEADPSHPEYLVTVRGFGYRFG

SEQ ID NO: 8417 - DNA, 738 bp, Gloeobacter violaceus
  CDS (1)..(738)
atggtgggcaacttggacaaccgcaaagaaaagattcttgttgtcgacgacgaggccagcatccgccgcatcctggagacccgtctgtcgatgattggctacgacgtggtcacggctgccgacggtgaagaggcgctcgaagtcttcagccgcgagcacccggacctggtcgtgctcgatgtgatgatgccgaagctggacggctacggcgtctgccaggaactgcgcaaggactccgacgtcccgattatcatgctgaccgccctgggcgacgtggccgaccggatcacgggtctggagctgggagcggacgactacgtcgtcaagcccttctcgcctaaggaactggaggcgcgcatccgctcggtcctgcgccgggccgaccgcgacaccgcgagcggcatcccgagttcgggcgtcattcacgtgggcgatctcaagatcgacaccaacaagcgccaggtctacaagcgcggcgagcgcattcgcctgaccggcatggaattttcgctgttggagctggtggtcagccgctccggcgagcccttttcgcgctcggagatccttcaagaagtttggggctacacgcccgagcgccacgtagacacccgcgtggtcgatgtgcacatctcgcgactgcgctccaagctcgaggacgacccgtccaacccggaactgatcctcactgcccgcggcaccggctatctgttccagcgcatcaccgaacccaaagaatag

SEQ ID NO: 8418 - protein, 245 aa, Gloeobacter violaceus
MVGNLDNRKEKILVVDDEASIRRILETRLSMIGYDVVTAADGEEALEVFSREHPDLVVLDVMMPKLDGYGVCQELRKDSDVPIIMLTALGDVADRITGLELGADDYVVKPFSPKELEARIRSVLRRADRDTASGIPSSGVIHVGDLKIDTNKRQVYKRGERIRLTGMEFSLLELVVSRSGEPFSRSEILQEVWGYTPERHVDTRVVDVHISRLRSKLEDDPSNPELILTARGTGYLFQRITEPKE

SEQ ID NO: 8419 - DNA, 717 bp, Gloeobacter violaceus
  CDS (1)..(717)
atgccgccgtctccgggtgtaaccatgccgaacgccgctatcctcgtcgtcgaagacgacccgctcattcttgagaccattcgccgctacctcgaacacgcagggcaccgttgccattgcgccgccgacggttgggaggccgaccggctcgccctgcgccaccgcccggatctggtggtgctcgactggatgctgccgggcgtggacggtctggcgctgtgcgagcgctggcgcaaaggggagtacttcgcgcctgtgttgatgctcacggcgcgcaccgaggaggaccaccgcgtgcgcgctctggcgggcggggcagacgactacctggacaaacctttctctgcaaaggaactggtggcccgggtgcaggccctgctgcgccgcgcctacgccagcggttaccgcgactgcagccccaaaaacggcctgctggtcgatcgcaacacccgtcaggtgcagctgcacggtcgcccgatcgacctgcgggcccgggaattcgacctgctcgcccagttggccgatcaccccggccgggtgtactcgcgcgacgaactgctcgagcgggtctggggctacgacttcgaaggcggtcaccggacgatcgacgtgcacgtgcgcaagctccgcgagaagctcgagccggatcccacccgcccggtctatgtgctcaccgtctggggtgtgggttacaaattcgcgggaccgccgcggtga

SEQ ID NO: 8420 - protein, 238 aa, Gloeobacter violaceus
MPPSPGVTMPNAAILVVEDDPLILETIRRYLEHAGHRCHCAADGWEADRLALRHRPDLVVLDWMLPGVDGLALCERWRKGEYFAPVLMLTARTEEDHRVRALAGGADDYLDKPFSAKELVARVQALLRRAYASGYRDCSPKNGLLVDRNTRQVQLHGRPIDLRAREFDLLAQLADHPGRVYSRDELLERVWGYDFEGGHRTIDVHVRKLREKLEPDPTRPVYVLTVWGVGYKFAGPPR

SEQ ID NO: 8421 - DNA, 690 bp, Chromobacterium violaceum
  CDS (1)..(690)
atggccgccaatattctgcttgtcgaagacgaaccggcgattcaggagctgatcgccttcaacctggcccaggccggccaccatgtgctgcgcgccggcaccgcggaagcggcgctgacgctggtgaggaacgccttgcccgatctggtgctgctggactggatgctccccggcgccagcggcatcgacgtcgccaagcgcctgcgcgccgacgagcggacccgccacatccccatcatcatgctgactgcccgttccgacgagcaggacaaggtcgccggcctggagaccggcgccgacgactacatcaccaagccgttctcgccgcgcgagctcctggcccgcatcaaggcggtgctgcgccgccgcgcgccgcagatgaccgacgacgcggtcgacgtgcagggcctgcggctggacccggtgacccaccgcgtcaccggcaacggcagcgtgatcgagctcggccccaccgaattccgcctgctgcacttcttcatgacccatccggagcgcgtccactcccgcgcccagctgctcgaccaggtgtggggcgaccacgtcttcgtcgaggagcgcaccgtggacgtgcatatccgccgcctgcgcagcgcgctggaaggcacgcagcacgacggtctgatccagaccgtgcgcggcaccggctaccgcttctccgtccagcagtaa

SEQ ID NO: 8422 - protein, 229 aa, Chromobacterium violaceum
MAANILLVEDEPAIQELIAFNLAQAGHHVLRAGTAEAALTLVRNALPDLVLLDWMLPGASGIDVAKRLRADERTRHIPIIMLTARSDEQDKVAGLETGADDYITKPFSPRELLARIKAVLRRRAPQMTDDAVDVQGLRLDPVTHRVTGNGSVIELGPTEFRLLHFFMTHPERVHSRAQLLDQVWGDHVFVEERTVDVHIRRLRSALEGTQHDGLIQTVRGTGYRFSVQQ

SEQ ID NO: 8423 - DNA, 732 bp, Chromobacterium violaceum
  CDS (1)..(732)
atggaacacaataaaatcctggtcgtcgacgacgacgctaagctgcgcgaactgctgacccgctacctgacccagcagggttacatcgtggaaacgctgcccgatcccaaggacctggaccgcaagctggcgcgcaaccgtcccgatctgatcgtgctggacgtgatgatgcccggcgaagacggcctggcggtggtgcgccggctgcgcgcccagggcgagaccctgccggtaatcatgctgaccgcgcgcggcgaggacatcgaccgcatcctgggcctggaaatgggcgccgacgactacctgcccaagcccttcaacccgcgcgagctgaccgcccgcatccagtcggtgctgcgccgccaccacgccacgccggcgctggccgcgctgcacaacgccgacgacgtggtggaattcggcgagttcgtgctcaatctcggccagcgcgagctgcgccgcgccggccagccggtctcgctgaccagcgccgaattcgcggtgctgtcggtgctggtcagccatccgcgccgcccgctgacccgcgagcagctgatggagctggcgctgggcaagggcaacggcgaatcgctggaccgcagcatcgacgtgcacatctcccgcctgcgtaaggcgctggaaagcggcgacagcgacagccagctgcgctacatccagacggtttggggctacggctacgtgttcgtgccggacggctcgcctagggagtaa

SEQ ID NO: 8424 - protein, 243 aa, Chromobacterium violaceum
MEHNKILVVDDDAKLRELLTRYLTQQGYIVETLPDPKDLDRKLARNRPDLIVLDVMMPGEDGLAVVRRLRAQGETLPVIMLTARGEDIDRILGLEMGADDYLPKPFNPRELTARIQSVLRRHHATPALAALHNADDVVEFGEFVLNLGQRELRRAGQPVSLTSAEFAVLSVLVSHPRRPLTREQLMELALGKGNGESLDRSIDVHISRLRKALESGDSDSQLRYIQTVWGYGYVFVPDGSPRE

SEQ ID NO: 8425 - DNA, 747 bp, Synechococcus sp
  CDS (1)..(747)
atgacggccacgaccccctccaaggaaacaatcctcgtggtcgatgacgaggcctcgatccgacggattctggaaacccgcttgtcgatgatcgggtacaacgtcgtcacggcctgcgacggcaccgaagcgctcgagctgttcgaaaacacggctccagatctggtggtgctcgacgtgatgatgccgaagctggacggctacggcgtctgccaggagctgcgcaaggaatccgatgtgccgatcgtgatgctgacggccctcggcgatgtggcggaccggatcacgggtcttgagctcggggccgatgactacgtcgtcaaaccgttcagcccaaaggagctggaagcccgcatccgttgcgtgctgcgtcgggtggagaaggaatccgtggctggcatccccaactcgggggtgattcaggtgtcggatctccgcatcgacaccaacaaacgccaggtgttccgggccgacgagcggatccgactgaccgggatggaattcagcctgctggaattgctggtgagtcgctccggtgagccattcaatcggggagaaattctcaaggaagtctggggatacaccccggaacgccatgtggacacccgcgtggtggatgtccacatttcgcggcttcgctccaagttggaggatgatcctgctaaccccgagttgatcctcacggctcgcggtaccggctacctgttccagcgcatcatcgactccgttgcctccgaaggaccctga

SEQ ID NO: 8426 - protein, 248 aa, Synechococcus sp
MTATTPSKETILVVDDEASIRRILETRLSMIGYNVVTACDGTEALELFENTAPDLVVLDVMMPKLDGYGVCQELRKESDVPIVMLTALGDVADRITGLELGADDYVVKPFSPKELEARIRCVLRRVEKESVAGIPNSGVIQVSDLRIDTNKRQVFRADERIRLTGMEFSLLELLVSRSGEPFNRGEILKEVWGYTPERHVDTRVVDVHISRLRSKLEDDPANPELILTARGTGYLFQRIIDSVASEGP

SEQ ID NO: 8427 - DNA, 708 bp, Synechococcus sp
  CDS (1)..(708)
atgcccgccgctgtggccaccagcagacttctcgtggtcgaggacgatgacagcatccgtgaaacggttggtgaggttcttcgtgcggagggatatgacgttctcacctgtggtgacggggctgaagctctgaatctgttcacgagtgagcccgctcagcaggtggacctgctggtgctcgacctgatgctgcccggcctgggggggttggatctttgccgtgagctgcggcgcataaacaacaacaccccgattctggtgatcagcgcccgggacagtgaaaccgaccgcgtgcttggtcttgaagtgggggctgacgactatctggtgaagccatttggcctcagagagctggtggcccgttgccgggccctgctgcgtcgggctcagcaggacccctcggttcttcccgagatctacagccacgccaacctttgcctgtacgtcaacgagtgccgcgtcacccgtgatgggaacgacctcaatctctcccccaaggagtacaagatcctcgagctcttccttcagcacccgaaacgggtctggagtcgtgatcaattgctggagaagatctggggaatcgatttcgtcggcgacacgaaaaccgtggatgttcacatccgctggctgcgggagaagatcgaggagcaaccctcttcacctgaattgatccgcacggtgcggggcttcggctaccggttcggctga

SEQ ID NO: 8428 - protein, 235 aa, Synechococcus sp
MPAAVATSRLLVVEDDDSIRETVGEVLRAEGYDVLTCGDGAEALNLFTSEPAQQVDLLVLDLMLPGLGGLDLCRELRRINNNTPILVISARDSETDRVLGLEVGADDYLVKPFGLRELVARCRALLRRAQQDPSVLPEIYSHANLCLYVNECRVTRDGNDLNLSPKEYKILELFLQHPKRVWSRDQLLEKIWGIDFVGDTKTVDVHIRWLREKIEEQPSSPELIRTVRGFGYRFG

SEQ ID NO: 8429 - DNA, 729 bp, Prochlorococcus marinus subsp
  CDS (1)..(729)
atggctgctaaagaacataaaagtttgcaaggatcaaagattcttctgatagaagatgataaaagtattaggcttactgttactgaatcattaataagtgaaggttttgaagtatcaaattttaaagatgggtctagtgctttagattttattttgggagaaggaataaaagattttgatcttatccttctggatttaatgttgccaggcttaaatgggttagagttatgcagaaaaataagaaatgaagaattatatacacctatattgattttgagtgcaaaaggaaatgaatcggatagggttcttggcttagaagtaggagctgatgattacctaacaaagccatttgggattagtgaattaattgctaggtgcagagccttactaagaaggtctaaaaggggtaaagaaaagaaacaaaaaattgaaacgataatcgaatataaaaatattaagatgtttacagaagaatgcagagtaacaaattttaatcaagaaataatattatctccaaaagaattcaaattattagaattatttatcaaaaatcctaaaagggtatggtctagggatttaatacttgaaaaaatatgggctatagattttataggagatacaaaaactgtggatgtacatgttagatggcttagagaaaaactagaagaaaatccctccgcgccaaaaattataaagactgttagaggttttggatataggttcggatga

SEQ ID NO: 8430 - protein, 242 aa, Prochlorococcus marinus subsp
MAAKEHKSLQGSKILLIEDDKSIRLTVTESLISEGFEVSNFKDGSSALDFILGEGIKDFDLILLDLMLPGLNGLELCRKIRNEELYTPILILSAKGNESDRVLGLEVGADDYLTKPFGISELIARCRALLRRSKRGKEKKQKIETIIEYKNIKMFTEECRVTNFNQEIILSPKEFKLLELFIKNPKRVWSRDLILEKIWAIDFIGDTKTVDVHVRWLREKLEENPSAPKIIKTVRGFGYRFG

SEQ ID NO: 8431 - DNA, 747 bp, Prochlorococcus marinus
  CDS (1)..(747)
atgacggccaccagcccatctaaagagacgatcctcgtggtcgacgatgaggccagcattcgtcggatcctcgaaacccgtctctcgatgatcggctatcaagtgttcacggcatgtgacggcaacgaagctctcgatatcttccacaactgtgagcctgatcttgttgtgctcgacgtgatgatgccaaagcttgatggctatggcgtttgtcaagagcttcgcaaagaatcggatgtgccgatcgtgatgctcacggcccttggagatgtcgctgacagaatcacggggcttgagctgggtgcagacgactacgtcgtcaaacccttcagccctaaggaacttgaagcgcgcatacgctgcgtgcttcgacgagtcgagaaagagcacgttgccggcatccctaactcaggggtgattcaagtggctgaactaagagtcgacaccaacaagcgacaggttttccgaggagatgagcggattcgccttaccggtatggaattcagcctgcttgagctactggtcagccgctcaggggagcctttcagtcgcggcgaaatcctcaaggaggtatggggttatacacctgaacgacatgtagacaccagagtcgtggatgttcatatttcacgtcttcgctccaaactcgaagacgatcccgccaatcccgagctgatcctcaccgctcgaggtaccggctacctgttccagcgcatcatcgactcccttgcccccgaaggactctga

SEQ ID NO: 8432 - protein, 248 aa, Prochlorococcus marinus
MTATSPSKETILVVDDEASIRRILETRLSMIGYQVFTACDGNEALDIFHNCEPDLVVLDVMMPKLDGYGVCQELRKESDVPIVMLTALGDVADRITGLELGADDYVVKPFSPKELEARIRCVLRRVEKEHVAGIPNSGVIQVAELRVDTNKRQVFRGDERIRLTGMEFSLLELLVSRSGEPFSRGEILKEVWGYTPERHVDTRVVDVHISRLRSKLEDDPANPELILTARGTGYLFQRIIDSLAPEGL

SEQ ID NO: 8433 - DNA, 744 bp, Prochlorococcus marinus
  CDS (1)..(744)
atgacggccgccagtccatctaaagaaatcatccttgttgctgatgatgaagcgagtattaggagaatcctagaaactcgcttatctatgatcggttatcaagttgtgactgcatgcaatgggaatgaagcattgcagcagttccataattgtgagcctgatttggttgtgcttgatgtaatgatgcccaaattagatggctatggagtaattcaagaattgagaaaggaatcagatgtgccgatagtaatgcttacagctttaggagatgttgcagatcgaattactggacttgaattaggagctgatgattatgtggttaagccttttagtccaaaagagcttgaggcgcggatacggtgtgtattacgccgtgtcgagaaggaacaaattgcggggctccctaattcaggtgtaatacaggtcgctgcatttcgcatagacactaataggcgcaaagtttatcgcggtgatgaacgaattaggctaactggcatggagtttagtttgcttgagcttcttgtcagtcgttctggcgaaccgtttagcagaggggagattttgaaagaagtttggggctatacacctgaaagacatgttgatacaagagtggttgatgttcatatttctagacttcgttcaaagttagaagatgatccagctaatcctgagttgatccttactgccagagggacaggttatttgtttcagcgtattgttgatcctctttcgttagatcattag

SEQ ID NO: 8434 - protein, 247 aa, Prochlorococcus marinus
MTAASPSKEIILVADDEASIRRILETRLSMIGYQVVTACNGNEALQQFHNCEPDLVVLDVMMPKLDGYGVIQELRKESDVPIVMLTALGDVADRITGLELGADDYVVKPFSPKELEARIRCVLRRVEKEQIAGLPNSGVIQVAAFRIDTNRRKVYRGDERIRLTGMEFSLLELLVSRSGEPFSRGEILKEVWGYTPERHVDTRVVDVHISRLRSKLEDDPANPELILTARGTGYLFQRIVDPLSLDH

SEQ ID NO: 8435 - DNA, 642 bp, Bordetella parapertussis
  CDS (1)..(642)
atgaacctttcgttcgcgggccacaaggtcctgcgcgcgttcgatgccgaacaggcccagaccctgatccgcgccgagctgcccgacctcatcctgctcgactggatgctgccgggggcctccggcctgtcgctggcccgcaagctgcgcgacgaagagcgcacccgcgccgtcccggtcatcatgctgacggccaagggcgccgaacaagacaaggtcgacggcctggaggcgggcgccgacgactacatcaccaagcccttctcgcccaaggagctgatggcgcgcatcaaggccgtgctgcgccgccgcgccccgcagctgaccgacgacatcatcgacgtcgctgggctgaagctggacccggtcacccaccgcctgtcgggccacagccagtcgctgtccatcgggcccaccgagttccgcctgctgcacttcttcatgacccacccggagcgggtgttttcccgctcgcagctgctcgaccaggtgtggggcgaccacgtcttcgtggaagagcgtacggtggacgtacatatccgccgcctgcgcaaggcgctggaacccagcggccacgacgcgcacgtcgagacggtgcgcggcaacggctaccggtttacagcacaggtgccggcgcgctaa

SEQ ID NO: 8436 - protein, 213 aa, Bordetella parapertussis
MNLSFAGHKVLRAFDAEQAQTLIRAELPDLILLDWMLPGASGLSLARKLRDEERTRAVPVIMLTAKGAEQDKVDGLEAGADDYITKPFSPKELMARIKAVLRRRAPQLTDDIIDVAGLKLDPVTHRLSGHSQSLSIGPTEFRLLHFFMTHPERVFSRSQLLDQVWGDHVFVEERTVDVHIRRLRKALEPSGHDAHVETVRGNGYRFTAQVPAR

SEQ ID NO: 8437 - DNA, 699 bp, Bordetella bronchiseptica
  CDS (1)..(699)
atgtccagcaccattcttgtcgttgaagacgaacccgccatccaggaactgatcgccgtgaacctttcgttcgcgggccacaaggtcctgcgcgcgttcgatgccgaacaggcccagaccctgatccgcgccgagctgcccgacctcatcctgctcgactggatgctgccgggggcctccggcctgtcgctggcccgcaagctgcgcgacgaagagcgcacccgcgccgtcccggtcatcatgctgacggccaagggcgccgaacaggacaaggtcgacggcctggaggcgggcgccgacgactacatcaccaagcccttctcgcccaaggagctgatggcgcgcatcaaggccgtgctgcgccgccgcgccccgcagctgaccgacgacatcatcgacgtcgccgggctgaagctggacccggtcacccaccgcctgtcgggccacagccagtcgctgtccatcgggcccaccgagttccgcctgctgcacttcttcatgacccacccggagcgggtgttttcccgctcgcagctgctcgaccaggtgtggggcgaccacgtcttcgtggaagagcgtacggtggacgtacatatccgccgcctgcgcaaggcgctggaacccagcggccacgacgcgcacgtcgagacggtgcgcggcagcggctaccggtttacagcacaggtgccggcgcgctaa

SEQ ID NO: 8438 - protein, 232 aa, Bordetella bronchiseptica
MSSTILVVEDEPAIQELIAVNLSFAGHKVLRAFDAEQAQTLIRAELPDLILLDWMLPGASGLSLARKLRDEERTRAVPVIMLTAKGAEQDKVDGLEAGADDYITKPFSPKELMARIKAVLRRRAPQLTDDIIDVAGLKLDPVTHRLSGHSQSLSIGPTEFRLLHFFMTHPERVFSRSQLLDQVWGDHVFVEERTVDVHIRRLRKALEPSGHDAHVETVRGSGYRFTAQVPAR

SEQ ID NO: 8439 - DNA, 720 bp, Bacillus cereus
  CDS (1)..(720)
atgaacaatcgtattttagtagttgatgatgaggaatttatcttaactttaatcgaatttaatttacaacaagctgggtttgaagttataacagcgatggatggagaaatggcgcttcaaaaagcgacaacagaacgcccagatttaattatattagatttaatgcttccgaaaatggatggtatggaagtgtgtaaagaattacgattgcagcgcgttatgacgccgattttaatgttaacggcaaaagatgatgagtttgataaggtgctaggccttgaacttggggcggatgattatatgacaaagccatttagtccaagagaagttgttgctcgtgtgaaggcgattttgcgtcgtacgaaattacaacaagaagaacaagttgcagaagcgccagatgaagatagcatcacaattgcagaacttaaaattttaccggaattttatgaggcttatttccaaggaagaaagcttgaattaacaccaaaagaatttgaactacttgtgtatcttgcgaaaaataaaagtcgcgtgttaacacgtgatcaattactaagtgctgtatggaattacgattttgctggtgatacacgaattgttgatgttcatattagccatttgcgcgataaaattgaacaaaatacgaaaaaaccgacgtacattaaaacgatacgtggtttaggatataaattagaggagccaaaagggaatgaataa

SEQ ID NO: 8440 - protein, 239 aa, Bacillus cereus
MNNRILVVDDEEFILTLIEFNLQQAGFEVITAMDGEMALQKATTERPDLIILDLMLPKMDGMEVCKELRLQRVMTPILMLTAKDDEFDKVLGLELGADDYMTKPFSPREVVARVKAILRRTKLQQEEQVAEAPDEDSITIAELKILPEFYEAYFQGRKLELTPKEFELLVYLAKNKSRVLTRDQLLSAVWNYDFAGDTRIVDVHISHLRDKIEQNTKKPTYIKTIRGLGYKLEEPKGNE

SEQ ID NO: 8441 - DNA, 678 bp, Bacillus cereus
  CDS (1)..(678)
atgaacaaaacggtattgcttgttgaagatgaaagaagattacgtgaaattgttagtgattattttcgtaatgaaggctttgaagtaatcgaagcagaagatggaaaaaaagcgctagagttatttgcagagcatgaaattgatttaattatgttagatattatgttaccggaaatagatggatggtctgtttgtagaagaattagaaaagaatcagcagtaccaattattatgttgacagcgcgttcggatgaggatgatacattgctaggtttcgaattaggtgcagacgagtatgtaacgaaaccatttagcccgaaagtattagtagctcgtgcaaagacgttattgaaacgtgcggatggtgcggtaggagtagcggaagaaaatgctatgtctttagctggaatagaagtgaatcgtctatctagaactgttttagtagatggagaagaaattatattgacacataaagaatttgaacttcttgtgtatttaatggagaacaaaggaattgtgttatcacgtcaacatttattagaccagttatggggatatgactattacggtgatgaccgaacggttgatacccatattaaaaaacttcgaaataagctaggagataaagcgaagcatatcggtactgttattcgagttggttataaatttgaagaataa

SEQ ID NO: 8442 - protein, 225 aa, Bacillus cereus
MNKTVLLVEDERRLREIVSDYFRNEGFEVIEAEDGKKALELFAEHEIDLIMLDIMLPEIDGWSVCRRIRKESAVPIIMLTARSDEDDTLLGFELGADEYVTKPFSPKVLVARAKTLLKRADGAVGVAEENAMSLAGIEVNRLSRTVLVDGEEIILTHKEFELLVYLMENKGIVLSRQHLLDQLWGYDYYGDDRTVDTHIKKLRNKLGDKAKHIGTVIRVGYKFEE

SEQ ID NO: 8443 - DNA, 690 bp, Bacillus cereus
  CDS (1)..(690)
atgtcaaaaattttagttttagaagatgaattaacgatccgtagctttattgttttaaatttaaaacgtgctggattttatgtaatagaagctactactggagaagaagcgttacaaattttgagtgaacaaactgttgatatagcactgctggatgtaatgttaccggggattgatggtttagaggtttgtaaggctatcaggaaagaaaataaaaaaatgggtattattatgttaaccgcacgtgtacaagatgaagataaggtgcaaggactaggaatgggtgcagatgattatattgcaaaaccgtttagtccagtagtattaactgcacgtatacagtctttattaagaagaatagaagtacatgaagaaaaaacgaatattgttacgtcaggtccattttcgttaaatattatagaagaaagattgtataaagatggacaattagtcgatttaacacctacagagtatatgatattacagtatttaatgaatcaggcttcaaagccagtttcgcgtgatgaaattttaaatatgatttggggaaccaattacgtaggtgagacgaaagtagtagatgtaaatatgagacggttacgtcaaaagatagaatgtaatccatcagaacctgaatttattcttacggtgtggggaaaaggatatgtgtggaaggaaagtatgagatga

SEQ ID NO: 8444 - protein, 229 aa, Bacillus cereus
MSKILVLEDELTIRSFIVLNLKRAGFYVIEATTGEEALQILSEQTVDIALLDVMLPGIDGLEVCKAIRKENKKMGIIMLTARVQDEDKVQGLGMGADDYIAKPFSPVVLTARIQSLLRRIEVHEEKTNIVTSGPFSLNIIEERLYKDGQLVDLTPTEYMILQYLMNQASKPVSRDEILNMIWGTNYVGETKVVDVNMRRLRQKIECNPSEPEFILTVWGKGYVWKESMR

SEQ ID NO: 8445 - DNA, 678 bp, Bacillus cereus
  CDS (1)..(678)
atgatacctaaaattttaatagtagacgacgatccacacattagagaactcgtttctgtatttttagaacgagaaggttttcaaacatatgaggcaattgatggagtagatgcacttcagaaaatggatgacgtaaaagtcgatatggttattcttgatatcatgatgccaaatatggatggatttgatgtatgttttgaattaagaaaatactatgatatcccggttctgatgctaactgccaaaggagaaacatcacaaaaagtaaaaggatttcaccttgggacagatgattatcttgtaaaaccatttgatcctatagaactagtagtgagagtaaaggcattattgaaacgttaccaaattacagtttcgcaatcgattcaagttggaaatgtattattaaatcgtaaaacattcgaagttacatctggagaacaaacggttacgttaccgttaaaagaatttgagctgctctttactttaggggctaaatcgggaagaacttgttcgagagagcaattaattgaagaaatatggggatatgattttgaagggaatgaacgtacactagacgttcatattaatcggttacgtgagaagtttcaagaagagcaatcgaaatttagtattaaaacaataagaggattagggtatcgcttagaggtaagtaaatga

SEQ ID NO: 8446 - protein, 225 aa, Bacillus cereus
MIPKILIVDDDPHIRELVSVFLEREGFQTYEAIDGVDALQKMDDVKVDMVILDIMMPNMDGFDVCFELRKYYDIPVLMLTAKGETSQKVKGFHLGTDDYLVKPFDPIELVVRVKALLKRYQITVSQSIQVGNVLLNRKTFEVTSGEQTVTLPLKEFELLFTLGAKSGRTCSREQLIEEIWGYDFEGNERTLDVHINRLREKFQEEQSKFSIKTIRGLGYRLEVSK

SEQ ID NO: 8447 - DNA, 672 bp, Bacillus cereus
  CDS (1)..(672)
atgaataaatatagagtgctagttgtagatgatgaaagtgatatgagacagcttgttggaatgtatttggataactttggatatgagtggggagaagctgagaatggaaaagaggctcttaaaaaactagaaacggatcattatgatttcgttgtattagatataatgatgccagaaatggatggactttcagtttgtaaagaaattagaaaaacgtcagatgtgccgattatatttttaacggcaaaaggtgaagagtggaatagggtgaacggcttacgtatgggagcagatgactatattgtaaaaccgtttagtcctggtgaattggttgcccgtatggaagctgtgctaagaagatatacaaagcaagaacagcaagaagagattcaatttggaccaattcttatcaatgaaaaaagtagacgaatagaggcggatggtgagtcgatttctcttactgtaaaagagtttgatttattatattttctttgccaacatacaggacaagtatttagccgggagcaattacttgaaaaggtatggggatatgattatgccggaagtacaagaacggtagatacgcatgtgaaaacgatgcgcttgaagcttggagaaagtggaaactacattcaaactgtttggggtgtaggctataaatttgaggtgtaa

SEQ ID NO: 8448 - protein, 223 aa, Bacillus cereus
MNKYRVLVVDDESDMRQLVGMYLDNFGYEWGEAENGKEALKKLETDHYDFVVLDIMMPEMDGLSVCKEIRKTSDVPIIFLTAKGEEWNRVNGLRMGADDYIVKPFSPGELVARMEAVLRRYTKQEQQEEIQFGPILINEKSRRIEADGESISLTVKEFDLLYFLCQHTGQVFSREQLLEKVWGYDYAGSTRTVDTHVKTMRLKLGESGNYIQTVWGVGYKFEV

SEQ ID NO: 8449 - DNA, 708 bp, Bacillus anthracis
  CDS (1)..(708)
atgatgggaaagaaaattttagtagttgatgatgaaaagccgattgcagatattttgaagttcaacctagaaaaagaaggttttgaaattgtaatggcacacgatggtgatgaagcgattgaaaaagcgactgaagaacagccagatatggttttattagatattatgctaccaggtaaggatggcttagaggtttgccgtgaaatacgtaaaagctcagaaatgccgattattatgcttacagcgaaggactctgaaatcgataaagtattaggtttggagcttggggcagatgattatgtaacgaagccatttagtacgagggaattacttgctcgcgtgaaggcgaatttacgtcgccatcagcaaggtggtgctgcagaaaaagaagaaaatacggaaatggttattgggccaattgttatcaatcccaatgcgtatagtgtaacgaaacgtgaggaaaatattgagcttacacaccgtgaatttgagctgctgcattatttagcaaaacatttaggacaagttatgacacgcgaacatttattgcaaacagtttggggttatgactactttggagatgtacgtacagtggatgtaacagtacgtcgtctacgtgaaaaaattgaagataatccaagtcatcctacattaattgtcactagacgtggagtagggtattacttgcgtgacccagagcaggaatag

SEQ ID NO: 8450 - protein, 235 aa, Bacillus anthracis
MMGKKILVVDDEKPIADILKFNLEKEGFEIVMAHDGDEAIEKATEEQPDMVLLDIMLPGKDGLEVCREIRKSSEMPIIMLTAKDSEIDKVLGLELGADDYVTKPFSTRELLARVKANLRRHQQGGAAEKEENTEMVIGPIVINPNAYSVTKREENIELTHREFELLHYLAKHLGQVMTREHLLQTVWGYDYFGDVRTVDVTVRRLREKIEDNPSHPTLIVTRRGVGYYLRDPEQE

SEQ ID NO: 8451 - DNA, 672 bp, Bacillus anthracis
  CDS (1)..(672)
atgaagatacttgtagtggatgatgagtcgagtattcgtaatttgattcggatgcagcttgagatggaaggatatgaagtgctcacggcggctgatgggagagaagttttagagagatggaatgaagggccggatgttttgattttggatgttatgcttccagatacagatgggtatgaattacttcgtttgttccgtgagaaggatagggatattccagtactcatgttaactgcgaagagtcaaatgaatgataaattgcttggtttgcagctgggcgctgatgattacgtgacgaagccatttaattatgcggagcttattcttcgggtcaagaatatgacgcggcgtgtgaagaagaaagaggtaacggtaagtcatgaagtaatcgaggcaggagagataacgatctgtcctaaggaaagaaaagtgcatgtgagtgaacaagagattcagttaacgtacagagagtttaatttatgtcagttgtttgtttctaatccgcagcgtgtatttatgagagatgagttacttgagaaagtatggggatttgagtatatcggaaatacgagagcggttgatattatggtgcaaagattgcggaagaagttagggaatagcggggaatatattaagacaatttatggcgttggctataaactagattgttaa

SEQ ID NO: 8452 - protein, 223 aa, Bacillus anthracis
MKILVVDDESSIRNLIRMQLEMEGYEVLTAADGREVLERWNEGPDVLILDVMLPDTDGYELLRLFREKDRDIPVLMLTAKSQMNDKLLGLQLGADDYVTKPFNYAELILRVKNMTRRVKKKEVTVSHEVIEAGEITICPKERKVHVSEQEIQLTYREFNLCQLFVSNPQRVFMRDELLEKVWGFEYIGNTRAVDIMVQRLRKKLGNSGEYIKTIYGVGYKLDC

SEQ ID NO: 8453 - DNA, 690 bp, Bacillus anthracis
  CDS (1)..(690)
atgaaaagaattttactaatagaagatgaagtaagcattgcagaattacagcgagattatttagaaattaatgattttcaagttgatgtagaacattcaggagaaacaggtttacaaatggccctgcaagaagactacgatttaattattttagatattatgcttccgaaaatgaatggatttgaaatttgtaagcaaattcgagctataaaagatattccgattctacttgtttcagcaaaaaaagaagatatagataaaattcgcgggctcggattaggagcggatgattatataacgaaaccgtttagcccgagtgagctagtagcaagagtaaaagcccatatttctcgttatgaaagattattaggaaatgtaagtaagcaacgcgatacgctatatattcacggaatctctattgatcaaagggcgaggaaagtttttataaacaatgaagaaatcgcctttacaacgaaagaatttgatttattaacattctttgtcacaaacccaaaccaagtattaaataaagaacagttatttgaacgcatttggggattagactccgctggtgatttagcaactgttgtcgttcatattagaaagttacgtgaaaaaattgaaagagatcctgctcacccgcaatatattgaaacagtgtggggggctggttatcgttttaatgtgtag

SEQ ID NO: 8454 - protein, 229 aa, Bacillus anthracis
MKRILLIEDEVSIAELQRDYLEINDFQVDVEHSGETGLQMALQEDYDLIILDIMLPKMNGFEICKQIRAIKDIPILLVSAKKEDIDKIRGLGLGADDYITKPFSPSELVARVKAHISRYERLLGNVSKQRDTLYIHGISIDQRARKVFINNEEIAFTTKEFDLLTFFVTNPNQVLNKEQLFERIWGLDSAGDLATVVVHIRKLREKIERDPAHPQYIETVWGAGYRFNV

SEQ ID NO: 8455 - DNA, 717 bp, Bacillus anthracis
  CDS (1)..(717)
atggaaaatgaatcaagaattttaattgtagacgatgaggatcgtattcgtcgtttgttgaaaatgtatttagaaagagaacaatacacaattgaagaagcagacaatggtgatacagctttagaaatggcgttgcaaaatgattatgatttaatcctattagatcttatgatgcctggtaaagatggtattgaagtatgtaaaggggttcgtgagaagaaagcaacgccaattattatgttgacagcaaaaggtgaagaagtaaatcgagtacaagggtttgaggtaggaactgatgattatattgtgaaaccatttagcccacgtgaagtagtgcttcgagtgaaagcggtcttacgccgttctgtaccaacaacattctttacacaagatacaacgacaaaagatgttactgtgttccctcatttaacaattgataatgatgcacaccgtgttacagcagatgggaatgaagtgaatttaacaccgaaagagtacgaattactattattcttagcgaaagcgcctgataaggtatttgatcgtgagcaattgttaaaagaagtatggcaatatgaattcttcggagatttacgtacagttgatacgcatgtaaagcgtttacgtgagaagttaagcaaaaaatcaccagatgctgcgaagatgattgttaccgtttggggcgtaggttataagtttgaggttgtgaacgactga

SEQ ID NO: 8456 - protein, 238 aa, Bacillus anthracis
MENESRILIVDDEDRIRRLLKMYLEREQYTIEEADNGDTALEMALQNDYDLILLDLMMPGKDGIEVCKGVREKKATPIIMLTAKGEEVNRVQGFEVGTDDYIVKPFSPREVVLRVKAVLRRSVPTTFFTQDTTTKDVTVFPHLTIDNDAHRVTADGNEVNLTPKEYELLLFLAKAPDKVFDREQLLKEVWQYEFFGDLRTVDTHVKRLREKLSKKSPDAAKMIVTVWGVGYKFEVVND

SEQ ID NO: 8457 - DNA, 723 bp, Nitrosomonas europaea
  CDS (1)..(723)
atgtctgcaacagttctggtagtggaagatgaatcggcgattcaggagctgatcgcctataacctgcgcaatgcaggctataccgctgtatgtacaaacagtgccgagcaggcggcagccatggtgaatgaggtgttgcccgatctggtattgctggactggatgcttcctgggaaaagcggtattgagctggcgcgatcgctgcgacgcgatccgcgtaccaaaccgattcccgtcatcatgctgactgctcgagtggatgagagagataaggtaatcggattggaaaccggggcggatgattacgttaccaaaccgttctccccgcgtgagttgattgcccggataaaagcagtattacgccggagcctgcctgaagcttccgatgaaattctcgatatcgggggggtacagatcaacccgatgacacaccgggtgaccgttaccgatctgaacgatggcacgcacgagaaagagttgctgctcagtcctaccgaataccgtctgttgtattttctgatggcgcatgctgaacgtgtgcatacccgcgcccagctactggatcgggtgtggggagatcatgtttttgtcgaagatcgtacggttgatgtgcatatacgccggttgcgcaaggcgctggatgtagcaggaaaagctgatctcgtgcagacagtcagaggggcagggtatcgtttttccacgcgcggtgagagtgaactctga

SEQ ID NO: 8458 - protein, 240 aa, Nitrosomonas europaea
MSATVLVVEDESAIQELIAYNLRNAGYTAVCTNSAEQAAAMVNEVLPDLVLLDWMLPGKSGIELARSLRRDPRTKPIPVIMLTARVDERDKVIGLETGADDYVTKPFSPRELIARIKAVLRRSLPEASDEILDIGGVQINPMTHRVTVTDLNDGTHEKELLLSPTEYRLLYFLMAHAERVHTRAQLLDRVWGDHVFVEDRTVDVHIRRLRKALDVAGKADLVQTVRGAGYRFSTRGESEL

SEQ ID NO: 8459 - DNA, 690 bp, Streptomyces avermitilis
  CDS (1)..(690)
atgatgtcgtttatgaagggacgagtccttgtcgtcgatgacgacaccgcactggccgagatgctcggcattgtgttgcgtggtgaaggttttgagccgtcttttgtagccgacggcgacaaggcgctggccgctttccgtgagtccaagcccgatcttgtgctcctggacctgatgctgcccggccgggacggtatcgaggtgtgccgcctgatcagggcggagtccggggtgccgatcgtgatgctcacggccaagagcgacaccgtcgatgtcgtggtgggcctggagtcgggcgcggacgactacatcgtgaagccgttcaagccaaaggagctggtggcccgtatccgggcgcggctgcggaggtccgaggagccggcgcccgagcagctcggcataggtgacctggtcatcgatgtggcgggtcactccgtgaagcgggacgggcagtcgatcgcgctgacgccgctggagttcgatctgctggtggcgctggcccgcaagccgtggcaggtgttcacgcgtgaggtcctgctcgagcaggtctggggctaccggcacgcggcggacacccgcctggtcaacgtgcatgtacagcggctgcgctccaaagtcgagaaggacccggagcggccggagatcgtggtgaccgtccgtggcgtcggttacaaggccggaccgagctga

SEQ ID NO: 8460 - protein, 229 aa, Streptomyces avermitilis
MMSFMKGRVLVVDDDTALAEMLGIVLRGEGFEPSFVADGDKALAAFRESKPDLVLLDLMLPGRDGIEVCRLIRAESGVPIVMLTAKSDTVDVVVGLESGADDYIVKPFKPKELVARIRARLRRSEEPAPEQLGIGDLVIDVAGHSVKRDGQSIALTPLEFDLLVALARKPWQVFTREVLLEQVWGYRHAADTRLVNVHVQRLRSKVEKDPERPEIVVTVRGVGYKAGPS

SEQ ID NO: 8461 - DNA, 750 bp, Streptomyces avermitilis
  CDS (1)..(750)
atgcagcagccgtacgaattccggggggccgaggcggtggagcggggcgccggagccggagcccgcgtgctcgtcgtcgacgacgaccccaccgtcgccgaggtcgtctccggctacctcgaccgcgccgggtacgtcgtggaccgggccgaggacggccccaccgcgctcgcccgcgccgcggcgcactggcccgacctggtggtgctggacctgatgctgcccgggatggacggcctggaggtgtgccggcggatgcgcggccgcgggcccgtgccggtcatcatgctcaccgcccgcggcgacgaggacgaccgcatcctcgggctcgaggtgggcgccgacgactacgtcaccaagcccttcagcccgcgggagctggtcctgcgggtggagtccgtcctgcgccgcacccggcccgtcaccgccccgcgccccctgcacgcgtccggtctcgccctcgaccccgcggcccgccgcgccaccaaggacggcgaggaactcgccctgaccatccgtgagttcgacctcctcgccttctttctccgccatcccggccgggcgttcagccgcgaggacctgatgcgcgaggtgtggggctgggacttcggcgacctgtcgacggtcaccgtccacgtacgccggctccggggcaaggtcgaggacgacccggcgagaccccgtctgatccagacggtgtggggcgtcggataccgcttcggcaccacgccccgccaggaggcggtctga

SEQ ID NO: 8462 - protein, 249 aa, Streptomyces avermitilis
MQQPYEFRGAEAVERGAGAGARVLVVDDDPTVAEVVSGYLDRAGYVVDRAEDGPTALARAAAHWPDLVVLDLMLPGMDGLEVCRRMRGRGPVPVIMLTARGDEDDRILGLEVGADDYVTKPFSPRELVLRVESVLRRTRPVTAPRPLHASGLALDPAARRATKDGEELALTIREFDLLAFFLRHPGRAFSREDLMREVWGWDFGDLSTVTVHVRRLRGKVEDDPARPRLIQTVWGVGYRFGTTPRQEAV

SEQ ID NO: 8463 - DNA, 711 bp, Enterococcus faecalis
  CDS (1)..(711)
atgaaaaaagttcttgtcgtcgatgatgaaccatcgattttaactttgttaacctttaatttggaaaaagaaggctatcaggtgactacttccgaagatggtaaaaacggcttcgaattagctttgtctaatcaatatgattttataattttagatgtaatgcttcctggtatggatggcttagaaattaccaaagcacttcgtcgagaaaaaattgacacgcctattttgattttaactgccaaagatgaacaagtagataaaatcatcggcttagaaattggggcagatgattatttaacaaaaccttttagtcccagagaagtcctagcacgcatgaaagctattttccgtcgtttaaaacctaccacgaccgaaacgcttcaagaggacacacctaaagctccgcttgtgattggcgagattcgtgtggatgaacaaaattatgaagtctttgtgcgcaatcagcccattgagctaacaccgaaagaatttgaattactcgtttacttcatgaaacgcaaagatcgggtcattaatcgggaaaccttgttggaacgaatttggcaatatgacttcgctggacaaagtcgcatcgtcgatgtccacattagtcatttacgtgataaaatcgagcccgatcccaaacggcccgtttacttagtaactgtccgtggctttggctaccgttttcaggagccaaaacgatga

SEQ ID NO: 8464 - protein, 236 aa, Enterococcus faecalis
MKKVLVVDDEPSILTLLTFNLEKEGYQVTTSEDGKNGFELALSNQYDFIILDVMLPGMDGLEITKALRREKIDTPILILTAKDEQVDKIIGLEIGADDYLTKPFSPREVLARMKAIFRRLKPTTTETLQEDTPKAPLVIGEIRVDEQNYEVFVRNQPIELTPKEFELLVYFMKRKDRVINRETLLERIWQYDFAGQSRIVDVHISHLRDKIEPDPKRPVYLVTVRGFGYRFQEPKR

SEQ ID NO: 8465 - DNA, 705 bp, Enterococcus faecalis
  CDS (1)..(705)
atgaagaaaattttagtagttgatgacgagaagccaatttcagagatcgttaaatataatttggttaaagaaggatatgaagtatttactgcttatgatggagaagaagcacttgaaaaagtggaagaagtggaaccagacttaattattttagacttaatgctccctaaaatggatggcttagaagtcgcgcgagaagtgcgcaaaacacatgatatgccaatcattatggtgactgccaaagattctgaaattgataaggttttaggattggaattaggagccgatgactatgtaacgaaaccattttcaaatcgtgaattagttgctcgtgtaaaagccaatttacggcgaggtgcaaccaatgcgaaagaagccgaggtgacaacacaatctgaattaacgattggtgatttaaccattcatcctgatgcatacatggtctcaaaacggggtgaaaaaattgaattaacccaccgtgaatttgagttactttattacttagcaaaacatatcggacaagtgatgactcgtgaacatttattacaaaccgtttggggttatgattattttggggatgtgcggacagtggacgtaaccgtacgtcgtttaagagaaaaaattgaagatagtccaagtcatccaacgtatttagttactcgtcgtggggttggttattatctaagaaatcctgaacaggagtaa

SEQ ID NO: 8466 - protein, 234 aa, Enterococcus faecalis
MKKILVVDDEKPISEIVKYNLVKEGYEVFTAYDGEEALEKVEEVEPDLIILDLMLPKMDGLEVAREVRKTHDMPIIMVTAKDSEIDKVLGLELGADDYVTKPFSNRELVARVKANLRRGATNAKEAEVTTQSELTIGDLTIHPDAYMVSKRGEKIELTHREFELLYYLAKHIGQVMTREHLLQTVWGYDYFGDVRTVDVTVRRLREKIEDSPSHPTYLVTRRGVGYYLRNPEQE

SEQ ID NO: 8467 - DNA, 747 bp, Coxiella burnetii
  CDS (1)..(747)
atgcgttataatagtgaaattcttaggaccaatgagtttatatcagtgagaaaaataaaattgttaattatcgaagatgaaatcgccatccgagacatggtccgtttttcgttgccggatgagtttgaactcctcgacgcggaagacacggcaaaagcgattaaacaactggcggctcaaatccccgacctcatcttattggattggatgcttcccggcaaaagtggcattgaatttatcgaatggataaaacaaaaagaaatttggcaagatattcctattgttttgttaaccgccaaagcggaagaagaaaataaagtcagaggtttaatgagtggcgctgacgattatattacaaaacctttttcccccgatgaattaattgctaggataagagccattcttcgccgtggcccattaatttcctctaaccaggaaattaaaattggggatattaaaatcaatacagcgaaacatctcgttactgttaaagatgaacacatcgctctttcacccactgaatataaaatgcttcatttttttatgaaacatccaaataaaacctatagccgcgatcagctaattacttatatctggggcggaaatatttatatcgatgatcgtacggttgatgtccaagttcgtcgattgcgtgataaattaaaaaaatacgatcaccatcatttaattaaaacaattagaggcgctggttatcagctttcaaccgatgatacaaagaacgcataa

SEQ ID NO: 8468 - protein, 248 aa, Coxiella burnetii
MRYNSEILRTNEFISVRKIKLLIIEDEIAIRDMVRFSLPDEFELLDAEDTAKAIKQLAAQIPDLILLDWMLPGKSGIEFIEWIKQKEIWQDIPIVLLTAKAEEENKVRGLMSGADDYITKPFSPDELIARIRAILRRGPLISSNQEIKIGDIKINTAKHLVTVKDEHIALSPTEYKMLHFFMKHPNKTYSRDQLITYIWGGNIYIDDRTVDVQVRRLRDKLKKYDHHHLIKTIRGAGYQLSTDDTKNA

SEQ ID NO: 8469 - DNA, 723 bp, Shigella flexneri
  CDS (1)..(723)
atgaccgagttaccaatcgacgaaaacacaccgcgtattttgatcgtggaagatgaaccgaagctggggcagttgctcattgattatctgcgtgctgcgagctatgcgccgacgcttatcagccacggcgatcaggtactggcgtatgtgcgccagacaccaccggatctgatcctgttggatctgatgctccctggcaccgatggcctgacattatgccgggaaattcgtcgtttttccgatgttccgatcgtgatggtgacggcaaaaatcgaagagatcgaccgcctgctggggctggagattggcgccgatgactacatctgcaagccgtacagcccacgggaagtggtagcgcgtgtcaaaaccattttgcgccgttgtaaaccgcaacgcgaacttcagcaacaggatgccgaaagcccgttgattatcgacgaaggtcgttttcaggcttcatggcgcggtaaaatgcttgacctgacgcctgcggaatttcgtctgcttaaaacgctctctcacgaaccaggaaaagtgttctcccgcgagcaattgctcaatcatctttatgacgactaccgcgtagtaaccgaccgcaccattgacagccacattaaaaatctgcgccgcaagctggaatctctcgacgccgaacagtcatttatccgcgccgtttacggcgttggttaccgctgggaagccgacgcctgccgcatcgtttag

SEQ ID NO: 8470 - protein, 240 aa, Shigella flexneri
MTELPIDENTPRILIVEDEPKLGQLLIDYLRAASYAPTLISHGDQVLAYVRQTPPDLILLDLMLPGTDGLTLCREIRRFSDVPIVMVTAKIEEIDRLLGLEIGADDYICKPYSPREVVARVKTILRRCKPQRELQQQDAESPLIIDEGRFQASWRGKMLDLTPAEFRLLKTLSHEPGKVFSREQLLNHLYDDYRVVTDRTIDSHIKNLRRKLESLDAEQSFIRAVYGVGYRWEADACRIV

SEQ ID NO: 8471 - DNA, 693 bp, Mycobacterium bovis BCG
  CDS (1)..(693)
atgtccgtgcgaattcttgtcgttgacgacgatcgtgcggtgcgcgagtcgctgcgccggtcgctttccttcaatggctattcggtcgaactggcccacgacggggttgaggcgctcgacatgattgccagcgatcgccccgacgcgttggtcctggatgtcatgatgccgcggctggacggcctcgaggtgtgccgtcagctccgcagcaccggcgacgacctgccgattctggtgctgaccgcgcgcgactcggtgtccgagcgggtggccgggctggacgccggtgccgacgactacctaccaaagccgttcgccctcgaagagctgctggcacggatgcgggcgctgctgcgccgcaccaagcccgaggatgccgccgagtcgatggccatgaggttctccgacctgacgctggacccggtaacccgcgaagtcaaccgtggacagcgccggatcagcctgacccgcaccgaatttgcattgctggagatgctgatcgccaatccgcggcgagtgctgacgcgcagccgtatcctggaagaggtatggggattcgactttcccacctcgggcaacgcgctggaagtctacgtcgggtatctacgccgcaagaccgaggccgacggcgagccgcggctgatccacactgtgcgcggagtgggttacgtgctacgtgaaacaccaccctga

SEQ ID NO: 8472 - protein, 230 aa, Mycobacterium bovis BCG
MSVRILVVDDDRAVRESLRRSLSFNGYSVELAHDGVEALDMIASDRPDALVLDVMMPRLDGLEVCRQLRSTGDDLPILVLTARDSVSERVAGLDAGADDYLPKPFALEELLARMRALLRRTKPEDAAESMAMRFSDLTLDPVTREVNRGQRRISLTRTEFALLEMLIANPRRVLTRSRILEEVWGFDFPTSGNALEVYVGYLRRKTEADGEPRLIHTVRGVGYVLRETPP

SEQ ID NO: 8473 - DNA, 696 bp, Xylella fastidiosa
  CDS (1)..(696)
atgcaaaaacgcgtcttgattgtcgatgatgaggtggcgattcgtgacatggttgctttcgctttgcgtaagggtgaatttgaatccttgcaagctagtgatgcgcgcgaggctcaggccgttatcgcagattgcgttccggatttgattttgttggattggatgctgcctggtaccagtggcctggagttgacacgtcgttggcgtaaagcgtcgctgacccgtgaaatacctatcatcatgctgaccgcgcgtagtgaggagaacgatcgggttggtggtttggaagcgggggtggatgattatatggtcaagccgttctcggcgcgcgaactgttggcgcgcatccgcgcggtgatgcgccgtactcgtgatgatgaggaggatggtagtgttgccattggaaaattacgcattgatggtgctgcgcaccgtgtgtatgccggtcatgtgcaagtgccaattggtccgactgaataccgcttactgcattttttcatgacacattcggagcgcgtgtactcgcgtactcaacttttagatcatgtttggggtagcggcgtatatatagaggagcgcacgattgatgtgcatatccgccgtttgcgtagaacgttggagccattcggccttgacgatatggtgcagacggtacgtagtgccggttatcgcttctccggggcgatccagatctga

SEQ ID NO: 8474 - protein, 231 aa, Xylella fastidiosa
MQKRVLIVDDEVAIRDMVAFALRKGEFESLQASDAREAQAVIADCVPDLILLDWMLPGTSGLELTRRWRKASLTREIPIIMLTARSEENDRVGGLEAGVDDYMVKPFSARELLARIRAVMRRTRDDEEDGSVAIGKLRIDGAAHRVYAGHVQVPIGPTEYRLLHFFMTHSERVYSRTQLLDHVWGSGVYIEERTIDVHIRRLRRTLEPFGLDDMVQTVRSAGYRFSGAIQI

SEQ ID NO: 8475 - DNA, 690 bp, Pseudomonas syringae
  CDS (1)..(690)
atggctggcaggagcatcctgatcgttgacgacgaagcgcctattcgtgaaatgatcgccgttgcgttggaaatggctggatacgactgtattgaagccgaaaactctcagcaggcccacgcgatcatcgtcgaccgcaagcctgaccttattctgctcgactggatgctgcctggcacatccggcatcgaattggcccgacgcctcaaacgtgatgagctgaccggggatatcccgatcatcatgctcaccgccaagggcgaagaggacaacaagatccagggcctggaagtgggcgctgacgattacatcaccaagccgttttcgccccgcgaactggttgcccgcctcaaggccgtgctgcgccgggccgggccgactgacggagagtcccctatcgaagtcggcggcttgctgctcgacccgatcagccaccgcgtcaccatcgatggcaaaccggcagaaatgggcccaaccgaataccgcctgctgcaatttttcatgacccatcaggagcgcgcttacacacgtggccagctgctggatcaggtctggggcggcaacgtgtacgtcgaagagcgtaccgtcgatgtccacattcgtcgcctgcgcaaggccttgggtgatgcgtatgaaaatctggtacaaaccgtgcgcggcaccggctatcgcttttcaacgaagagctga

SEQ ID NO: 8476 - protein, 229 aa, Pseudomonas syringae
MAGRSILIVDDEAPIREMIAVALEMAGYDCIEAENSQQAHAIIVDRKPDLILLDWMLPGTSGIELARRLKRDELTGDIPIIMLTAKGEEDNKIQGLEVGADDYITKPFSPRELVARLKAVLRRAGPTDGESPIEVGGLLLDPISHRVTIDGKPAEMGPTEYRLLQFFMTHQERAYTRGQLLDQVWGGNVYVEERTVDVHIRRLRKALGDAYENLVQTVRGTGYRFSTKS

SEQ ID NO: 8477 - DNA, 729 bp, Pseudomonas putida
  CDS (1)..(729)
atgcgggccaagacaccgaatccaggagaggttttgagcatggtaggcaggaacattctgatcgtcgacgacgaagcgcccattcgcgagatgatcgccgttgccctggaaatggccggctatgactgcctggaagcggaaaactcccaacaggcccacgcgatcatcgtcgaccgcaaaccggacctgatcctgctcgactggatgctgccgggcacctccggcatcgagctggcccgccgcctgaagcgcgacgaactgaccggcgatatcccgatcatcatgctcaccgccaagggtgaagaggacaacaagatccagggcctggaagtgggcgccgacgactacatcaccaagccgttctcgccgcgtgaactggtagcgcgactgaaagccgtgctgcgccgcactggcccgagcgacagcgaggcgccgatcgaggtcggcggcctgctgctcgacccgatcagccaccgtgtgaccatcgacggcaagccggccgagatgggccctaccgaataccgcctgctgcagtttttcatgacccaccaggagcgcgcctatacccgcggccaactgctggatcaggtgtggggcggcaacgtctatgtcgaggaacgtaccgtcgacgtgcacatccgtcgcctgcgcaaggcactgggtgaagcttacgagaatctggtacaaaccgtccggggcactggctaccgtttctcgaccaagagctga

SEQ ID NO: 8478 - protein, 242 aa, Pseudomonas putida
MRAKTPNPGEVLSMVGRNILIVDDEAPIREMIAVALEMAGYDCLEAENSQQAHAIIVDRKPDLILLDWMLPGTSGIELARRLKRDELTGDIPIIMLTAKGEEDNKIQGLEVGADDYITKPFSPRELVARLKAVLRRTGPSDSEAPIEVGGLLLDPISHRVTIDGKPAEMGPTEYRLLQFFMTHQERAYTRGQLLDQVWGGNVYVEERTVDVHIRRLRKALGEAYENLVQTVRGTGYRFSTKS

SEQ ID NO: 8479 - DNA, 729 bp, Lactobacillus plantarum
  CDS (1)..(729)
atgaccatggataagattttagtggtagacgacgaaccagctatcgtcacgttattatcatataacttgaagcaggcggggtacgaagttgtgacggcgacggatggtgcggacgcgttgtcattaggcctggcccaatcatttacatgtattttgttagatttgatgttgccgaaactcgatggaatggaagtaacaaaaaagttacgacaagaaaaggttcagacgcctattattattgtgacggctaaaaatgatgagtttgataaagtgttcggcttggaattaggtgcggacgattatataaccaagccgttttcaccccgcgaagtgctcgctcggatcaaagcagttattcggcggacaacgccggacgagcccgtgacaccaccggcacccatgccgcctgctaatcgtgcggtaatgcttgttggtgatttacagattgatcaaaacaaataccgagtcgcgcgcaacgggaaaaatatcagcttgacaccaaaggaatttgaattacttgtgtattttgttgaacgagaaggtcgggttctcagtcgtgatgcgattttaaatcacgtctggggctacgactatgctagtgagacgcggatcgttgatattcacatctcacatttacgtgaaaagattgaagcagatcccaagcagccacggttgatcaggacggtccggggttttggctacgaatttgtgggtgacggccatgcataa

SEQ ID NO: 8480 - protein, 242 aa, Lactobacillus plantarum
MTMDKILVVDDEPAIVTLLSYNLKQAGYEVVTATDGADALSLGLAQSFTCILLDLMLPKLDGMEVTKKLRQEKVQTPIIIVTAKNDEFDKVFGLELGADDYITKPFSPREVLARIKAVIRRTTPDEPVTPPAPMPPANRAVMLVGDLQIDQNKYRVARNGKNISLTPKEFELLVYFVEREGRVLSRDAILNHVWGYDYASETRIVDIHISHLREKIEADPKQPRLIRTVRGFGYEFVGDGHA

SEQ ID NO: 8481 - DNA, 705 bp, Lactobacillus plantarum
  CDS (1)..(705)
atgaaaaacacgattttaattgttgaggatgaaggcagtctatctggctacttgactaaagaactacaatttgaggatttcaacgttttggtagcggctaacggtttggcagctatggaaacctaccaagcgcatcaaaacgagttgctcctcatcctgctagactggatgttgccaaaacttgacggtatggaagttcttcgccgcattcgcaaacacgatcaagtaccagtcattattatgaccgctagagattatgtcggtgataaagtcgccgggttagataatggtgccgacgactatatcaccaaaccatttgaaatcgaagaattattggcccgaatccgggttatccaacgacgcattgaaaatcaagttgaacccaatcaagtctaccaactggatgatgtccagctagatactaaagctcaccgcgttactaacgggcaggaagaagttaccttaactcaccgtgaatatgatttgctgcaattcttcctcgctcatcccgacgaagtctttacccgtgatgacttgcttgaccaagtctggggcgccgactttctcggtcagcaaaatgtcgttgacgtttatgttggttatttacgtaataaaatcacgacaaccggcgcctccccactcattcaaacggtgcgcggcgtcgggtataaactaagggagccgatgtctgatgcccaaaaataa

SEQ ID NO: 8482 - protein, 234 aa, Lactobacillus plantarum
MKNTILIVEDEGSLSGYLTKELQFEDFNVLVAANGLAAMETYQAHQNELLLILLDWMLPKLDGMEVLRRIRKHDQVPVIIMTARDYVGDKVAGLDNGADDYITKPFEIEELLARIRVIQRRIENQVEPNQVYQLDDVQLDTKAHRVTNGQEEVTLTHREYDLLQFFLAHPDEVFTRDDLLDQVWGADFLGQQNVVDVYVGYLRNKITTTGASPLIQTVRGVGYKLREPMSDAQK

SEQ ID NO: 8483 - DNA, 708 bp, Lactobacillus plantarum
  CDS (1)..(708)
atgaaaaaaatcttagtagttgatgatgaaaagcccatctctgatatcatgaaatttaatctgaccaaagaaggctatgaagttcacgttgcagctgacggagaggaagccttacaaaaagtggatgaagtccaccctgatttgattttgttagatttgatgttgcctaagatggatggcttggaagttgctcgacaagtacggaagaactatgatatgccaattatcatggtaacggcaaaggactctgaattagacaaggtgttgggcttggaactgggcgcggacgactatgtgaccaaaccgttctcaaaccgggaactcgtggctcgagtcaaagcaaatctgcggcggcaaggtacaccaagtgcccaaccagctgaagttgaagaaaattcagacattgaaattggcgatctggtgattcatccagaagcttatatggtttccaaacgcggtgaaaacatcgaattaacgcaccgtgaatttgaactgttacattacttagcccaacatatcggccaagtcatgacgcgggaacacttgttgcagacggtctggggctatgattactttggtgatgtccggacagttgatgtgaccgtgcggcggttacgtgaaaaagttgaagataacccgagtcatccaaaatggctggtgacgcggcggggcgtgggttactatctccgcaatcctgaaaatgagtag

SEQ ID NO: 8484 - protein, 235 aa, Lactobacillus plantarum
MKKILVVDDEKPISDIMKFNLTKEGYEVHVAADGEEALQKVDEVHPDLILLDLMLPKMDGLEVARQVRKNYDMPIIMVTAKDSELDKVLGLELGADDYVTKPFSNRELVARVKANLRRQGTPSAQPAEVEENSDIEIGDLVIHPEAYMVSKRGENIELTHREFELLHYLAQHIGQVMTREHLLQTVWGYDYFGDVRTVDVTVRRLREKVEDNPSHPKWLVTRRGVGYYLRNPENE

SEQ ID NO: 8485 - DNA, 699 bp, Clostridium tetani
  CDS (1)..(699)
atgtcacaagataagattttaatagtggatgatgaagagcatattagagaacttcttagatataatttagaaaaagaaggctataaaattttttgtgctgaaaatggaaaagaagctttagaaatagctaaagaaaaaaaacctacactaattttactggatgtcatgttaccacaaatggatgggtatgacgtatgcaaagaaataagaaaagataattctatatccactacacccattataatgataactgctaaaggtgaagaattagataaggtgttaggattagaacttggtgcagatgattatataacaaaacccttttccattagggaattgattgccagaataaaagctgtactgagaagaactttattaaagagtacagaggaaccttttaaatttgaaggtttaaaaatggattttgaaaaacatgaagtaatgaaagacggggaaaaagttgatttaacccttaaagaatttcaattgttagaaatacttattaaaaataaaggaagagtattaactagagaatatttattagataaaatatggggatatgaatatataggagaaactaggacagtagacgtacatataagacatttaagacagaaggtagaggatgatgataaaaaccctaagtatatagaaactattagaggagtgggatataggttcaatctaaatataaattaa

SEQ ID NO: 8486 - protein, 232 aa, Clostridium tetani
MSQDKILIVDDEEHIRELLRYNLEKEGYKIFCAENGKEALEIAKEKKPTLILLDVMLPQMDGYDVCKEIRKDNSISTTPIIMITAKGEELDKVLGLELGADDYITKPFSIRELIARIKAVLRRTLLKSTEEPFKFEGLKMDFEKHEVMKDGEKVDLTLKEFQLLEILIKNKGRVLTREYLLDKIWGYEYIGETRTVDVHIRHLRQKVEDDDKNPKYIETIRGVGYRFNLNIN

SEQ ID NO: 8487 - DNA, 702 bp, Clostridium tetani
  CDS (1)..(702)
atgaataaaaatactatcattgtagtagatgatgaaaaagaaataagggacttaatatgtatatatttagaaaatgaaggctatagagtaattaaagcagaaaatggtataaaagcattagaattattagagaaagaaaaggtagatttaataatacttgatataatgatgccaaatatggatggaattgaagcatgtactaaaattagagaagaaaaaaacatgcctataataatgttatcagctaaaacagaagatatggataaaatatggggacttactgcaggagcagatgactatatgacaaaaccatttaaccctttagaacttatagcaagggtaaaatctcaattaagaagatataaaaagtttaatgttcaaaatggttatattaatgatgatataatagaaatagatgaacttacaattaataccgcaacccacgaggttcaggttggagaaaaaaaagttagacttactcctagagagtttgatatattagaattactagctagaaataaaggaatagtatttagtatagaaaaaatatatgaaagagtttggaaagaagagttttttaaatcagataatacagttatggtacacataagaaaactaagagaaaagatagaggaaaatcctagaaaacctaagtatgtaaagactgtatggggtgtaggctataaggtagaaaagttataa

SEQ ID NO: 8488 - protein, 233 aa, Clostridium tetani
MNKNTIIVVDDEKEIRDLICIYLENEGYRVIKAENGIKALELLEKEKVDLIILDIMMPNMDGIEACTKIREEKNMPIIMLSAKTEDMDKIWGLTAGADDYMTKPFNPLELIARVKSQLRRYKKFNVQNGYINDDIIEIDELTINTATHEVQVGEKKVRLTPREFDILELLARNKGIVFSIEKIYERVWKEEFFKSDNTVMVHIRKLREKIEENPRKPKYVKTVWGVGYKVEKL

SEQ ID NO: 8489 - DNA, 741 bp, Clostridium tetani
  CDS (1)..(741)
atgtttatatatgataaattaaatatatatgtaattgtgggaggaataaaaatgattaatgggaaaatagctaaaatattaatagtagatgatgatcaaaatatatgtgaagtaataaaaatgtatttagagagtgcaggattcgatacaagagtttgccacgatggaaaggaatcacaaagtatatttatagaatacaatccagatttagttttgctagatataatgttacctagcatggacggaattgacgttttaaaatggattagaaaggaacatgaaactccggtaataatgctaacagcaaaaggagaaacttttgacaaagttctagggctggaattgggagcagatgattatatggtaaaaccttttgaaccaaaagaattattagccagggtaaaagctgttttaagaagatttaattcagataatgtaagtaaggaagcattacagtttaatggtttaacaatagatatagattcatatactgttatatacaatggaaaagaaataaagatgcctccaaaggaatttgaattattgtattatttagctagtaataaaaacagagttttcaccagagaacaattattatgtgaggtatggggatacgactacccaggagattctagaactgtagatgttcatataaaaagacttagagaaaagttggaagaaggttcaaactggcaaatagagactgtatggggtgttgggtataaatttgaggtgaaataa

SEQ ID NO: 8490 - protein, 246 aa, Clostridium tetani
MFIYDKLNIYVIVGGIKMINGKIAKILIVDDDQNICEVIKMYLESAGFDTRVCHDGKESQSIFIEYNPDLVLLDIMLPSMDGIDVLKWIRKEHETPVIMLTAKGETFDKVLGLELGADDYMVKPFEPKELLARVKAVLRRFNSDNVSKEALQFNGLTIDIDSYTVIYNGKEIKMPPKEFELLYYLASNKNRVFTREQLLCEVWGYDYPGDSRTVDVHIKRLREKLEEGSNWQIETVWGVGYKFEVK

SEQ ID NO: 8491 - DNA, 705 bp, Bradyrhizobium japonicum
  CDS (1)..(705)
atggcgcatcgcattctcatcgtcgacgacgagggccacatccgcgaggtcatccgggtcgccctgaagaaggccggcatggacgtgatcgaggcccgcgacggcaaggaggcactcgcccgctttgccgccgacaggcccgatttgatcgtgctcgacgtcggcatgcccgagttcgacggcctcgacgtctgccgcgagatacgcaaaggctccgacgtgccgatcctgttcctgtcggcgcgcgacgaggagatcgaccgcgtgctcggccttgagatcggcggcgacgactacgtgacaaagccgttcagcccgcgcgagctggtggcgcgggtcaacgtcatcctgcgccggctcagcccgcgcaatggcgaggccaaggccgggccgagcgcgctggcgcaaggtggcctgctgatcgatccggagcagcatgtggcgtcgttcgccggcacgccgctgaagctgaccgcgatcgagttcggcattctgcgcgcgttcctgacccggccgacctcggtgttcaaccgcgagcagctgatgcgcgcggcctaccaactcaacatccaggtctccgaccgcaccatcgatagccacatccgcaacatccgcgccaagctcgcggcgctttcctgcgacaacgtgatcgagaccatccacggcgtcggcttcaagctcggccgctgcgagaaagaggcatga

SEQ ID NO: 8492 - protein, 234 aa, Bradyrhizobium japonicum
MAHRILIVDDEGHIREVIRVALKKAGMDVIEARDGKEALARFAADRPDLIVLDVGMPEFDGLDVCREIRKGSDVPILFLSARDEEIDRVLGLEIGGDDYVTKPFSPRELVARVNVILRRLSPRNGEAKAGPSALAQGGLLIDPEQHVASFAGTPLKLTAIEFGILRAFLTRPTSVFNREQLMRAAYQLNIQVSDRTIDSHIRNIRAKLAALSCDNVIETIHGVGFKLGRCEKEA

SEQ ID NO: 8493 - DNA, 711 bp, Staphylococcus epidermidis
  CDS (1)..(711)
atgtcacaaaaaatattagtggttgatgatgagcaatccatcgtgaccttactaaaatataatttagaaacagcagggtatatagtcgaagtcgcttatgatggtgaagaggcattgaaaaaagttgaaacagaacaaccggaactaattgtattagacgttatgttgccaaaaaaagatggtatagaagtatgtaaaacaatcaggtctgataaaaatttagtaccgattttaatgttgacagcaaaggacgatgaatttgatcgagttttagggcttgaactaggtgccgatgactatatgacaaaaccattttcacctagagaggtagttgccagagttaaagcaatattaagacgttctcaatttgtaaatgaaattgagaaggaagatgttgatgatgaagatattatcattggttcaattagaattcgacctgaattctttgaagtctataaagaagatgaattattagaattgacgccaaaagaatttgaattgttattatatttaattgaaagacaaggaagagttattactcgagaacatatgttgaattcagtgtggaattatgaattcgctggagattctcgaattgttgatgtacatataagccacttaagagataaattggaagaaaatcctaagcaacctaaattgataaagactgtacgtggtttaggttataaactggagagacctaaagcttaa

SEQ ID NO: 8494 - protein, 236 aa, Staphylococcus epidermidis
MSQKILVVDDEQSIVTLLKYNLETAGYIVEVAYDGEEALKKVETEQPELIVLDVMLPKKDGIEVCKTIRSDKNLVPILMLTAKDDEFDRVLGLELGADDYMTKPFSPREVVARVKAILRRSQFVNEIEKEDVDDEDIIIGSIRIRPEFFEVYKEDELLELTPKEFELLLYLIERQGRVITREHMLNSVWNYEFAGDSRIVDVHISHLRDKLEENPKQPKLIKTVRGLGYKLERPKA

SEQ ID NO: 8495 - DNA, 741 bp, Staphylococcus epidermidis
  CDS (16)..(741)
gaggtagtagaaagtatgactaacgaaattttaatcgttgatgatgaagatagaattagaagattacttaaattatatttagaaagagaatcttttgaaattcatgaagcaagagatggtaaagaagcctacgagcttgctcttgaaaacaactatgcgtgcatcctcttagatttaatgcttcctgaaatggatggaattgaagttgcctctaaacttagagaacataaagatacacctatcatcatgcttactgcaaaaggtgaagaaacaaatcgtgttgaaggatttgaatcgggagcagatgattatattgttaagcctttctcacctagagaagtagtattgagagtaaaggcgttattaagacgtacacaaactgcaaacactgagcaaagcgaaccgcatgcacgcgatattattgaatttagtcatctagtgattgataatgacgctcatcgagtccttgcggatgatcaacaagtgaatctaacacctaaagagtatgaattactcatctatttagctaaaactccaaataaagtatttgatcgagaacagttacttaaagaggtttggcattacgaattttatggggacttgcgtacagtagacactcacgtcaaaagacttagagaaaagttaaatcgagtatcaagtgatgctgcacaaatgatacaaactgtgtggggtgtcggttataaatttgaggtaaaacctagtgatgaaccgactaaatag

SEQ ID NO: 8496 - protein, 241 aa, Staphylococcus epidermidis
MTNEILIVDDEDRIRRLLKLYLERESFEIHEARDGKEAYELALENNYACILLDLMLPEMDGIEVASKLREHKDTPIIMLTAKGEETNRVEGFESGADDYIVKPFSPREVVLRVKALLRRTQTANTEQSEPHARDIIEFSHLVIDNDAHRVLADDQQVNLTPKEYELLIYLAKTPNKVFDREQLLKEVWHYEFYGDLRTVDTHVKRLREKLNRVSSDAAQMIQTVWGVGYKFEVKPSDEPTK

SEQ ID NO: 8497 - DNA, 702 bp, Staphylococcus epidermidis
  CDS (1)..(702)
atggctagaaaagttgttgtagttgacgatgaaaaaccaattgctgatattttagaatttaatttaaaaaaagaaggttacgacgtatattgcgcttatgacggtaatgacgcagtagatttaatctatgaagaagaaccagatatcgtcttacttgatatcatgttacctggtagagatggtatggaagtgtgtcgtgaagtgcgtaaaaagtatgaaatgccaattatcatgctgacagcgaaagattctgaaattgataaagttttaggtcttgaattaggtgcagatgactacgtaactaaaccatttagtactcgtgaactcatcgcacgtgtgaaagcgaacttacgccgtcattattcacaaccagctcaagaagtaagtggtgcgacaaatgaaattacaattaaagatattgtgatttatccagatgcatattcaattaaaaaacgtggagaagacattgaattaacgcatcgtgaattcgagctgttccattatctttctaaacatatgggtcaagtcatgacacgtgaacacttactacaaacagtgtggggttacgattatttcggtgatgttcgtactgtggacgtaacaattcgccgtttaagagaaaaaattgaagatgatccatctcatccagaatacattgtgacacgtagaggcgttggatacttcctccaacaacatgattag

SEQ ID NO: 8498 - protein, 233 aa, Staphylococcus epidermidis
MARKVVVVDDEKPIADILEFNLKKEGYDVYCAYDGNDAVDLIYEEEPDIVLLDIMLPGRDGMEVCREVRKKYEMPIIMLTAKDSEIDKVLGLELGADDYVTKPFSTRELIARVKANLRRHYSQPAQEVSGATNEITIKDIVIYPDAYSIKKRGEDIELTHREFELFHYLSKHMGQVMTREHLLQTVWGYDYFGDVRTVDVTIRRLREKIEDDPSHPEYIVTRRGVGYFLQQHD

SEQ ID NO: 8499 - DNA, 720 bp, Yersinia pestis
  CDS (1)..(720)
atgaccgctaacatactggcagggttgatgatggcaagacgcatactggtggtggaagatgaagcaccaatccgtgagatggtgtgctttgtgttggagcaaaatggctaccaaccgttagaagccgaagattatgacagcgcggtagctcgcctgtcggagccttttcctgatttagtgctgttagactggatgttacccggcggctcgggtattcagtttattaaacatatgaaacgtgaagctttgacccgggatattccggtgatgatgctgaccgctcgtggcgaagaagaagatcgtgtgcgcggtttggaagtgggcgcagatgattatattaccaagcctttttcacctaaagagctggtagcgcggatcaaagcggtaatgcggcggatatcgccaatggccgttgaagaagtgattgaaatgcaagggttgagccttgacccttcatctcacagggtaatggcgaatgatcaggcgctagatatggggccgaccgagtttaaattattacacttctttatgactcatcccgagcgtgtttatagccgtgaacagttgcttaattatgtttggggcactaacgtttatgtagaagatcgtacggttgatgtgcatattcgtcggttacgcaaggcgcttgaaactgatggtcacgataaaatggtacaaactgtccggggaactggataccgtttctcaacgcgctactga

SEQ ID NO: 8500 - protein, 239 aa, Yersinia pestis
MTANILAGLMMARRILVVEDEAPIREMVCFVLEQNGYQPLEAEDYDSAVARLSEPFPDLVLLDWMLPGGSGIQFIKHMKREALTRDIPVMMLTARGEEEDRVRGLEVGADDYITKPFSPKELVARIKAVMRRISPMAVEEVIEMQGLSLDPSSHRVMANDQALDMGPTEFKLLHFFMTHPERVYSREQLLNYVWGTNVYVEDRTVDVHIRRLRKALETDGHDKMVQTVRGTGYRFSTRY

SEQ ID NO: 8501 - DNA, 690 bp, Vibrio vulnificus
  CDS (1)..(690)
atgtctagaaggattctggtagtagaggacgaagcgccaattcgcgaaatgctgtgtttcgtgcttgaacagaaaggttaccaggcggttgaagctgaagattatgatacggcagtaaacaaacttgctgaacccttcccagatttagtattactggattggatgctgccaggtggcagtggcatcaatttcattaagcacatgaagcgtgaagagctgacgcgtaacatccctgtggtgatgttgacggctcgtggtgaagaagaagacaaagttcgtggccttgaagtcggtgcggacgattacattaccaagcctttttcgccaaaagagttagtggctcgccttaaagcggtgattcgccgtgtcacgccaaccgcactagaagatgtgattgatgttcaagggcttaaactcgatccagtttctcaccgtgtgacggccaatgacgcgcctgttgatatggggccaacagaattcaaaatgttgcatttctttatgacccaccaagagcgcgtgtacagtcgtgagcaactgttgaacaatgtgtggggcaccaatgtttatgtggaagatcgcacggttgatgttcacattcgtcgcctgcgtaaagcgctagaagatgcagggcatgataaactgattcaaacagtgcgaggcgcgggctatcgtttctcaacgaaagcgtaa

SEQ ID NO: 8502 - protein, 229 aa, Vibrio vulnificus
MSRRILVVEDEAPIREMLCFVLEQKGYQAVEAEDYDTAVNKLAEPFPDLVLLDWMLPGGSGINFIKHMKREELTRNIPVVMLTARGEEEDKVRGLEVGADDYITKPFSPKELVARLKAVIRRVTPTALEDVIDVQGLKLDPVSHRVTANDAPVDMGPTEFKMLHFFMTHQERVYSREQLLNNVWGTNVYVEDRTVDVHIRRLRKALEDAGHDKLIQTVRGAGYRFSTKA

SEQ ID NO: 8503 - DNA, 756 bp, Synechococcus elongatus
  CDS (1)..(756)
atgtccgttactttggagacccacaaggaaaagatactcgttgttgacgatgaagcgagtattcgtcgcatcttagaaactcgcctgtcaatgattggctataccgtcgtcactgccgccgatggcgaggaagccctgaccaaatttcggcaggagcagccagatttagtcgtgcttgatgtgatgatgccgaaactagacggctatggcgtctgtcaagaactgcgcaaggaatcggatgtccccattattatgctcactgccctgggcgatgtggccgatcgcattacggggctagaactaggtgccgatgattatgtggtcaagcccttttcccccaaggagttggaagcccgcatacgctcggtactgcgacgcattgagaaaaccagtacctctggcatccctagctccggggtgattcaggtgggcaatattcgcattgacaccaataagcggcaggtctacaagggggatgagcgcattcgtctcacgggcatggaatttatgctcttggaattgctggtgggacgctcgggcgagcctttctcccgtgcagaaattctggagcaagtatgggggtacacccccgagcgccatgtggatacacgggtggtggatgtccacatttcccgcttgcgggctaaattagaagaagaccccagtaatccagaattaatcttgaccgcacggggtactgggtatctctttcagcgcattacggaaccgggagaagcaagcaacaaaaatcaatag

SEQ ID NO: 8504 - protein, 251 aa, Synechococcus elongatus
MSVTLETHKEKILVVDDEASIRRILETRLSMIGYTVVTAADGEEALTKFRQEQPDLVVLDVMMPKLDGYGVCQELRKESDVPIIMLTALGDVADRITGLELGADDYVVKPFSPKELEARIRSVLRRIEKTSTSGIPSSGVIQVGNIRIDTNKRQVYKGDERIRLTGMEFMLLELLVGRSGEPFSRAEILEQVWGYTPERHVDTRVVDVHISRLRAKLEEDPSNPELILTARGTGYLFQRITEPGEASNKNQ

SEQ ID NO: 8505 - DNA, 771 bp, Synechococcus elongatus
  CDS (1)..(771)
atgctctctactgagaccgttgccgaacccccggagactgctggtgtcctaccagccgcagttgccaacattttagtgattgaagatgaagatctgattcgggaaaccgttgttctggctttgcaggaggaaggctaccatacccttgtggccagcgatggctatgaagccctcaatctcattcatacctatctgttgagggagacttctcctgaacagggagaggtgtgtttgatcatcctagatgtcatgctaccgggcatcaatggcttggatctgtgccgactaattcgccgtcaaggctgcacagttcccatcctcatgatcagcgccaaaggcagtgaaattgatcgagtggttggccttgaaattggtgccgatgactacttggctaagccctttggcatgcgggagatgctggcccgctgccgcgccctcttgcggcggacacgaattcaacaggctaccctaccaccggttctgcgctttcgcgatctgtgtctttatccccaagaatgccgcgccaccctgcggggcgaggagctcaatctctcccccaaagaatacaaactgctcgagctgtttatgcgtcacccccgccgtgtgtggccacgggagcagttattggatcaggtgtggggtcctgactttgttggcgacagcaaaacggttgatgtccacatccgctggctgcgggagaaaattgaaaccgaccccagtcatccccagtacattcttacggtgcggggttttggctatcgctttggttga

SEQ ID NO: 8506 - protein, 256 aa, Synechococcus elongatus
MLSTETVAEPPETAGVLPAAVANILVIEDEDLIRETVVLALQEEGYHTLVASDGYEALNLIHTYLLRETSPEQGEVCLIILDVMLPGINGLDLCRLIRRQGCTVPILMISAKGSEIDRVVGLEIGADDYLAKPFGMREMLARCRALLRRTRIQQATLPPVLRFRDLCLYPQECRATLRGEELNLSPKEYKLLELFMRHPRRVWPREQLLDQVWGPDFVGDSKTVDVHIRWLREKIETDPSHPQYILTVRGFGYRFG

SEQ ID NO: 8507 - DNA, 678 bp, Streptococcus agalactiae
  CDS (1)..(678)
atgatatattgtgttgaagatgatgctgatattcgcgaaatgatgctctatactttgcaaatggcaggttttaaagctcaaggattttcgagttcagagcttttttgggaagctattcaggagaaagttccagacttgattttgcttgatattatgttgccgggagatgatggtttgactattttagagcgtttaaggagaaaacatcaaacggaaatgataccagtaatcatgacaactgctaaaggtagtgagtatgataaagttaaagggttagatcttggagcagatgattatctcgtcaaaccttttgggatgatggaaatgatttcacgaataaaagcagtcttgagacgtagccgccaagtagattcaaaagctcatattatcattggaaatttagagattgatccgactaattattgggtcaaaaggggaacggaaaaaatccacttaaccctaaaggaatttgagttattagtattattcttccgtaatcccaatagagtctttacaaggcaagaacttctggataaggtttggggagaacaatttttaggagaaactagaactgtggatgttcacattgggacactgcgaacaaaacttggtgaggatggctatttgattgctacagtaaggggagttggataccgtttggaggaaagacatgactaa

SEQ ID NO: 8508 - protein, 225 aa, Streptococcus agalactiae
MIYCVEDDADIREMMLYTLQMAGFKAQGFSSSELFWEAIQEKVPDLILLDIMLPGDDGLTILERLRRKHQTEMIPVIMTTAKGSEYDKVKGLDLGADDYLVKPFGMMEMISRIKAVLRRSRQVDSKAHIIIGNLEIDPTNYWVKRGTEKIHLTLKEFELLVLFFRNPNRVFTRQELLDKVWGEQFLGETRTVDVHIGTLRTKLGEDGYLIATVRGVGYRLEERHD

SEQ ID NO: 8509 - DNA, 711 bp, Streptococcus agalactiae
  CDS (1)..(711)
atgaaaaaaatacttatcgttgatgatgaaaaaccaatttcagatattatcaaatttaatttaaccaaagaaggatatgagacggcgacagctttcgatggccgtgaagctttagtacaatatgcagaatttcaaccagatttaatcattttggatttaatgcttcctgaactagatggtttagaagtggctaaggaagttcgtaaaaccagccatattcctattattatgctttctgcaaaagacagtgagtttgacaaagtcattggtttagaaatcggtgcagatgattatgttactaaacctttttcaaatcgtgaacttttggcacgggtcaaagcacatttacgacgtactgaaaatattgaaacagctgtagcagaagaaagtgctcaaaatgcttcttcagatattactattggtgagttgcaaattttaccagatgcctttattgctaagaaacgtggcgaagaaattgaattaacgcaccgagaatttgaattacttcaccatttagcgacacatatcggacaagtcatgacacgcgaacatttattggaaacagtttggggatatgattattttggagatgtccgtacagttgatgtgacggtgagacgtttacgtgaaaagattgaagatactcctggtcgtccagaatatattttgactcgacgtggtgtaggttattacatgaagtcttatgaatag

SEQ ID NO: 8510 - protein, 236 aa, Streptococcus agalactiae
MKKILIVDDEKPISDIIKFNLTKEGYETATAFDGREALVQYAEFQPDLIILDLMLPELDGLEVAKEVRKTSHIPIIMLSAKDSEFDKVIGLEIGADDYVTKPFSNRELLARVKAHLRRTENIETAVAEESAQNASSDITIGELQILPDAFIAKKRGEEIELTHREFELLHHLATHIGQVMTREHLLETVWGYDYFGDVRTVDVTVRRLREKIEDTPGRPEYILTRRGVGYYMKSYE

SEQ ID NO: 8511 - DNA, 720 bp, Shewanella oneidensis
  CDS (1)..(720)
atgttgacattcactgacagaaaatcacctatgactgcaaggatattgatagtagaagacgagttagccatccgcgagatgctgacttttgtaatggaacagcatgggtttaccacctctgcggcggaagattttgattcggccattgcgctgctaaaggagccttatcccgatctgattttgttggattggatgtttcctggtggaagcggcattcaattagccaaacgccttaagcaggatgagtttacccgccagatccctattattatgcttaccgcgcgcggtgaagaggaagataaggttaaggggctcgaagtcggcgccgatgactacatcactaaacctttctcccccaaggagctagttgcccgcatcaaagcggtgttacgccgcagtgcgccaactcgccttgaagaaaccattgatgtacaaggattgttactcgaccctgtcagtcacagggtgagtgttggcgatactgtactcgatatgggtccgacggaattccgtttgttgcacttctttatgacacacccagaacgcgtctatagccgtgaacaactgcttgataacgtgtggggcaccaacgtgtatgttgaagaccgaacagttgatgtgcatattcgccgcctacgaaaagcggttgaagagtcgggccatgatcgtcttattcagacagttcgtggtgcgggttatcgcttttctacacgtagttag

SEQ ID NO: 8512 - protein, 239 aa, Shewanella oneidensis
MLTFTDRKSPMTARILIVEDELAIREMLTFVMEQHGFTTSAAEDFDSAIALLKEPYPDLILLDWMFPGGSGIQLAKRLKQDEFTRQIPIIMLTARGEEEDKVKGLEVGADDYITKPFSPKELVARIKAVLRRSAPTRLEETIDVQGLLLDPVSHRVSVGDTVLDMGPTEFRLLHFFMTHPERVYSREQLLDNVWGTNVYVEDRTVDVHIRRLRKAVEESGHDRLIQTVRGAGYRFSTRS

SEQ ID NO: 8513 - DNA, 702 bp, Oceanobacillus iheyensis
  CDS (1)..(702)
atgagtcaaaaaatactagtagtagatgatgagcagccaattgcagatatattacaatttaacttagaaaaagaaggctaccaagttgtcgtagcgaatgatggagatacagcaatagaattagcagaaagtgaaaaaccgaacctaattctgttagatattatgcttccgggaaaagacgggaatgaagtattaagagaagtaagaaaaacacaaaacatacctgtaatcatgcttacagcaaaagatgcagaaatcgataaagtattaggactggagcttggtgcggatgattacgtaacaaagccatttagtaatcgagagcttattgcacgtgttaaggcgaatttacgtcgtgaacaagtacctgatgaaacagtgaaaacaaccaaagacatcgttattggtgatcttatcgtacaccctgatgcgtatgttgtatcgcgaaaaggcgaagaaattgagcttacccatcgtgagttcgagcttctacattatctggcgcgtcatataggacaagtaatgacaagagaacatctattagaaaccgtatggggatatgattatttcggtgatgtgcgtacagttgatgtgactgtccgtcgtcttcgtgaaaaaattgaagaaaacccaagtaatcctttatggattgtgacccgaagaggtgtgggctattatttacgtaatcctgagcaggagtag

SEQ ID NO: 8514 - protein, 233 aa, Oceanobacillus iheyensis
MSQKILVVDDEQPIADILQFNLEKEGYQVVVANDGDTAIELAESEKPNLILLDIMLPGKDGNEVLREVRKTQNIPVIMLTAKDAEIDKVLGLELGADDYVTKPFSNRELIARVKANLRREQVPDETVKTTKDIVIGDLIVHPDAYVVSRKGEEIELTHREFELLHYLARHIGQVMTREHLLETVWGYDYFGDVRTVDVTVRRLREKIEENPSNPLWIVTRRGVGYYLRNPEQE

SEQ ID NO: 8515 - DNA, 696 bp, Oceanobacillus iheyensis
  CDS (1)..(696)
atgagtaaaagaatattaatcgtagatgatgaaaagtctattgtaacattactaaaatataatatggaaaattcaggttttgaaacggatgttgcttataatggacaagaagcgattaataaagcagaggcaagcatgtatgatttaattgtattggatttaatgcttcctgaagtcgatgggatggaggtatgccgtacattaagaatgaatcaagtaaatacaccaattcttatgttaactgcaaaagatgaggaatttgataaggtacttggtttagaaatgggggcagatgattatttaacgaaaccatttagcccaaaggaagttattgcaagagtaaaagcaattttacgacgatcccaattatctaataaccatgggtttcacgtattaaaaataggggaattaagtatatatcctgaaagatatgaagcagaaatgagtaataatatcattactttcactcgaaaggaatttgaattattgtatcatcttgcaaaacataaagggaaagtaatatcacgggatcagttattgagtagtgtatgggattatgactttattggagatactcgaattgtagatgttcatattagtcatcttcgagataaaatagaacctaattctaaaaagcctgtatatatcaagacagtacgcggcttgggctataaaatggaggagcctgtttcatga

SEQ ID NO: 8516 - protein, 231 aa, Oceanobacillus iheyensis
MSKRILIVDDEKSIVTLLKYNMENSGFETDVAYNGQEAINKAEASMYDLIVLDLMLPEVDGMEVCRTLRMNQVNTPILMLTAKDEEFDKVLGLEMGADDYLTKPFSPKEVIARVKAILRRSQLSNNHGFHVLKIGELSIYPERYEAEMSNNIITFTRKEFELLYHLAKHKGKVISRDQLLSSVWDYDFIGDTRIVDVHISHLRDKIEPNSKKPVYIKTVRGLGYKMEEPVS

SEQ ID NO: 8517 - DNA, 717 bp, Oceanobacillus iheyensis
  CDS (1)..(717)
atggatataacacataaaatactagtagttgacgatgaagatagaattcgtcgtttaataaaaatgtacttagaaaaagaggattttgaaatagatgaagcagctgatggcgatgttgctttggaaaaagcgttagcgaatgattatgatgtaattattttagatattatgatgcctgaaaaagatggtattgaagtttgtaaagaattacgtaaggaaaaggatacacctgtgattatgctaactgctaaaggcgaagaatcgaaccgtgtacaagggtttgaggttggagctgatgactatatagtaaagccatttagtccaagagaggcagtacttcgagtgaaagcattacttcgaagagtgtcaacgaaaacctatcaagaagtagatacatcatctaaaaatatgcttgtattcccacatctgacgatcgatcatgatgcacaccgagtcgcagcggataatcaagaagtaagtttaactccaaaagagtatgaactgttatgcttcttagcaaacgcaccagataaagtatttaatagagagcagttattaaaagaagtttggcaatatgaattctttggtgatttgcgaactgtagatacacatgtcaagagacttagagaaaaattaaatacagtttctaaagaagctgccaaaatgatcgtgacggtttggggtgtaggatacaaatttgaggtagaagaaaactaa

SEQ ID NO: 8518 - protein, 238 aa, Oceanobacillus iheyensis
MDITHKILVVDDEDRIRRLIKMYLEKEDFEIDEAADGDVALEKALANDYDVIILDIMMPEKDGIEVCKELRKEKDTPVIMLTAKGEESNRVQGFEVGADDYIVKPFSPREAVLRVKALLRRVSTKTYQEVDTSSKNMLVFPHLTIDHDAHRVAADNQEVSLTPKEYELLCFLANAPDKVFNREQLLKEVWQYEFFGDLRTVDTHVKRLREKLNTVSKEAAKMIVTVWGVGYKFEVEEN

SEQ ID NO: 8519 - DNA, 702 bp, Leptospira interrogans
  CDS (1)..(702)
atgaaaaatcaatcagggaacccagggcaaaaagttctcgtcgtagacgatgaggaagatatagccgagctgatccgatttcatttagaagaaaacggttaccaagtagatacatgccaaaatggattagaagtacttccaaaattggaaaaaaatactcctgacttaatcatcttagatcttatgcttcccggaatcggaggtatggatctttgcaagaaaatcaaagaaaagtattctatgccgatcattatggttaccgcaaaatctggagaaaccgaagcagttctcggtttggaattaggggcggacgattatgttcgtaaaccatttagcacaagggaattaatcgccagggtacgctccgttttaagaagaatcaaagatgaagaagaagatgaattcgaaggaaatatcacgattggaaacatctttctcaatctgaaagcgcataaagccttcataaacaactctgaagtcgatttaactttaatagagtataaaatactaaatctttttatgaccaatccaggagtcgcctttactagagataaactattggatcgagtctggggaaaagatatttacgttaccgatagagcagtagacgtaaatatcaaaagactacgcgataaactcggagacgaaaaggaaagactagaaacgatacgcggaatcggctatagattcaatgaggcgtag

SEQ ID NO: 8520 - protein, 233 aa, Leptospira interrogans
MKNQSGNPGQKVLVVDDEEDIAELIRFHLEENGYQVDTCQNGLEVLPKLEKNTPDLIILDLMLPGIGGMDLCKKIKEKYSMPIIMVTAKSGETEAVLGLELGADDYVRKPFSTRELIARVRSVLRRIKDEEEDEFEGNITIGNIFLNLKAHKAFINNSEVDLTLIEYKILNLFMTNPGVAFTRDKLLDRVWGKDIYVTDRAVDVNIKRLRDKLGDEKERLETIRGIGYRFNEA

SEQ ID NO: 8521 - DNA, 681 bp, Corynebacterium efficiens
  CDS (1)..(681)
atgccgcagaaaattctcgtcgttgatgatgatcccgcgatctctgagatgctcaccatcgtgttgagcgccgaggggttcgataccgtcgcagtcaccgacggcgcgcttgccgttgagaccgccgagcgggaacaacccgatctcatcctcctcgatctgatgcttcccggcatgaacggcatcgacatctgcagggccatccgtcaggattccgccgtccccatcatcatgcttaccgccaagaccgacacggttgatgtggtgttggggctggaatccggtgcggatgactatgtgaacaaacccttcaaggcgaaggagcttgtcgcccgcatccgtgcgcgcctgcgtcgcaccgatgatgagcccgccgagaccctcgaggtcggggacctgaccatcgacgtgcccgggcacaccgtcaagcgtggcgatgaggagatctccctcaccccgctcgagttcgatctgctcctggaactggcccgcaaaccacagcaagtattcacccgggaggaactcctcggtaaggtatggggctaccggcacgcatccgatacgcgtctggtcaatgtccacgtgcagcggctgcgcgccaagatcgagaaggatccggagaacccgcagatcgttctcacggttcgtggtgtcggatacaaaaccggtaatgttgactaa

SEQ ID NO: 8522 - protein, 226 aa, Corynebacterium efficiens
MPQKILVVDDDPAISEMLTIVLSAEGFDTVAVTDGALAVETAEREQPDLILLDLMLPGMNGIDICRAIRQDSAVPIIMLTAKTDTVDVVLGLESGADDYVNKPFKAKELVARIRARLRRTDDEPAETLEVGDLTIDVPGHTVKRGDEEISLTPLEFDLLLELARKPQQVFTREELLGKVWGYRHASDTRLVNVHVQRLRAKIEKDPENPQIVLTVRGVGYKTGNVD

SEQ ID NO: 8523 - DNA, 699 bp, Corynebacterium efficiens
  CDS (1)..(699)
atgacgaccatcctgatcgttgaagatgaggaatcgttggcggatcctttggccttcctcctcagaaaagaaggctttgacaccatcatcgcgggcgatggtcccaccgcactcgtggaattcagcagaaacgacattgacatcgtcctgctcgatctcatgctgccgggcatgtccggaaccgatgtgtgcaaggaactgcgcctggtctccaacgtgccggtgatcatggtgacggcgcgtgactccgagatcgacaaggttgtcggtctggaactcggcgccgatgactatgtgaccaagccgtactcctcccgcgagctcatcgcccgtatccgcgcggtgctgcgccgccggggggacaccgaggccgaggccgccgaggatgataccgacgaccagatcctcgagggcgggcgcgtgcgcatggatgtggacagccacaccgtcaccgtcgacggcaaggcggtgaacatgccgctgaaggaattcgacctgctggaatacctcctgcgcaacgccggccgtgtgctcacccgtggccagctcatcgaccgcatctggggtgccgactatgtcggcgacaccaagaccctcgatgtccacgtcaagcggctgcgctccaagatcgaggaggagccctcacgcccccgtcacctcgtgaccgtgcgtgggctggggtataaatacgaactctga

SEQ ID NO: 8524 - protein, 232 aa, Corynebacterium efficiens
MTTILIVEDEESLADPLAFLLRKEGFDTIIAGDGPTALVEFSRNDIDIVLLDLMLPGMSGTDVCKELRLVSNVPVIMVTARDSEIDKVVGLELGADDYVTKPYSSRELIARIRAVLRRRGDTEAEAAEDDTDDQILEGGRVRMDVDSHTVTVDGKAVNMPLKEFDLLEYLLRNAGRVLTRGQLIDRIWGADYVGDTKTLDVHVKRLRSKIEEEPSRPRHLVTVRGLGYKYEL

SEQ ID NO: 8525 - DNA, 723 bp, Corynebacterium efficiens
  CDS (1)..(723)
atggctgtccaaacaccaaccgacactctggctgcggggcgcgtgctcatcgtcgatgatgaaaaaccgctggcccagatggttgagacctatctcctccgggccgggttcgaaactgttcaggcacacaccgggatcgatgccgtccatgaggcgcgcagattctccccggatgtggtgatcctcgaccttggattacctgaactcgatggtcttgaggtgtgccgtcaggtccgtgccttctcggactgctacatcctcatgctcacggcccgcggtagtgaggaggataagatcaccggtctgaccatgggggccgatgattacatcaccaaacccttcggcatcagggaactggtcacccgggtgcgggcggttatgcgccgcccccgcatcaccgtcaccggcccggggacggacgccccgttgatcatcggggaccttgtcatcgacccctccgcgcatacggtccgcgtcgggggcggggcagtggacatcacgcctactgaatttgatctcctgctggccctggcactgcgtcccggccgggtctgttcgcgtcgggagctggtcaccgaggtgtgggatacaacctgggtgggtgatgagcgcattgttgatgttcatatcgggaatctcagacgcaagctcggtaccgatgcgcgggggaggggtcttatcgacaccgtccgtggggtggggtaccggttggggcaggtatga

SEQ ID NO: 8526 - protein, 240 aa, Corynebacterium efficiens
MAVQTPTDTLAAGRVLIVDDEKPLAQMVETYLLRAGFETVQAHTGIDAVHEARRFSPDVVILDLGLPELDGLEVCRQVRAFSDCYILMLTARGSEEDKITGLTMGADDYITKPFGIRELVTRVRAVMRRPRITVTGPGTDAPLIIGDLVIDPSAHTVRVGGGAVDITPTEFDLLLALALRPGRVCSRRELVTEVWDTTWVGDERIVDVHIGNLRRKLGTDARGRGLIDTVRGVGYRLGQV

SEQ ID NO: 8527 - DNA, 711 bp, Chlorobium tepidum
  CDS (1)..(711)
atggctgaaacctccatactgatcgtcgaagatgaccggaaccttgccggactcctgaagtacaaccttgaaaaagccggttacggctgcattcacgccgccagtggagaggaggcgctcgacgagttgcaacgccatgccgtgaacctcgtgctgctcgacattatgctgccgggcattgacggcttcgaggtgtgccgccgcatccgccagaatgtgcagtggagcgatctgcccatcgtgatgctgacggccaagggcgaggagatcgacaaggtgttcggtttcgaactcggtatcgacgactatgtggtcaagcccttcagtccccgcgagctgaatctccgaattcgcgccattctcaagcgcgatcgtcgcaaccgcagcaatgtgcaggaggtgctccgttcgggcggtatcgagctcgatatcggccgccacgaggccacgctcgacggccgtcccctcgttctgaccttgatggagttcaagctgctggcgcttctgatgaaacgcaaagggcaggcgcagacgcgcgaggtgctcctgagcgacgtgtgggatgtggacaagagcatcaatactcgcaccatcgacacgcatgtcacgcggcttcgcgaaaagctcggcgacgccgggcgcttcatccgaaccgtgcgcggcctcggctacaagttcgacgaaaacggagacaatttgaatgaaagctaa

SEQ ID NO: 8528 - protein, 236 aa, Chlorobium tepidum
MAETSILIVEDDRNLAGLLKYNLEKAGYGCIHAASGEEALDELQRHAVNLVLLDIMLPGIDGFEVCRRIRQNVQWSDLPIVMLTAKGEEIDKVFGFELGIDDYVVKPFSPRELNLRIRAILKRDRRNRSNVQEVLRSGGIELDIGRHEATLDGRPLVLTLMEFKLLALLMKRKGQAQTREVLLSDVWDVDKSINTRTIDTHVTRLREKLGDAGRFIRTVRGLGYKFDENGDNLNES

SEQ ID NO: 8529 - DNA, 693 bp, Pseudomonas syringae
  CDS (1)..(693)
atggctggcaggagcattttgattgttgatgacgaggcaccgatccgcgaaatgattgcagtagccttggaaatggcaggctacgactgccttgaagccgataatgcccaggatgcccatgccatcatcgttgaccgcaaaccggacctgatcctgctggactggatgctgcccggcggcacttccggcattgaactggcccgccgcctcaagcgcgaagagctgaccagcgacatcccgatcatcatgctcaccgccaaaggtgaagaggacaacaagatccagggcctggaagtcggggttgacgactacatcaccaaaccgttctcgccccgtgaactggtggcccgcctcaaagccgtgctgcgccgtgccggacctgccgacagtgagtcacccattgagattggcggtttgctgctcgaccccatcagccaccgcgtcaccatcgacggcacccctgccgagatgggccctaccgaatatcgcctgctgcagttcttcatgacccatcaggaacgtgcctacacccgcggccaactgctcgatcaggtgtggggcggcaacgtgtacgtggaagagcgcaccgtggacgttcacatccgccggctgcgcaaagccctcggcgaggcttacgaaaatatggtacaaaccgtgcgcggcaccggttaccggttttcgacccaagcttaa

SEQ ID NO: 8530 - protein, 230 aa, Pseudomonas syringae
MAGRSILIVDDEAPIREMIAVALEMAGYDCLEADNAQDAHAIIVDRKPDLILLDWMLPGGTSGIELARRLKREELTSDIPIIMLTAKGEEDNKIQGLEVGVDDYITKPFSPRELVARLKAVLRRAGPADSESPIEIGGLLLDPISHRVTIDGTPAEMGPTEYRLLQFFMTHQERAYTRGQLLDQVWGGNVYVEERTVDVHIRRLRKALGEAYENMVQTVRGTGYRFSTQA

SEQ ID NO: 8531 - DNA, 693 bp, Rhodobacter sphaeroides f
  CDS (1)..(693)
atgtcgccagccgatcagcccgtggtcctgctcgtcgaggacgagccggcacagcgcgaggttctgtcctacaacctcgagtccgagggcttccgggtggtgcaggccggcaacggcgacgaggcgctgatgctcgtcgaggaagcggggcccgacgtgatcgtgctcgactggatgctgccctcggtctccgggatcgaggtctgccgccagctcaagtcccgcccctcgacgcgctcggtgccgatcatcatgctctcggcccgctcggaagaggtggaccgggtgcgcggcctcgagaccggggccgacgattatgtggtcaagccctactcggtggtcgagctcatggcgcgggtgcgcagccagctccggcgggcccggccctcgagcgtgggcctgacgctcgagttcgaggatatccgcctcgatcccgagacccacaaggtgcaccgtggcggacagctcctgaagctcgggccgacggagttccggctgctctcgaccttcatggagaagcccggccgggtctggagccgcgagcaattgctcgaccgggtctggggccgcgacatctatgttgacagccgtacagtcgatgttcatgtcggccggctgcgcaaggcgctctgcctccacggcggcgaggatcctgtccgcaccgtgcgcggcgcaggctacgcgctgggctga

SEQ ID NO: 8532 - protein, 230 aa, Rhodobacter sphaeroides f
MSPADQPVVLLVEDEPAQREVLSYNLESEGFRVVQAGNGDEALMLVEEAGPDVIVLDWMLPSVSGIEVCRQLKSRPSTRSVPIIMLSARSEEVDRVRGLETGADDYVVKPYSVVELMARVRSQLRRARPSSVGLTLEFEDIRLDPETHKVHRGGQLLKLGPTEFRLLSTFMEKPGRVWSREQLLDRVWGRDIYVDSRTVDVHVGRLRKALCLHGGEDPVRTVRGAGYALG

SEQ ID NO: 8533 - DNA, 726 bp, Corynebacterium glutamicum
  CDS (1)..(726)
atgacgaacccctcccccgcgctaaatgaaaccctttccggcagggtgctgatcgttgaagatgagcgccctcttgctcgcatgatttcgctttatttaagcaaagcgggtttcgataccaccacgatccacgacggcgccgctgctccagataaggtcgctcacctgcgccccgacgtggtcattttggatcttgggctgcctggtcttgatggtttggaagtgtgcaaacgcatccgcgcgttcaccgattgctacatcctaatgctcaccgccaggggttcagagcgggatcggattacaggtttggaaattggggctgatgattacatcaccaagccgtttaatatccgcgaacttgtcattcgtatccagtcagtaatgcgtcgccctcgaaaaatcgatgaaaccatccaaaatggtttgaccttgacttatggccacattgagctggacaccttggcgcatgaagtcactgtcaaaggcgttggggtgacactgacccgcacagaatttgagctgcttcaagccctcatgcacaaaccgggagaggcagtgtctaggcgtgatttggtcagccaagtgtgggataccacctgggttggcgatgaacgcatcgttgacgtgcacattggaaatctgcgccgcaagctggaagcacctgcgccgggttcacacttcatcgacaccatccgaggtgttggctaccggatggccttcaaatga

SEQ ID NO: 8534 - protein, 241 aa, Corynebacterium glutamicum
MTNPSPALNETLSGRVLIVEDERPLARMISLYLSKAGFDTTTIHDGAAAPDKVAHLRPDVVILDLGLPGLDGLEVCKRIRAFTDCYILMLTARGSERDRITGLEIGADDYITKPFNIRELVIRIQSVMRRPRKIDETIQNGLTLTYGHIELDTLAHEVTVKGVGVTLTRTEFELLQALMHKPGEAVSRRDLVSQVWDTTWVGDERIVDVHIGNLRRKLEAPAPGSHFIDTIRGVGYRMAFK

SEQ ID NO: 8535 - DNA, 681 bp, Corynebacterium glutamicum
  CDS (1)..(681)
atgtcacagaaaattctcgtggttgatgatgatcccgccatctccgagatgctcaccatcgtgctcagcgcagaaggctttgacaccgtagctgtcaccgacggcgcactcgccgtggaaaccgcctcccgggaacaaccggatctgattttgctcgacttgatgcttccaggcatgaacggcatcgacatttgtcgcctcatccgccaagaatcctccgtacccatcatcatgctcaccgccaaaaccgacaccgttgatgtggtgctcggtttggaatccggtgcagacgattacgtgaacaagcctttcaaagcgaaagaacttgtcgcccgcatccgtgcccgcctccgcgcaaccgtggacgagcccagcgaaatcatcgaagtcggcgatctgtccatcgacgtcccagcacacaccgtcaaacgaaacggcgctgagatttccttgaccccactcgaattcgacctcctgctggaactcgcccgcaaaccacagcaagtattcacccgtgaagaattgctgggcaaagtgtggggctaccgccacgcatccgacactcgactggtcaacgttcacgttcagcgtctgcgcgccaagattgaaaaagatccagaaaatccgcagatcgtcctcaccgtccgcggtgttggctacaaaactggccacaacgattag

SEQ ID NO: 8536 - protein, 226 aa, Corynebacterium glutamicum
MSQKILVVDDDPAISEMLTIVLSAEGFDTVAVTDGALAVETASREQPDLILLDLMLPGMNGIDICRLIRQESSVPIIMLTAKTDTVDVVLGLESGADDYVNKPFKAKELVARIRARLRATVDEPSEIIEVGDLSIDVPAHTVKRNGAEISLTPLEFDLLLELARKPQQVFTREELLGKVWGYRHASDTRLVNVHVQRLRAKIEKDPENPQIVLTVRGVGYKTGHND

SEQ ID NO: 8537 - DNA, 705 bp, Staphylococcus aureus
  CDS (1)..(705)
atgtcgcaaaaagtgttggtagtagatgacgaacattcaatcgtaacattacttaaatataacttagaaacagctggttatgaagttgttgtcgcatttgatggtgatgaggctttagaaaaggtagaaagtgaacagccagatttaattattttagatgttatgctacctaaaaaagatggcattgacgtatgtaagactgtaagaacaaataaaaatttagtccctatattaatgttaacggcgaaaaatgatgaatttgatcgggtattaggtttagaattaggtgccgatgactatatgactaagcctttttcacctagagaagttgttgcccgtgtgaaagccattttaagacgttctcaatttgtaaaagaagtagaagaggttgatgatgatattaccatcggatcgatacgtattagacccgattattttgaagtatataagcataatgagttattggagctaacaccgaaagaatttgaactcttgctttatttgatagaaagacaaggcagagtcattacgagagaacatatgttaaatacggtatggaattatgaatttgcaggagactcaagaattgtcgatgtacatatcagtcatttaagagataaattagaagataatcctaagaagccacaacttattaaaactgtgcgtggcttaggctataaattggaaagacctaaagaacaatga

SEQ ID NO: 8538 - protein, 234 aa, Staphylococcus aureus
MSQKVLVVDDEHSIVTLLKYNLETAGYEVVVAFDGDEALEKVESEQPDLIILDVMLPKKDGIDVCKTVRTNKNLVPILMLTAKNDEFDRVLGLELGADDYMTKPFSPREVVARVKAILRRSQFVKEVEEVDDDITIGSIRIRPDYFEVYKHNELLELTPKEFELLLYLIERQGRVITREHMLNTVWNYEFAGDSRIVDVHISHLRDKLEDNPKKPQLIKTVRGLGYKLERPKEQ

SEQ ID NO: 8539 - DNA, 690 bp, Xanthomonas campestris
  CDS (1)..(690)
atgcagaaacgcatcctgatcgtcgatgacgaacccgcaatccgcgacatggtcgcgttcgcactgcgcaaaggcgagttcgagcccatccacgccggtgacgcccgcgaggcgcagaccgccatcgccgaccgcgttcccgatctcatcctgctcgactggatgttgcccggcaccagcggcctggacctggcgcggcgctggcgcaaggaatcgctgacccgcgagatcccgatcatcatgctgaccgcgcgcggcgaagagaacgatcgcgtcggcggcctggaggccggcgtcgacgattacgtggtcaagccgttctcggcccgcgaattgctggcacgcatccgtgcggtcatgcggcgcacccgtgaggacgacgaagacggcagcgtggccgtgggccgcctgcgcatcgacggtgccgcgcaccgcgtgttcgccggcgatgccccggtgccgatcggcccgaccgaataccggctgctgcacttcttcatgacccatcctgagcgcgtctacacccgcacccagctgctggaccatgtgtggggcggcagtgtgtatgtggaagagcgcacgatcgatgtgcacatccgccgcctgcgcaagacgctggaaccgttcggcctggaaaacatggtgcagaccgtgcgtggatcgggctaccgtttctcctcggccacctga

SEQ ID NO: 8540 - protein, 229 aa, Xanthomonas campestris
MQKRILIVDDEPAIRDMVAFALRKGEFEPIHAGDAREAQTAIADRVPDLILLDWMLPGTSGLDLARRWRKESLTREIPIIMLTARGEENDRVGGLEAGVDDYVVKPFSARELLARIRAVMRRTREDDEDGSVAVGRLRIDGAAHRVFAGDAPVPIGPTEYRLLHFFMTHPERVYTRTQLLDHVWGGSVYVEERTIDVHIRRLRKTLEPFGLENMVQTVRGSGYRFSSAT

SEQ ID NO: 8541 - DNA, 690 bp, Xanthomonas axonopodis
  CDS (1)..(690)
atgcagaaacgcattctgatcgtcgatgacgaacccgcgatccgcgacatggtggcgttcgcgctgcgcaaaggcgagttcgagcccatccatgccggcgatgcccgcgaggcgcaaaccgccatcgccgaccgcgtgccggacctgatcctgctggactggatgttgccaggcaccagcgggctggacctggcaaggcgctggcgcaaggagcagctgacccgcgagattccgatcatcatgctcaccgcgcgcggcgaagaaaacgaccgcgtcggcggcctggaagccggcgtcgacgattatgtggtcaagccgttctcggcgcgcgagctgctggcacgcatccgcgcggtgatgcggcgcacccgcgaagacgacgaagacggtagcgtggcggtaggcaagctgcgcatcgacggcgccgcgcaccgggtgttcgctggcgatgcaccggtgccgatcggcccgaccgaatatcggctgctgcactttttcatgacacaccccgagcgcgtgtatacgcgtacccagctactggaccatgtctggggcggcagcgtgtatgtggaagagcgcaccatcgacgtgcatatccgccgcctgcgcaagacgctggaaccgttcgggctggaaaacatggtgcagaccgtacgtggctccggctatcgtttttcttcggcgacctga

SEQ ID NO: 8542 - protein, 229 aa, Xanthomonas axonopodis
MQKRILIVDDEPAIRDMVAFALRKGEFEPIHAGDAREAQTAIADRVPDLILLDWMLPGTSGLDLARRWRKEQLTREIPIIMLTARGEENDRVGGLEAGVDDYVVKPFSARELLARIRAVMRRTREDDEDGSVAVGKLRIDGAAHRVFAGDAPVPIGPTEYRLLHFFMTHPERVYTRTQLLDHVWGGSVYVEERTIDVHIRRLRKTLEPFGLENMVQTVRGSGYRFSSAT

SEQ ID NO: 8543 - DNA, 684 bp, Xanthomonas axonopodis
  CDS (1)..(684)
atgagcagcgcgtccccgatcgggcatgtgctgatcgtcgaggacgaaccgcgcctggccgcggtgttgggcgagtacctgcacgcggccggctattcgcacgactggatcgccgatggcgcgcaagcgctgggcgcattccgcgcgcagcagcccgacctggtgctactggacctgatgctgcccaaccgcggcggcctggacatctgccgcgacctgcgcaatgaaagcgcggtgccggtcatcatggtcaccgcgcgcgtggaggaaatcgaccgcctgctgggcctggagatcggcgcggacgactacatctgcaagccgttcagcccgcgcgaagtggtggcgcgcgtccaggcagtgttgcgccggcatcgccacgacccccacggcgcgccggcaccgggcctgcagatcgacgaggacgcctgtcgcgccagcgtggacggccgcgccctggacctgacccaggtcgaattccgcctgctgcgtaccctcgccgcggccccggggcgggtgtactcgcgcgagcaactgatgggccggctttacgccgaccaccgcatcgtcaccgaccgcactgtcgacagccacgtcaagaatctacgccgcaaactcgccgacgccggcggcgaggactgggtccgttcggtctatggggcggggtatcgctttgagccgtga

SEQ ID NO: 8544 - protein, 227 aa, Xanthomonas axonopodis
MSSASPIGHVLIVEDEPRLAAVLGEYLHAAGYSHDWIADGAQALGAFRAQQPDLVLLDLMLPNRGGLDICRDLRNESAVPVIMVTARVEEIDRLLGLEIGADDYICKPFSPREVVARVQAVLRRHRHDPHGAPAPGLQIDEDACRASVDGRALDLTQVEFRLLRTLAAAPGRVYSREQLMGRLYADHRIVTDRTVDSHVKNLRRKLADAGGEDWVRSVYGAGYRFEP

SEQ ID NO: 8545 - DNA, 696 bp, Thermoanaerobacter tengcongensis
  CDS (1)..(696)
atgagcagcaagattttgattgtggacgatgaaaaaccgcttgtggacataataaagtataatttagaaaaagaaggttacataacttttgaagcctatgacggcgaagaagccgtaaagatggcaaaagaacaaaaccctgacctcataatattggatgtgatgcttcctaaaatggacggttttaccgttttaaagactttgcggcagtccatgacagttccaattttgatgctcactgcaaaagaggaggaagtagataaagtattgggactggaattgggagctgatgattatatcacaaagcctttttcaatgagggagctcgtagctcgcgttaaagcgaatttgaggcgggtaagtttcaatggcagcgagcagaatcacattatacggataaagaatttgaagatcgacatcttaaagtacaaagtggagaagaacaacaaagagatagagttaacctcccgagaattcgagcttttgagatttctcgttttaaacaaagggctggtcttttcaagagaggctcttttagaaaaagtgtggggttacgaatattttggcgatattagaacggtggacgtcaccataaggcgattgagagaaaaaatagaagatgacccgagcaacccaaaattcatacacacaaaaagaggggttggttactattttagcgatgaaaagccgatttaa

SEQ ID NO: 8546 - protein, 231 aa, Thermoanaerobacter tengcongensis
MSSKILIVDDEKPLVDIIKYNLEKEGYITFEAYDGEEAVKMAKEQNPDLIILDVMLPKMDGFTVLKTLRQSMTVPILMLTAKEEEVDKVLGLELGADDYITKPFSMRELVARVKANLRRVSFNGSEQNHIIRIKNLKIDILKYKVEKNNKEIELTSREFELLRFLVLNKGLVFSREALLEKVWGYEYFGDIRTVDVTIRRLREKIEDDPSNPKFIHTKRGVGYYFSDEKPI

SEQ ID NO: 8547 - DNA, 681 bp, Thermoanaerobacter tengcongensis
  CDS (1)..(681)
atgggagaaagccagaagatttatgtggtggatgatgacaaaaatatatgcgaaattgtctctttatatctcgaaaaagagggttttgaagtggagcagatatacgacgggcagacagctcttagaaagatacaggaaaagcctccaaagcttgtaatactcgatataatgcttccgggaattgatggaattgcactttgcaaagaagtaagaaaattttctaaagtgccaataattatgcttactgcaaaaggagacactttggacaaggttttaggacttgagataggagctgatgattatattgtcaaaccttttgacgggaaggagcttgtagcaagggttaaagcagttttgagaaggtatgagggcgaaagtgaggataaatctgtgtcctatcctgacttgtacgttagtttaagcgagtacaaagtcatctacaaaggaaaaaatattgaccttacgccgaaggagttagagcttctttattttctctgcacacatcccaatagagtgtttacaagggaccagcttttggagaatgtgtggggctatgactacatgggggacagcaggacggtggatgtgcacataaagaggttgagagagaaggtgggagagggtccaaactggaagctcacgactgtttggggagtaggttataagtttgaggtgaactga

SEQ ID NO: 8548 - protein, 226 aa, Thermoanaerobacter tengcongensis
MGESQKIYVVDDDKNICEIVSLYLEKEGFEVEQIYDGQTALRKIQEKPPKLVILDIMLPGIDGIALCKEVRKFSKVPIIMLTAKGDTLDKVLGLEIGADDYIVKPFDGKELVARVKAVLRRYEGESEDKSVSYPDLYVSLSEYKVIYKGKNIDLTPKELELLYFLCTHPNRVFTRDQLLENVWGYDYMGDSRTVDVHIKRLREKVGEGPNWKLTTVWGVGYKFEVN

SEQ ID NO: 8549 - DNA, 696 bp, Thermoanaerobacter tengcongensis
  CDS (1)..(696)
atgaataagaaaatacttgtggttgatgacgaaataaaaatactggaagttgtaaagtcataccttgagcgtgagggatttagcgttattactgaaactaatggcaataacgttttagatacattcaaaaaagaaaaaccagaccttgttatattggacctcatgttgccaggtatttcaggagaggaactgtgtaaaaggttacgtcagttttccaatgttccgatattgatgcttacagcaaaagttcaagaaagtgataaaattaatggattttctataggtgctgatgactatattacaaaaccattcagcccacgtgaattggttatgagagtgaaagcaatattaagaagaacaactgatgatgtgcctcttgctgaagtaatgtcttttaataatgatgaccttgtggtcgatttaagagcacatacagtgaggaaaaagggtgtggttgtaaatcttactccaaatgaatttaaaattttaaagattctaattcgcaatccaaatagggtctttacaagagaagaattaattgaaaaagttatgggatttgactatgaaggctatgacaggacgattgatgcacatattaaaaatttaagacaaaaaattgaagacgatacgaaaaatccagtgtatattaaaacggtgtatggcgttggatataaatttggtgatggaaatgtttag

SEQ ID NO: 8550 - protein, 231 aa, Thermoanaerobacter tengcongensis
MNKKILVVDDEIKILEVVKSYLEREGFSVITETNGNNVLDTFKKEKPDLVILDLMLPGISGEELCKRLRQFSNVPILMLTAKVQESDKINGFSIGADDYITKPFSPRELVMRVKAILRRTTDDVPLAEVMSFNNDDLVVDLRAHTVRKKGVVVNLTPNEFKILKILIRNPNRVFTREELIEKVMGFDYEGYDRTIDAHIKNLRQKIEDDTKNPVYIKTVYGVGYKFGDGNV

SEQ ID NO: 8551 - DNA, 723 bp, Thermoanaerobacter tengcongensis
  CDS (1)..(723)
atgccttatactgtcctggtgatagaagatgagatccatatcttagagctattgagatataatctagaggctgcaggatataaagtcatggcttcggaaaatgggaaagaaggtttggagaaagctttggaagaaaagccggatctgctgatactagatttgatgttacctgatatggatgggttagagatatgcaaagtgctgaagaaaaatgaggatactaagaacattccaataataatgctgactgcaagaagtgaagaatttgataaggtattgggactagaactgggagctgatgattacattactaaaccttttagtgtgagagagcttttagctagaataaaggcggttcttcggcgaacgcagcaggtagaggaagaaaaagaagaaataataaagtttggggatatagtgatagatactggaaagcatgtagtgtacaagaaaggaaaggcgctggatctgactttgaaagaatttgagcttttaaagctcctctctcaaaataaagggaaagtgctgacgagagactatttgctggacaaggtgtggggatacgaatacgctggtgaaacgaggactgttgacgttcacataaggcatttgagaaagaagatagaagatgacgacaaggcgcctgtctatattgagactgtgcgagggataggttacaaactcagagacttgagtgaagacaaaggtgaagaagatgcttag

SEQ ID NO: 8552 - protein, 240 aa, Thermoanaerobacter tengcongensis
MPYTVLVIEDEIHILELLRYNLEAAGYKVMASENGKEGLEKALEEKPDLLILDLMLPDMDGLEICKVLKKNEDTKNIPIIMLTARSEEFDKVLGLELGADDYITKPFSVRELLARIKAVLRRTQQVEEEKEEIIKFGDIVIDTGKHVVYKKGKALDLTLKEFELLKLLSQNKGKVLTRDYLLDKVWGYEYAGETRTVDVHIRHLRKKIEDDDKAPVYIETVRGIGYKLRDLSEDKGEEDA

SEQ ID NO: 8553 - DNA, 690 bp, Thermoanaerobacter tengcongensis
  CDS (1)..(690)
atgaaggaaaagatactgattgtagaagatgaaagacagatagcgcgttttttacaattggaattcgaacacgaaggctatgaagtaaaaatagtttacgacggaacctcaggcgtgaaagaagctttagagggcgattatgaccttgtgcttttggatataatgcttccaggaatggatggatatgaagttttgaaaaaaataagagaaaactctgacatacctgttataatgcttacagcaaaatatgaggtgaaagacaaggtaagagggctagacattggtgcagatgactatgtaactaagcctttttctatagaggagcttttcgctagagtgagggctgcattgagaaagagaaatcccagtattaaaaaagatgtgctgaagtttgctggtattgttatggatttgactactcatgaggtcaggaggcagggagtaaaaattgaccttacgaaaaaagagtttgaccttttagaatttttaatgagaaatgcgaatattgctctttctagagaaaaaattctgcggtcagtttggggatatgactattatggggataccaatgtagtagacgtgtacataaggtatttgagaagcaaaattgacgacccatttgacagaaaattgattcacactataaggggagtaggttacagtttgagagatggtgaagatgaagattaa

SEQ ID NO: 8554 - protein, 229 aa, Thermoanaerobacter tengcongensis
MKEKILIVEDERQIARFLQLEFEHEGYEVKIVYDGTSGVKEALEGDYDLVLLDIMLPGMDGYEVLKKIRENSDIPVIMLTAKYEVKDKVRGLDIGADDYVTKPFSIEELFARVRAALRKRNPSIKKDVLKFAGIVMDLTTHEVRRQGVKIDLTKKEFDLLEFLMRNANIALSREKILRSVWGYDYYGDTNVVDVYIRYLRSKIDDPFDRKLIHTIRGVGYSLRDGEDED

SEQ ID NO: 8555 - DNA, 675 bp, Thermoanaerobacter tengcongensis
  CDS (1)..(675)
atgatgcacaaagttctggtaattgaagatgaagaaggaatgagagatatattgaaaacttatttagaaaataatggatatcaagtattaacagcagaaaatggaaaagaaggccttgacctcttcaacgaaaacaaagatataaagataatcctcttggatataatgctccctgatataagcggatggagccttttaaaaacaataagggaaacatcaaaagttcctgtgatgatgataacagcaagaggagaagaatacgacaaacttttaggctttgaattgggggcagatgattatgtagtaaagccctttagtcccagagaagtagtggcccgtgtaaaagcaattttatcaaggacatatggctctcaagatgatggaaaaacagaatatcaagggattgtcatggatgttcattcgagggaagtcactgttgatggcaaaaaaattgagctcactccaaaagaatttgaccttttaaagcttttactggataacaagggaaaagttgtatcccgcgaaaaatgtctcaatgaagtctggggctacgatttttacggagatttgaggacagtcgacactcacataaaacagctgagagaaaaattgggtgagaaaagaaatcttataaaaactgtgtggggaataggttataaactggaaggtgactga

SEQ ID NO: 8556 - protein, 224 aa, Thermoanaerobacter tengcongensis
MMHKVLVIEDEEGMRDILKTYLENNGYQVLTAENGKEGLDLFNENKDIKIILLDIMLPDISGWSLLKTIRETSKVPVMMITARGEEYDKLLGFELGADDYVVKPFSPREVVARVKAILSRTYGSQDDGKTEYQGIVMDVHSREVTVDGKKIELTPKEFDLLKLLLDNKGKVVSREKCLNEVWGYDFYGDLRTVDTHIKQLREKLGEKRNLIKTVWGIGYKLEGD

SEQ ID NO: 8557 - DNA, 796 bp, Listeria monocytogenes
  CDS (53)..(775)
aaaaaggttaattcatgctatattttagataaaagggttacataaagaagggatgggaagtacgttggtaaaaattcttgtagttgatgatgaagcttctattgttaccttgctacaatttaatattgaaaaagcaggatttgaagtggtgacagctgaagatggtagaactgggtatgagctcgctttgtccgaaaagccagatttaattgtgcttgatttaatgcttcctgagatggacggaatcgaagtaacaaaaaaacttcgtcaagataaagtaaatgtaccaattttaatgttaacagcaaaagatgaagagttagataaaattattggacttgaacttggagcagatgattatatgactaagccttttagtccaagagaagtagtggcgagaattaaagctatcctgcgtcgaacagaaggaaaagcagaaataatagaagaattaaccgaagatgtggaagccactatattaattggtgatttgaaaattttgccagatagttacgaagtgtatttacaagatgatttacttgacctaacaccgaaagaatttgagttattattattcctggcgaatcatcgtggcaaagttttctctagagaccaattgctcgatactgtctggaactatgattacgttggcgaaacccgaattgtagacgttcatgttagccatttgcgcgataaaatcgaactagatacgaaacaacctaaatatatcaaaacaattcgtggcttcggttataaaatggagaacgtaaaataatgaagaaattatggctgaaaa

SEQ ID NO: 8558 - protein, 240 aa, Listeria monocytogenes
MGSTLVKILVVDDEASIVTLLQFNIEKAGFEVVTAEDGRTGYELALSEKPDLIVLDLMLPEMDGIEVTKKLRQDKVNVPILMLTAKDEELDKIIGLELGADDYMTKPFSPREVVARIKAILRRTEGKAEIIEELTEDVEATILIGDLKILPDSYEVYLQDDLLDLTPKEFELLLFLANHRGKVFSRDQLLDTVWNYDYVGETRIVDVHVSHLRDKIELDTKQPKYIKTIRGFGYKMENVK

SEQ ID NO: 8559 - DNA, 765 bp, Listeria monocytogenes
  CDS (41)..(754)
taaagccggcgaaatccaggaatgagaggactgtaaaaaaatggcagaaaagaaaattcttgtattagatgacgaaaaaccgattgcggatatagttaagtttaatctaaataaagaaggctttgatgtatattgcgcctatgatggcgatgaagcgttagaacttgtagaagaagttcagccagatttgattttactggatatcatgcttccaggtcgtgatggtattgaggtatgtcgtgaagttcgtaaaaaatatgatatgccaataattatggtaacagcgaaagactccgaaattgataaagttatcggactggaacttggtgcggatgactatgtaacgaagccattcagtaaccgtgaattaatcgctcgtgtgaaagccaacttgcgccgtcacagccaagtaagctcaagcacagccgaggaagaagaaaacagcgaactagaaatcggttctcttattattcatccagacgcatatgtggcctctaaacgtggagaaacaatcgaacttacgcatcgtgaattcgaattactacactatttagcaaaacatatgggacaagttatgacacgggaacatttactccaaactgtttggggctacgactacttcggcgatgttcgtacggtggatgttaccgttcgtcgtttacgtgaaaaaattgaagataatccaagtcacccagcatggttagtaactagacgcggagttggttattatttacgcaatcctgaacaagaataaataacaagaag

SEQ ID NO: 8560 - protein, 237 aa, Listeria monocytogenes
MAEKKILVLDDEKPIADIVKFNLNKEGFDVYCAYDGDEALELVEEVQPDLILLDIMLPGRDGIEVCREVRKKYDMPIIMVTAKDSEIDKVIGLELGADDYVTKPFSNRELIARVKANLRRHSQVSSSTAEEEENSELEIGSLIIHPDAYVASKRGETIELTHREFELLHYLAKHMGQVMTREHLLQTVWGYDYFGDVRTVDVTVRRLREKIEDNPSHPAWLVTRRGVGYYLRNPEQE

SEQ ID NO: 8561 - DNA, 687 bp, Clostridium perfringens
  CDS (1)..(687)
atggaaggtttattaggaaagattttaattgtagacgacgatgagaatatatgtgaagtcataaaaatgtatctagaaactacaggatataacgttaaagtagctcatgatggaaaggctgctaaagaagaatttgttaactttagccctaacctagttgtattagatatgatgctacctggaattgatggaatggaagtattaaagtggataagaaaagatagtaacgttccagtaataatgttaactgctaaaggagaaacttttgataaggtattagctttagaaatcggtgcagatgactatgtagttaaaccttttgaaccaaaagaattattagctagagtaaaagcggttatgagaagatattcaggagaagagccagataatgtagtattaaacttcccaggtttaactatagatgctaactcatataaagttatatacaatggagaagaagttaaaactcctcctaaagaatttgaacttttacactatcttgcaagtaacaagaataaagttttcacaagagatcaattattatgtgaagtttggggatatgattacccaggttattcaagaactgttgatgttcacataaagagattaagagaaaaattaaacggtggagaagactggcaacttgaaactgtttggggtgttgggtataaatttgaggtgaaataa

SEQ ID NO: 8562 - protein, 228 aa, Clostridium perfringens
MEGLLGKILIVDDDENICEVIKMYLETTGYNVKVAHDGKAAKEEFVNFSPNLVVLDMMLPGIDGMEVLKWIRKDSNVPVIMLTAKGETFDKVLALEIGADDYVVKPFEPKELLARVKAVMRRYSGEEPDNVVLNFPGLTIDANSYKVIYNGEEVKTPPKEFELLHYLASNKNKVFTRDQLLCEVWGYDYPGYSRTVDVHIKRLREKLNGGEDWQLETVWGVGYKFEVK

SEQ ID NO: 8563 - DNA, 798 bp, Clostridium perfringens
  CDS (1)..(798)
atggtattttcatcaaatgtccatcttttcattaaaaactcccctaaaattatttatataaaccttagttttcattgtataatattaagtaagttaaaacaatattttttaaaggttggtggttatatgaataaaacggtacttattgtagaagatgaaatacgtataagatttcttgtaagagattacttcaagaaagagggatttaatgtgttagaagcttctgatggtgaggaagctcttaggatattttctgaaaatatagttgatttagcaatattagatataatgatgccaaaattagatggacttgctgtttgtagaaatataagggaagtttccaatactcctataatattattaacagctaaaagccaagaagaagataaacttttaggttatgagcttggagctgatgactatatgactaaaccttttagtcctaaggttttattagcaaaggctaaagcattattaagaagaacaggtacattaaatgataaaaacattttagattttaatggattaacaataaataaactatctcatgaagtaaaactaaatggagaagaactattactatctcctaaggaatatgatttacttatttacctttcttcaaatgaaggaatagctttatcaagggatagaattctagataatgtttggggctatgattattttggagatataagaacagttgatacgaacataaaaagacttagagagaaattactagataaagctaattatatagctactgttaggggaagtggctataagtttgaggtgaaatag

SEQ ID NO: 8564 - protein, 265 aa, Clostridium perfringens
MVFSSNVHLFIKNSPKIIYINLSFHCIILSKLKQYFLKVGGYMNKTVLIVEDEIRIRFLVRDYFKKEGFNVLEASDGEEALRIFSENIVDLAILDIMMPKLDGLAVCRNIREVSNTPIILLTAKSQEEDKLLGYELGADDYMTKPFSPKVLLAKAKALLRRTGTLNDKNILDFNGLTINKLSHEVKLNGEELLLSPKEYDLLIYLSSNEGIALSRDRILDNVWGYDYFGDIRTVDTNIKRLREKLLDKANYIATVRGSGYKFEVK

SEQ ID NO: 8565 - DNA, 696 bp, Clostridium perfringens
  CDS (1)..(696)
atgacaaataaaaaagtcctaatagtagatgatgaggaacatattagagaacttataaaatttaatttaaaaaaagagggatatgatacagaggttgctgttaatggaactgaagctctaaaggttataagagaaattaagtttgatttaatacttttagatttaatgcttccagaaatagatggcttagaagtatgtaaagaaattagaagaaatgaagaaacttcagatattccagtaatgatgattacagcaaagggggaagagtttgataaagtattaggcttagaacttggagcagatgattatataacaaagccattttcaataagagaacttatggctagagtaaaagctttactcagaagaagtaatgttaaaaaagaagaaaatataattaaatttggtgatgtagtagttaattttaaaacaagagaagtaacaaaaggaactcaaaatgtagaattaacattaaaagagtttgaattattaaagcttcttataaagaataagggcaatatattaactagagaacttttgcttgataaaatttggggatatgaatacataggtgaaacaagaacagtagatgttcatattagacatttacgtaaaaagattgaaagcgatgataaaaatcctcaatatattcaaactataagaggcgttgggtataagtttacaagtaatgagtaa

SEQ ID NO: 8566 - protein, 231 aa, Clostridium perfringens
MTNKKVLIVDDEEHIRELIKFNLKKEGYDTEVAVNGTEALKVIREIKFDLILLDLMLPEIDGLEVCKEIRRNEETSDIPVMMITAKGEEFDKVLGLELGADDYITKPFSIRELMARVKALLRRSNVKKEENIIKFGDVVVNFKTREVTKGTQNVELTLKEFELLKLLIKNKGNILTRELLLDKIWGYEYIGETRTVDVHIRHLRKKIESDDKNPQYIQTIRGVGYKFTSNE

SEQ ID NO: 8567 - DNA, 738 bp, Ralstonia solanacearum
  CDS (1)..(738)
atgagcggcaccaagatcctggtcgtcgatgacgacgtcgaattgcgcgacctgctgcgcgaatatctgagccagcagggctttgcggtttccgtcctgcacgatggcgacggcctggccgcgcgcctggagcgggagcgcccggcactggtggtgctggacctgatgatgccgaaggtggacggcctgtccgccctgcgcgacctgcgcgcgcgcaacgacgatgtgccggtcatcctgctcaccgcgcgcagcgacgagatcgaccgcatcatcggcctggagatcggcgccgacgattacctcggcaagcccttctcgccgcgcgagttgctggcccgcatcaacgccgtgctgcgcaggcgccaggcggtcgcgcccgctgcgccggaagaccgcgacagcttcagcttcggcccgttccggctcaatttccgcatgcgcacgctgttccgcggcgagcatgccctgtccatcagcgataccgaattcgccctgctcaagctgctggtcacgcacgccatgcaggtgctcacccgcgagcacatcgtcgagctgatgtacggcccgggcagcagcgtgtccgatcgcggcatcgatgtgcaggtctggcgcctgcgccgcgtgctcgatgaggacgcccagcgcccgcgctatatccagaccgtgcgcggccgcggttacaccttcgttcccgacgagcgggatgcgcacgatgaagttcaaagcccggtttga

SEQ ID NO: 8568 - protein, 245 aa, Ralstonia solanacearum
MSGTKILVVDDDVELRDLLREYLSQQGFAVSVLHDGDGLAARLERERPALVVLDLMMPKVDGLSALRDLRARNDDVPVILLTARSDEIDRIIGLEIGADDYLGKPFSPRELLARINAVLRRRQAVAPAAPEDRDSFSFGPFRLNFRMRTLFRGEHALSISDTEFALLKLLVTHAMQVLTREHIVELMYGPGSSVSDRGIDVQVWRLRRVLDEDAQRPRYIQTVRGRGYTFVPDERDAHDEVQSPV

SEQ ID NO: 8569 - DNA, 660 bp, Ralstonia solanacearum
  CDS (1)..(660)
atgatcctgatcgttgaagacgaacccaagctcgccgcgctgatggcggactatctgcgcgccgcccactacgagaccgagtgggtggatgacggcacccgcgccgtgcagcgcgtgcgcgagacctcccccgagctggtgctgctggacctgatgctgcccggcaaggacgggctggagatctgccgcgaggtgcgcgctttcagcgacctgcccatcgtcatggtgaccgcgcgcgtggaagagatcgaccggctgctggggctcgagctgggcgcggacgactacatctgcaagccgttcagcccgcgcgagctggtcgcgcgcatcaagaccatcctgcgccgcgtgcagcgcagcggcgcgcagtccgacagcctcctgcagatcgacaacaccgcctattcggccacgctgcgcggccagcggctcgatctcacgccggtggagttccgcctgctgagcgcgctggccaacgcgccgggccgcatcctgtcgcgcgccaacctgctggagcagatctacgacgaccaccgcgtggtcaccgaccgcaccgtcgatacgcacgtcaagaacctgcgccgcaagatggagctggtgagccccggcacggagctgatccactcggtctacggcgtcggctatcggctcgatgcctga

SEQ ID NO: 8570 - protein, 219 aa, Ralstonia solanacearum
MILIVEDEPKLAALMADYLRAAHYETEWVDDGTRAVQRVRETSPELVLLDLMLPGKDGLEICREVRAFSDLPIVMVTARVEEIDRLLGLELGADDYICKPFSPRELVARIKTILRRVQRSGAQSDSLLQIDNTAYSATLRGQRLDLTPVEFRLLSALANAPGRILSRANLLEQIYDDHRVVTDRTVDTHVKNLRRKMELVSPGTELIHSVYGVGYRLDA

SEQ ID NO: 8571 - DNA, 684 bp, Ralstonia solanacearum
  CDS (1)..(684)
atgcacatcctcctaatagaagacgatcagaaagcggcccgcctgctggccaggggcttgcaggaggaaggcttcgaggtggcggtcgcgcattccgcggaagaggccgatgcctcgcttctggtggcatgccagctgatcatcctggattggatgctcccgggcaaggacggcatcgccctgtgccgcgagctgcgcgagcgcgatctccagacccccgtcctcatgctgaccgcccgcgacgcgaccgccgatcgcatcgccggcctggataccggcgccgacgactacctgaccaagcccttcgtcttcgatgagttgctcgcccgcgtccgcgcgctgttgcggcgggcccggctggcgcccgccgcgccgcgggtcatcggcgacctcgtgctcgatccgaacgcgcgggcggtgacgcgcggcggccaggcgctcgatgtcacgcccaaggaatacgcgatcctcgaatatctgatgcggcatgccgggcagatcgtcagccgcctgcagctggccgagcacgtctggcgcgccgacctgatcgcgatcgacaacctcatcgacgtgcacatgaagaacctgcgccgcaaggtcgatccgcccggccagccggccctcatccatacggtgcggggccagggctttcgcctcgcggcgccggagcgccggcatgcttag

SEQ ID NO: 8572 - protein, 227 aa, Ralstonia solanacearum
MHILLIEDDQKAARLLARGLQEEGFEVAVAHSAEEADASLLVACQLIILDWMLPGKDGIALCRELRERDLQTPVLMLTARDATADRIAGLDTGADDYLTKPFVFDELLARVRALLRRARLAPAAPRVIGDLVLDPNARAVTRGGQALDVTPKEYAILEYLMRHAGQIVSRLQLAEHVWRADLIAIDNLIDVHMKNLRRKVDPPGQPALIHTVRGQGFRLAAPERRHA

SEQ ID NO: 8573 - DNA, 714 bp, Ralstonia solanacearum
  CDS (1)..(714)
atgccgagcagtattctggtcgtggaagatgaaccggcgatcgccgagctgatcgccgtcaacctgcagcacgcgggtcactatccgattcgtgcctacaatgccgagcaggcgctgtcgctgatgagcgacgtgctgcccgacctcgtcctgctggactggatgctgccgggcaagtccggcgtgatgttcgccaaggaactgcgcgccaacgagcgcacccgtcagatcccgatcatcatgctgaccgcccgcagcgaagagcaggacaagatcatgggcctggacgccggcgccgacgactacgtcaccaagccgttttcgcccaaggagttgcttgcccgcatcaaggccgtactgcgccgccgcgcgccgcagctgaccgacgacgtggtcgccatcaacggccttcggctggacccggccacccaccgcgtgaccgccgtgaacagcgagtcggaaaaccccatcaagctggatctgggcccgaccgaattccgcttgctgcatttcctgatgacgcacccggagcgcgtgcatagccgttcgcagttgctcgatcaggtgtggggcgaccacgtcttcgtggaagagcgcaccgtggacgtgcacatcaagcgcctgcgcgcggcgctcgccccgggcggctacagcagcatgatcgaaaccgtgcgcggcagcggctatcgcctggcacgcaatcccggacagtaa

SEQ ID NO: 8574 - protein, 237 aa, Ralstonia solanacearum
MPSSILVVEDEPAIAELIAVNLQHAGHYPIRAYNAEQALSLMSDVLPDLVLLDWMLPGKSGVMFAKELRANERTRQIPIIMLTARSEEQDKIMGLDAGADDYVTKPFSPKELLARIKAVLRRRAPQLTDDVVAINGLRLDPATHRVTAVNSESENPIKLDLGPTEFRLLHFLMTHPERVHSRSQLLDQVWGDHVFVEERTVDVHIKRLRAALAPGGYSSMIETVRGSGYRLARNPGQ

SEQ ID NO: 8575 - DNA, 840 bp, Ralstonia solanacearum
  CDS (1)..(840)
atgggcattcagatcttgctggttgaacaggaccaggctgagggggagcgactgtcgttgtccctgcgcgatggcggacaccacgcccagcgcgtcgacagtccggcgcaggcgcaggccgcgatgcaggcatcgcagccggacctgctgctgatggagtggaactggccggaatgcgagtcgatcgacatgctgctggccctgcgtgccagcgcgcacacgcgcagcctgccggtcatcgtgctgtcgcgccacggcgacgcgcgcgccaagatcgcggcactcgatgccggcgccgacgattacgtggtcaagccctgcgatgtgggcgagctgcatgcccgcattcgtgccgtgctgcgccgccgctcgccgcagcagggggacgagatcctgcagatcaacggcctgcggcttgacccgctcacgctgggcgtgaccgcgcagacggacgaggggccgcggccggtcgcgctgagcccgctggaattccgcctgctgcatttcctggtggcgcatccgcagcgcgtgcattcgcgcacccaactgctcgaccgcgtctggggcaaccaggtcttcgtgggcgaacgcacggtcgatgtgcacgtccgcaaactgcgcgtggcgctggagggcacgctgtgcgatggcctgatccagaccgtgcgcggcggcggttatcgcctgctggtcggcaatggtgtccaccaggggccatccggcgaggcgatcgacgcgcaattcgaggtcgcggcgcgcgagcatgatgagtcttcggcttacgaaggcccttcggcccgtacccgcgctgcccgggagccggcccgcctgaacgcctga

SEQ ID NO: 8576 - protein, 279 aa, Ralstonia solanacearum
MGIQILLVEQDQAEGERLSLSLRDGGHHAQRVDSPAQAQAAMQASQPDLLLMEWNWPECESIDMLLALRASAHTRSLPVIVLSRHGDARAKIAALDAGADDYVVKPCDVGELHARIRAVLRRRSPQQGDEILQINGLRLDPLTLGVTAQTDEGPRPVALSPLEFRLLHFLVAHPQRVHSRTQLLDRVWGNQVFVGERTVDVHVRKLRVALEGTLCDGLIQTVRGGGYRLLVGNGVHQGPSGEAIDAQFEVAAREHDESSAYEGPSARTRAAREPARLNA

SEQ ID NO: 8577 - DNA, 693 bp, Rhizobium loti
  CDS (1)..(693)
atgccgcatcacatcctcgtcgccgacgatgacccgcatatccgcgaggtgatctgcttcgcgctggaaaaggccggcatgaagacgcttggggtggccgatggcgccgccgcattgcaggaaatcggacgccgtgcgcccgacctcgttgtgctcgacatcggcatgccggagatggacgggctggaggtctgccggcggctgcgccacacatcggacgtgccggtgctgttcttgtccgcgcgcgacgaggagatcgaccgcatcctcgggctcgaaatgggtggcgacgactatgtgacgaagccgttcagtccgcgcgagctggtcgcccgcgtcaacgtcatcctgcgccgcgcccgcccggcggcgcccgaagcggccgacgaccggcagttttcacatggcaagctcactctggcgccggccagccacgccgccgccttcgacggcacgccgcttgccctgacagggatagagttctccatcctgaaggggtttctggcgcggccggcgcatgtgctcgaccgtgacgcggtgatggcaaacgcctatgccggcaagatccatgtcgccgaccgcaccgtcgacagccatatccgcaacatccgcgccaagctggcggcggtcggctgcgtggacgccatcgagaccgtgcatggcgtcggcttccggctcggccgatgcggctga

SEQ ID NO: 8578 - protein, 230 aa, Rhizobium loti
MPHHILVADDDPHIREVICFALEKAGMKTLGVADGAAALQEIGRRAPDLVVLDIGMPEMDGLEVCRRLRHTSDVPVLFLSARDEEIDRILGLEMGGDDYVTKPFSPRELVARVNVILRRARPAAPEAADDRQFSHGKLTLAPASHAAAFDGTPLALTGIEFSILKGFLARPAHVLDRDAVMANAYAGKIHVADRTVDSHIRNIRAKLAAVGCVDAIETVHGVGFRLGRCG

SEQ ID NO: 8579 - DNA, 690 bp, Rhizobium loti
  CDS (1)..(690)
atgatcgcaccacgcatcatggtggtggaggacgaggagccgctcggcgtgctcctccgctacaatctggaatcggagggttaccaggtcgaggtggtgacacgcggcgacgaagccgaaatccgcctgcaggagaacgtgcccgatctcctggtgctcgactggatggtgccggcggtgtccggcatcgaactctgccggcgcctgcggatgcggcccgagaccgagcggctgccgatcatcatgctgaccgcgcggggcgaggaaagcgaccgtgtgcgtgggctctccaccggcgccgacgactatctggtcaagccgttttcgacgccggaattcatggctcgcgtgaaggcgctgctacgccgcgccaagccggaagtgctgtccagcgtgctcaaggtcggcgacatcgtgctcgaccgtgaatcacaccgggtctatcgcaaaaagagcgagatccggctcgggccgactgaattccgcctgctcgaattcatgatgcgtcatcccggccgcgtgttctcgcgcagccagctgctcgacaatgtctggggcgagacgatctacatcgacgagcgcaccgtggacgtgcatgtcggccgcctgcgcaaggcggtcaacaatggccgcatgccggatgttatcagaaccattcgtggggcgggctacgcgatccgcgaggattga

SEQ ID NO: 8580 - protein, 229 aa, Rhizobium loti
MIAPRIMVVEDEEPLGVLLRYNLESEGYQVEVVTRGDEAEIRLQENVPDLLVLDWMVPAVSGIELCRRLRMRPETERLPIIMLTARGEESDRVRGLSTGADDYLVKPFSTPEFMARVKALLRRAKPEVLSSVLKVGDIVLDRESHRVYRKKSEIRLGPTEFRLLEFMMRHPGRVFSRSQLLDNVWGETIYIDERTVDVHVGRLRKAVNNGRMPDVIRTIRGAGYAIRED

SEQ ID NO: 8581 - DNA, 708 bp, Streptococcus thermophilus
  CDS (1)..(708)
atgaaaaaaattctagttgttgatgatgaaagaccaatctccgatatcatcaagtttaaccttactaaggagggttatgaagtggttacggcctttgatgggcgagaagctttggaacaatttgaagctaaaaaaccagacttggttattctggacttgatgttgcctgaactggatggtttggaaattgtcaaggaaatccgtaaaacgagccacacaccgattatcatgctttcagctaaagatagtgagtttgataaggttgtcggattagaaattggggcagacgactatgtgactaagccattttctaaccgtgaattgttggcacgtattaaagcccacttgcgtcgtacagaaacgattgaaactgcagtagaagagagctctaactctggcaaacaagaaatttcaattggtgagttgattattgttccggatgcctttgttgctaaaaaacgtggaaacgaagttgagttgacccaccgtgaatttgagttactcttccatttggcaactcatatgggacaagttatgacgcgtgaacatttgcttgaaaccgtttggggctatgactattttggggatgttcgtactgtggacgtaacgattcgtcgtctgcgtgaaaaaattgaagatacacctagccgtcctgaatatatcttgacgcgtcgtggtgtcggttattacatgaagaattatgactag

SEQ ID NO: 8582 - protein, 235 aa, Streptococcus thermophilus
MKKILVVDDERPISDIIKFNLTKEGYEVVTAFDGREALEQFEAKKPDLVILDLMLPELDGLEIVKEIRKTSHTPIIMLSAKDSEFDKVVGLEIGADDYVTKPFSNRELLARIKAHLRRTETIETAVEESSNSGKQEISIGELIIVPDAFVAKKRGNEVELTHREFELLFHLATHMGQVMTREHLLETVWGYDYFGDVRTVDVTIRRLREKIEDTPSRPEYILTRRGVGYYMKNYD

SEQ ID NO: 8583 - DNA, 696 bp, Pasteurella multocida
  CDS (1)..(696)
atgaccaaaatactggtggttgaagatgaaagtgcgattcgcgaaatgatcagcctattcttaacacaacaaggttatgacattattgaagcggctgattatcaaagtgcggtcaaaaaattagtagaaaagccacaactcattttattagactggatgttgcccggtcgttctggtatccaatttattcagtttttgaaaaaacacgaagacaccgaaaacatccctgtcatcatgctgactgcgcgtagtgaagaagaagattgtattaccggcttaaatacaggcgcggatgattacatcactaaacctttctcacctaaaatcttacttgccagaattgaagccatgctccgacgtgtttatgaacaaagccagaatagcattgaaattgacgggctacttttagatcaaaatgccttgcgggtgagctatcaaaaaaatgtgattaaccttagctcgactgaatttaaactgcttaaatttctcatgactcaccctgaaaaagtctatacacgcgaacagctattagattgtatttggggaaatgatatttatgtggaagatagaacggtagatagctatattcgtcgcttacgcaaaagccttgagcaatatggttttgatcgctatatccaaacggtacgtggggcgggctatcgtttttcgcctcattttcaggacgagatgaaatga

SEQ ID NO: 8584 - protein, 231 aa, Pasteurella multocida
MTKILVVEDESAIREMISLFLTQQGYDIIEAADYQSAVKKLVEKPQLILLDWMLPGRSGIQFIQFLKKHEDTENIPVIMLTARSEEEDCITGLNTGADDYITKPFSPKILLARIEAMLRRVYEQSQNSIEIDGLLLDQNALRVSYQKNVINLSSTEFKLLKFLMTHPEKVYTREQLLDCIWGNDIYVEDRTVDSYIRRLRKSLEQYGFDRYIQTVRGAGYRFSPHFQDEMK

SEQ ID NO: 8585 - DNA, 699 bp, Corynebacterium glutamicum
  CDS (1)..(699)
atgacgagaatcctgatcgttgaagatgaggaatcgttagcagatcctttggcctttcttcttcgcaaagaaggttttgacaccatcatcgccggtgatggcccaaccgcacttgtggagttcagtcgcaacgaaatcgacatcgtcctcttagacctcatgctcccaggcatgtctggcaccgacgtatgcaaagaactccgcagcgtatccactgttcccgtcatcatggtcaccgcccgcgactccgagatcgacaaagttgttggcctcgaactcggcgccgatgattatgtaaccaagccatattcttcccgcgaactcatcgcccgcatccgcgctgtcctgcgccgacgcggagttactgaaaccgaagccgaagaattaccacttgacgatgaaatcctcgaaggcggccgcgtccgcatggacgtcgattcccacaccgtcaccgtcggtggcgaaccagtgagcatgccactgaaggaattcgaccttctggagtacctcctccgaaacgccggccgagtcctcacccgcggacagctcatcgaccgaatttggggcgcagattacgtcggcgacaccaaaaccctcgacgttcatgtcaaaaggttgcgttccaagatcgaagaagagccatctcgccctcgttacctcgtgaccgtgcgtggattgggctacaaattcgagctgtag

SEQ ID NO: 8586 - protein, 232 aa, Corynebacterium glutamicum
MTRILIVEDEESLADPLAFLLRKEGFDTIIAGDGPTALVEFSRNEIDIVLLDLMLPGMSGTDVCKELRSVSTVPVIMVTARDSEIDKVVGLELGADDYVTKPYSSRELIARIRAVLRRRGVTETEAEELPLDDEILEGGRVRMDVDSHTVTVGGEPVSMPLKEFDLLEYLLRNAGRVLTRGQLIDRIWGADYVGDTKTLDVHVKRLRSKIEEEPSRPRYLVTVRGLGYKFEL

SEQ ID NO: 8587 - DNA, 1229 bp, Streptomyces coelicolor
  CDS (246)..(932)
ggagcagcgccccggatatgaagtgaccgaggtcacagcacctcaggtgccggtggcgggagcgggaggcgggattccggtggcacccctggggacccaggcgtacaacccggcgttcgatgtgactccgcccgaactggtgacggcgatcgtcaccgaggagggtgtggtttcgcccgtgaccaccgaggccctggcctcgctgtgtgccaggtcacgccaggtaacgattagctaatgggatgatgtcgtttatgaagggacgagtccttgtcgtcgacgacgacaccgcactggccgagatgctcggcattgtgctgcgtggtgagggttttgagccgtctttcgtagccgacggcgacaaggcgctggccgccttccgggagaccaagccggacctggtgctgctcgacctgatgctgcccggacgggacggcatcgaggtgtgccgcctgatcagggcggagtcgggtgtgccgatcgtgatgctgacggcgaagagcgacaccgtcgacgtcgtggtgggtctggagtcgggcgccgacgactacatcgtgaagccgttcaagccgaaggagctggtggcccggatccgggcgcggctgcgcaggtcggaggaaccggcgccggagcagctcgccataggcgacctggtcatcgacgtggccggtcactccgtgaagcgggacgggcagtcgatcgcgctgacgccgctggagttcgacctgctggtggcgctggcccgcaagccgtggcaggtgttcacgcgcgaggtgctcctcgagcaggtctggggctaccggcacgccgccgacacccgcctggtcaacgtgcacgtccagcggctgcgctccaaggtcgagaaggacccggagaagccggagatcgtggtgaccgtccgcggcgtcggctacaaggccggaccgagctgacatggccagggacagtgccgcttcggcgcccgggtccggggcccgcgccggacggcctgtcggccaccggagcgtcggctcccgtctcttcggccgtgtgctggagggcgggctgctgcacggcggggtgcagggcagcccggtgctccgcctgttcatgcgctgggtgcgccgccccctgctgccggtcatgcggctgtggcggcgcaacatccagctcaaggtcgtcgccaccaccctgctgatgtcgctgggggtggtgctgctgctcggcttcgtggtgatcgggcaagtccg

SEQ ID NO: 8588 - protein, 228 aa, Streptomyces coelicolor
MSFMKGRVLVVDDDTALAEMLGIVLRGEGFEPSFVADGDKALAAFRETKPDLVLLDLMLPGRDGIEVCRLIRAESGVPIVMLTAKSDTVDVVVGLESGADDYIVKPFKPKELVARIRARLRRSEEPAPEQLAIGDLVIDVAGHSVKRDGQSIALTPLEFDLLVALARKPWQVFTREVLLEQVWGYRHAADTRLVNVHVQRLRSKVEKDPEKPEIVVTVRGVGYKAGPS

SEQ ID NO: 8589 - DNA, 672 bp, Streptomyces coelicolor
  CDS (1)..(672)
atgctcgtcgtcgaggacgaggagtccttctccgacgccctgtcgtacatgctccgcaaggagggcttcgaggtcgccatcgcgaccaccggccccgacggactcgacgagttcgagcgcaacggcgccgacctcgtgctcctcgacctgatgctgcccggcctgccgggcaccgaggtctgccgccagctgcgcggccgctcgaacgttcccgtgatcatggtgaccgccaaggacagcgagatcgacaaggtcgtcgggctggagataggggccgacgactacgtcaccaagcccttctcctcccgcgagctggtcgcccgcatccgagccgtactgcggcggcgcggcgagccggaggaggtcgccccggccgccctggaggccgggcccgtccggatggacgtggaccggcacgtggtgaccgtgggcggcaccaaggtcgacctgccgctgaaggagttcgacctgctggagatgctgctgcgcaacgcgggccgcgtgctgacccgcatgcagctgatcgaccgggtctggggcgccgactacgtcggtgacaccaagaccctcgacgtccacgtcaagcggctgcgcgccaagatcgagcccgacccgggcgcgccgcggtacctggtgacggtgcgcgggctgggttacaagttcgagccgtag

SEQ ID NO: 8590 - protein, 223 aa, Streptomyces coelicolor
MLVVEDEESFSDALSYMLRKEGFEVAIATTGPDGLDEFERNGADLVLLDLMLPGLPGTEVCRQLRGRSNVPVIMVTAKDSEIDKVVGLEIGADDYVTKPFSSRELVARIRAVLRRRGEPEEVAPAALEAGPVRMDVDRHVVTVGGTKVDLPLKEFDLLEMLLRNAGRVLTRMQLIDRVWGADYVGDTKTLDVHVKRLRAKIEPDPGAPRYLVTVRGLGYKFEP

SEQ ID NO: 8591 - DNA, 771 bp, Streptomyces coelicolor
  CDS (1)..(771)
atgctcgaaccgacggccgcccccgccgccgcggcggagcccgcggccgccaccgcccccgccgtcgcccccgcggccgaccccgcccggatcctcgtcgtggacgacgatcccaccgtcgccgaggtcgtggccgggtacctcgaccgggccggttaccgtgtcgaccgggccggtgacgggccggaggcgctcgcgcgggccgccgggcaccgtcccgacctggtggtgctcgacctgatgctgcccggcatggacgggctggaggtgtgccgtcggctgcgcggccaggggccggtgccggtcatcatgctgaccgcccggggcgacgaggacgaccgcgtcctcggactggaggtcggcgccgacgactacgtgaccaagccgttcagcccgcgggagctggtgctgcgggtggagtccgtcctgcgccgcacccggcccgccccggcgccgcgcccgccgtccgcggccggtctgaccgccgacccggccgcccgcagggccaccaaggacggcgccgaactggcgctgaccctgcgcgagttcgacctgctcgccttcttcctgcggcatccgggacgggcgttcgcccgggaggagctgatgcgtgaggtgtggggctgggacttcggggacctgtccaccgtcaccgtccacgtccggcggctgcgcggcaaggtcgaggacgatccggcccggccccggctgatccagacggtgtggggcgtgggctaccgcttcgaccccgcgggccgggaggcggactga

SEQ ID NO: 8592 - protein, 256 aa, Streptomyces coelicolor
MLEPTAAPAAAAEPAAATAPAVAPAADPARILVVDDDPTVAEVVAGYLDRAGYRVDRAGDGPEALARAAGHRPDLVVLDLMLPGMDGLEVCRRLRGQGPVPVIMLTARGDEDDRVLGLEVGADDYVTKPFSPRELVLRVESVLRRTRPAPAPRPPSAAGLTADPAARRATKDGAELALTLREFDLLAFFLRHPGRAFAREELMREVWGWDFGDLSTVTVHVRRLRGKVEDDPARPRLIQTVWGVGYRFDPAGREAD

SEQ ID NO: 8593 - DNA, 696 bp, Zymomonas mobilis
  CDS (1)..(696)
atggccgctttacggctactactcgttgaagatgacgatgctcttgccgaattactgaaatggcattttagcaagcaaaattttgaagttgttcatacgcgagatggggatgaagccttattattggcgcgggaaaatccgcccgatattatgcttcttgactggatggtagaaggcacttcggggatcgaagtctgtcggcagttacggcgttatccagaaacggctaatcttccgattattatgctgacggcgcggggcgaagaagatgaccggattagaggacttgaaaccggcgcggatgattatgtcaccaaacctttttcacctcgtgagctggttgcaagagtccttgctgtgttgcgtcgcatccgccctgcccttagcaaagaacaattgaactataatgatatagaaatggatttggtcagtcatcgcgttaaacgagctggcacaaatgtttcgataggcccgacggaatttcgtctcttaaggcatttgatggaatatccaagacgcgtcttttcgcgagaaaagcttctggattatatctgggggcaggatagtgacatcgaattaaggactgttgatgttcatatccgccgtcttcggaaagctttaaatcgggacggcttgccagatcttatcaggacagtccgttccgctggttatgccttggatacagatgaagaataa

SEQ ID NO: 8594 - protein, 231 aa, Zymomonas mobilis
MAALRLLLVEDDDALAELLKWHFSKQNFEVVHTRDGDEALLLARENPPDIMLLDWMVEGTSGIEVCRQLRRYPETANLPIIMLTARGEEDDRIRGLETGADDYVTKPFSPRELVARVLAVLRRIRPALSKEQLNYNDIEMDLVSHRVKRAGTNVSIGPTEFRLLRHLMEYPRRVFSREKLLDYIWGQDSDIELRTVDVHIRRLRKALNRDGLPDLIRTVRSAGYALDTDEE

SEQ ID NO: 8595 - DNA, 702 bp, Tolypothrix sp
  CDS (1)..(702)
atggtagacgacgaagccagcattcgccggattttggaaacgcgcctttccatgattggctacgatgtagtgacggctggtgatggagaagaagctttggaaacttttcgcaaagctgaccccgatctagtagttttggatgtcatgatgccaaaacttgatggctacggtgtttgccaagaactacgtaaggagtcagatgtccctattattatgctaacagccttaggggacgtagccgatcgcatcaccggattagagttaggcgctgatgactatgtagttaagccgttttccccaaaggaactagaagcccggattcgctctgtactcagacgggtagacaaaaccagtgcttcgggaattcctagttctggagtcatccacgttgctaatatcaaaattgatacgaataagcgacaagtttacaaaggtgatgagcgcattcgcctaactggtatggaatttagcttactagagttattggttagtcgctccggagaagctttttcccgttcagaaattttgcaagaagtatggggttacacaccagaacgccatgtagatacccgcgtggtggatgtgcatatctcccgtttgcgcgccaaattagaagacgatcccagcaaccctgaattgattcttaccgcccgtggcactggttatttattccaacggataattgaacctggggaggaataa

SEQ ID NO: 8596 - protein, 233 aa, Tolypothrix sp
MVDDEASIRRILETRLSMIGYDVVTAGDGEEALETFRKADPDLVVLDVMMPKLDGYGVCQELRKESDVPIIMLTALGDVADRITGLELGADDYVVKPFSPKELEARIRSVLRRVDKTSASGIPSSGVIHVANIKIDTNKRQVYKGDERIRLTGMEFSLLELLVSRSGEAFSRSEILQEVWGYTPERHVDTRVVDVHISRLRAKLEDDPSNPELILTARGTGYLFQRIIEPGEE

SEQ ID NO: 8597 - DNA, 714 bp, Lactobacillus sakei
  CDS (1)..(714)
atggctaaaaaaatattggtagttgatgatgaaaaacccatctcggatatcgttaagtttaatctaacgaaagagggctatgatgtttacacagcttatgatggggaagaagcactacaacaagtagaagaagttgtccctgacttaattctattagatttgatgttacctaaggttgacggtcttgaagtcgctcgccaggtacgcaaatcacacgatatgccaattattatggtaacagctaaagattcagaaattgataaagtgattgggctagaattaggcgctgatgattatgtcacaaaacctttttccaatcgtgaattggttgcccgtgttaaagcaaatttaagacgccaagggtcaaccagtcaatctgataaagaagcaaatgaggaaaaccacgaaattaacattggcgacctcacgattcacccagaagcttatattgtgtctaaacggggcacgaagattgaattaacgcatcgtgaattcgaattattacattacttagccaaacatattgggcaagtaatgacgcgtgaacatttattacaaacagtttggggttatgactattttggtgatgtgcgcacagtagatgtcacagtccgtcgtttacgtgagaagattgaagataatcctagtcatccagaatggttagtaacgcgtcgtggtgttggttattatttaagaaatcctgagcaggagtaa

SEQ ID NO: 8598 - protein, 237 aa, Lactobacillus sakei
MAKKILVVDDEKPISDIVKFNLTKEGYDVYTAYDGEEALQQVEEVVPDLILLDLMLPKVDGLEVARQVRKSHDMPIIMVTAKDSEIDKVIGLELGADDYVTKPFSNRELVARVKANLRRQGSTSQSDKEANEENHEINIGDLTIHPEAYIVSKRGTKIELTHREFELLHYLAKHIGQVMTREHLLQTVWGYDYFGDVRTVDVTVRRLREKIEDNPSHPEWLVTRRGVGYYLRNPEQE

SEQ ID NO: 8599 - DNA, 684 bp, Rhizobium meliloti
  CDS (1)..(684)
atgttgccgaagattgccgtagtcgaagatgaggaagccctaagcgttctcctgcgctacaatctcgaggcagaaggcttcgaggtcgatacgatccttcgcggcgacgaggcggagatccgcctgcaggagcgcctgcccgaccttctcatcctcgattggatgctgcccggggtttccggcatcgagctctgccgcaggctgcgccagcggccggaaacggagcgcctgccgatcatcatgctgacggcgcgcggcgaggagagcgagcgcgtgcggggccttgccaccggggccgacgattacgtcgtcaagcccttctcgacgccggaactgatggcgagggtcaaggctatgctcaggcgcgccaagcccgaggttctgtcgacgctcctgcgctgcggcgatatcgagctcgaccgggagacgcaccgcgtccaccgccgcagccgtgaagtgcgcctcggcccgacggagttccggctgctggaatttctcatgtcctcaccggggcgcgtcttctcccgttcacagctcctggacggtgtctgggggcacgacatctatgtcgacgaacggaccgtggacgtccatgtcggacgtctgcgcaaggcactgaacttctccaacatgcccgacgtcatccggacggtgcgcggcgcgggctattcgctggagagctga

SEQ ID NO: 8600 - protein, 227 aa, Rhizobium meliloti
MLPKIAVVEDEEALSVLLRYNLEAEGFEVDTILRGDEAEIRLQERLPDLLILDWMLPGVSGIELCRRLRQRPETERLPIIMLTARGEESERVRGLATGADDYVVKPFSTPELMARVKAMLRRAKPEVLSTLLRCGDIELDRETHRVHRRSREVRLGPTEFRLLEFLMSSPGRVFSRSQLLDGVWGHDIYVDERTVDVHVGRLRKALNFSNMPDVIRTVRGAGYSLES

SEQ ID NO: 8601 - DNA, 687 bp, Mycobacterium smegmatis
  CDS (1)..(687)
atgaccagcgtgttgatcgttgaagacgaggaatcgctggccgatcccttggcgtttctgctccgtaaggagggcttcgaggccaccgtggtgggcgacggcccgtcggccctcgcggagttcgaacgctccggcgccgacatcgtgctgctggatctcatgctccccggcatgagtggcaccgacgtgtgcaagcagttgcgtgcgcggtcaagcgtccccgtcatcatggtgacggcgcgcgacagcgagatcgacaaggtggtcggcctcgagctcggtgctgacgactatgtcaccaagccgtactcggcgcgtgaactcatcgcccggattcgtgcggtgttgcgccgtggcgccgacaacgacgacgcgggcgccgacgacggcgtgctggaggccggtcccgtgcgcatggacgtcgaacgacacgtggtgagcgtcaacggtgaaccgatcacgttgccgctcaaggagttcgacctgctcgagtacctgatgcgcaacagtggtcgcgtgctcacccgcggtcagctcatcgaccgggtgtggggtgcggactacgtcggcgacaccaaaacccttgacgtgcacgtcaaaaggctgcggtcgaagatcgaggaggatccggccaacccggtgcacctggtgaccgtacgcggcctgggatacaagctggagggctga

SEQ ID NO: 8602 - protein, 228 aa, Mycobacterium smegmatis
MTSVLIVEDEESLADPLAFLLRKEGFEATVVGDGPSALAEFERSGADIVLLDLMLPGMSGTDVCKQLRARSSVPVIMVTARDSEIDKVVGLELGADDYVTKPYSARELIARIRAVLRRGADNDDAGADDGVLEAGPVRMDVERHVVSVNGEPITLPLKEFDLLEYLMRNSGRVLTRGQLIDRVWGADYVGDTKTLDVHVKRLRSKIEEDPANPVHLVTVRGLGYKLEG

SEQ ID NO: 8603 - DNA, 765 bp, Guillardia theta
  CDS (1)..(765)
atgataaaaaacagatgtttagatattgatttagaaactaaagaaaaagtattaattgttgatgatgaagcaagtattcgtaaaatattggaaactcgtttgagtatgattgggtattttgttgtcactgctagtgatggcgaagaagctttaaatttgtttcatcaagaaatgccagatgttgtaattttagatataatgatgccaaagttagacggttatggagtctgtcaagaaattagaaaagactccgatgttcctataattatgttaacagctttaggtgatgttgcagatcggattactggattggagcttggggcagatgattatgtagtaaaacctttttcaccaaaagaacttgaagcacgtattagagcggtattaagacgaacaaataaagctgctttttcgtctcatttaactacttctggaataataaattttaattttttgactattgatttaaacaagagacaaatttataaagataatgaacgaatacgacttacaggcatggaatttagtttattagagttattaataagtagatctggtcaaccattttctagagcagatatactgcaggaagtttggggatatactcctgagcgtcatgttgatacgcgtgttgtagatgttcatatttcacgtttacgggcaaaattagaaactgatccaagtaatccggatttaattttaacagctagaggtactggatatttattccaacgtattacggatcaacatgtattaaaaacttga

SEQ ID NO: 8604 - protein, 254 aa, Guillardia theta
MIKNRCLDIDLETKEKVLIVDDEASIRKILETRLSMIGYFVVTASDGEEALNLFHQEMPDVVILDIMMPKLDGYGVCQEIRKDSDVPIIMLTALGDVADRITGLELGADDYVVKPFSPKELEARIRAVLRRTNKAAFSSHLTTSGIINFNFLTIDLNKRQIYKDNERIRLTGMEFSLLELLISRSGQPFSRADILQEVWGYTPERHVDTRVVDVHISRLRAKLETDPSNPDLILTARGTGYLFQRITDQHVLKT

SEQ ID NO: 8605 - DNA, 738 bp, Bacillus subtilis
  CDS (1)..(738)
atgacaatgacttcaaggagtgatcaatatatgtcacggcttcacagcaaagtattaatcatagacgacgaaaaagaaattttggaactgatcaaaaccgtattaataagagaaggcattgatcgcgtgatcaccgcttcgactgcccgtgacggattggctcaatttcatcaagaaaattccgatcttgtgatattggatatcatgctgccagacggtgaaggctatgatatctgcaaacaaataagagacatttcacacgttccgattatctttttgtctgcaaagggggaggaaacggataaaattgtaggacttgccatcggcggggacgactacattacaaaacctttcagccctaaggaagttgcatatcgggtcaaagcgcagctgagacgggtctcttacttacagccttctcaaaccggaaccgtgataaaaaaaggaccatttgaattaaaccaacaacaagccgagctcaccaaaaatggagcggctattgagttaacacctaaagaacttatgcttatgacctattttctgcagcatcccaatcgggtgatcagtaaagaaacactctatcaagctgtatggggagaagatttcttcggttctgacaacacggtgatggttcatatacgcaggctccgtgagaaaatagaaaacaccccatcaaaaccagactttctcgtcactgtgaaagggttaggctacaaatttgctgtaaaggatgcgtaa

SEQ ID NO: 8606 - protein, 245 aa, Bacillus subtilis
MTMTSRSDQYMSRLHSKVLIIDDEKEILELIKTVLIREGIDRVITASTARDGLAQFHQENSDLVILDIMLPDGEGYDICKQIRDISHVPIIFLSAKGEETDKIVGLAIGGDDYITKPFSPKEVAYRVKAQLRRVSYLQPSQTGTVIKKGPFELNQQQAELTKNGAAIELTPKELMLMTYFLQHPNRVISKETLYQAVWGEDFFGSDNTVMVHIRRLREKIENTPSKPDFLVTVKGLGYKFAVKDA

SEQ ID NO: 8607 - DNA, 678 bp, Geobacter sulfurreducens
  CDS (1)..(678)
atgaaaacgatacttatcatcgaagacgagcgcgacctggccgatctggtggccttcaaccttgaaaaagaagggtatcggaccctcacggcactggatggcgcgaacggcctggaattggcccgcagccagccccccgacctgatcctgctggacctgatgctgccgggaatgatggggatggaggtctgcaaaatcctcaagaagtcggaaaagaccgcccatatcccggtcatcatgctgacggcacgcggcgaggagatcgaccgtgtggtcggcttcgaggtcggggccgacgactacgtggtaaaacccttctctacccgcgagttgctgctcagggtgaaagcggtgctgcgccgctccctccccgacaagccggaaggaaaggtcatcaatgtcgggccggtgacgatcgatacggagcgtcacatggtggccgtggagggagatgatgtcaccctgaccacgaccgagttcaaacttctgctgaaccttgccgagcggctcggtcgggtccagagccgcgacctccttctcaaaaacgtgtggggatataattacgtgggagacacccgcacggtggatactcatatcacccgcctgcggacgaagctgggacaggccggagagctgatcaagaccgtccgcggcttcggctacaagatggaggaatag

SEQ ID NO: 8608 - protein, 225 aa, Geobacter sulfurreducens
MKTILIIEDERDLADLVAFNLEKEGYRTLTALDGANGLELARSQPPDLILLDLMLPGMMGMEVCKILKKSEKTAHIPVIMLTARGEEIDRVVGFEVGADDYVVKPFSTRELLLRVKAVLRRSLPDKPEGKVINVGPVTIDTERHMVAVEGDDVTLTTTEFKLLLNLAERLGRVQSRDLLLKNVWGYNYVGDTRTVDTHITRLRTKLGQAGELIKTVRGFGYKMEE

SEQ ID NO: 8609 - DNA, 684 bp, Geobacter sulfurreducens
  CDS (1)..(684)
atgaccggaacgattctcattgtggaggacgaggagaagattgccaccctgctgcgcgattatctgcgattggcgggatttgacgtctgttgtctggcgggaggtgccgaggctgcgccgtgggtgcgcgaacatgcaccggacctcgttctgctcgacctgatgctgccgggccgcgatggcctggagatctgcaaggatgtccgcgtcttttccagtgtgccgatcatcatgatcacggcgcggatcgaggagatcgaccgcctgctcggccttgaactgggggcggacgactacatctgcaagcccttcagtccccgcgaggtggtggcgcgggtgaaggcggtcctgcgccgtagcggaccgggtcagacaacggcactggccggtctcgtcatggacggggcatgctaccgtgccgcccttgacggtcacgaactggatttgaccgccgtcgagttcaagcttctccagttcctggcggccagccccggcaggatctacagccgccagcaactcatggaccgcatctaccccgacgagcgggtggttgccgaccgtaccatcgacagccacatcaaaaaactgcggaaaaagatcgcggatgtcgctcccggcgaggatctgatccattcagtgtacggggtggggtacaagttcgaacgggcatcgcgccgcgaatga

SEQ ID NO: 8610 - protein, 227 aa, Geobacter sulfurreducens
MTGTILIVEDEEKIATLLRDYLRLAGFDVCCLAGGAEAAPWVREHAPDLVLLDLMLPGRDGLEICKDVRVFSSVPIIMITARIEEIDRLLGLELGADDYICKPFSPREVVARVKAVLRRSGPGQTTALAGLVMDGACYRAALDGHELDLTAVEFKLLQFLAASPGRIYSRQQLMDRIYPDERVVADRTIDSHIKKLRKKIADVAPGEDLIHSVYGVGYKFERASRRE

SEQ ID NO: 8611 - DNA, 741 bp, Mycobacterium paratuberculosis
  CDS (1)..(741)
atgagccagccgcgagcctcagccgagcgggtcgtcatgtgccgcgccgacggcaacccgatcaacgtcctggtcgtcgacgacgaagccgtgctggccgaaatggtgtcgatggcgctgcgctacgagggctggaacatcgccaccgccagcgacggcgcctcggccatcgccgccgcgcgcaaccagcggcccgacgtggtggtcctcgacgtgatgctgcccgacatgagcgggctggacgtgctgcacaagctgcgggaggagaacccccagctgccggtgctgttgctgaccgccaaagacgcggtggaggaccggatcgcgggtctgaccgccggcggcgacgactacgtcaccaaaccgttcagcatcgaagaggtggtgcttcggttgcgggccctgctgcggcgcaccggcgtgacgaccgtggacagcggcgcgcagctggtggtcggcgacctggtgctcgacgaggacagccacgaggtcacccgcgccggcgagccgatctcgttgacatccaccgagttcgagctgttgcggttcatgatgcgcaactccaagcgggtgctgagcaaggctcagatcctggaccgggtgtggagctacgacttcggcggccgatccaacatcgtcgagctctacatttcctatctgcgtaagaagatcgacaacggtcgggagccgatgatccacaccctgcgcggcgcgggttatgtcctcaagcccgctcgctag

SEQ ID NO: 8612 - protein, 246 aa, Mycobacterium paratuberculosis
MSQPRASAERVVMCRADGNPINVLVVDDEAVLAEMVSMALRYEGWNIATASDGASAIAAARNQRPDVVVLDVMLPDMSGLDVLHKLREENPQLPVLLLTAKDAVEDRIAGLTAGGDDYVTKPFSIEEVVLRLRALLRRTGVTTVDSGAQLVVGDLVLDEDSHEVTRAGEPISLTSTEFELLRFMMRNSKRVLSKAQILDRVWSYDFGGRSNIVELYISYLRKKIDNGREPMIHTLRGAGYVLKPAR

SEQ ID NO: 8613 - DNA, 684 bp, Mycobacterium paratuberculosis
  CDS (1)..(684)
atgaccagtgtgctgattgtcgaggacgaggagtcgctggccgacccgctggccttcctgctccgtaaggagggcttcgaggccaccgtggtgaccgacggctccgccgcgctcgccgaattcgatcgggccggcgccgacatcgtgctgctcgacctgatgctccccgggatgtcgggcaccgacgtctgcaagcagctgcgcgcgcgttccagcgtgccggtgatcatggtgaccgcccgggacagcgagatcgacaaggtcgtcggcctcgagctcggcgccgatgactatgtgaccaagccgtattcggcgcgggagctgatcgcgcggatccgggcggtgctgcgccgcggcggtgacgacgactccgagatcagcgacggcgtgctcgaatccggcccggtgcggatggacgtcgaacgccacgtggtttcggtcaacggtgacacgatcacgttgccgctcaaggaattcgacctgctcgagtacctgatgcgcaacagcggccgggtgctgacccgcggccagctgatcgaccgggtgtggggcgccgactacgtcggcgacaccaagacgctcgacgtgcacgtcaagcggctgcgctccaagatcgaagccgacccggccaacccggtgcacctggtgacggtgcgcgggctgggctacaagctggaaggctaa

SEQ ID NO: 8614 - protein, 227 aa, Mycobacterium paratuberculosis
MTSVLIVEDEESLADPLAFLLRKEGFEATVVTDGSAALAEFDRAGADIVLLDLMLPGMSGTDVCKQLRARSSVPVIMVTARDSEIDKVVGLELGADDYVTKPYSARELIARIRAVLRRGGDDDSEISDGVLESGPVRMDVERHVVSVNGDTITLPLKEFDLLEYLMRNSGRVLTRGQLIDRVWGADYVGDTKTLDVHVKRLRSKIEADPANPVHLVTVRGLGYKLEG

SEQ ID NO: 8615 - DNA, 708 bp, Lactobacillus johnsonii
  CDS (1)..(708)
atgccaaagaagattttagtcgttgacgatgaaaaaccaatttctgacattattaaatttaatctgactaaggaaggctttgatgtcgacactgcatacgacggcgaagaagctgttaaaaaagttgaggaatataatcccgatttaatgattcttgacttgatgttaccaaaaaaagacggcttagaggttgcacgtgaagtgcgccaaactcatgatatgccaattattatggtaacggctaaagacactgagattgataaggtgttaggtcttgaaatgggagcagatgattatgttactaagcctttttctaaccgagaattagttgctagagtaaaggcaaacttgcgtagacgtgacttgactcaaaaagctactgaagatgatgaagacaaaaatattaccattggcaatcttgtgattatgcctgaagcttatatggttgaaaaaaatggtgaaaaaattgaattaacgcatcgtgaatttgaattacttcattatttagcacagcatatgggacaagtaatgactagagagcatttattacaaaccgtttggggctatgattattttggagatgttagaactgtggatgtaactgtgcgacgcttacgggaaaagatcgaagacaatccaagttcaccaacgattttagttaccagacgtggagtaggatattacgttaaaaacccatcagatgaataa

SEQ ID NO: 8616 - protein, 235 aa, Lactobacillus johnsonii
MPKKILVVDDEKPISDIIKFNLTKEGFDVDTAYDGEEAVKKVEEYNPDLMILDLMLPKKDGLEVAREVRQTHDMPIIMVTAKDTEIDKVLGLEMGADDYVTKPFSNRELVARVKANLRRRDLTQKATEDDEDKNITIGNLVIMPEAYMVEKNGEKIELTHREFELLHYLAQHMGQVMTREHLLQTVWGYDYFGDVRTVDVTVRRLREKIEDNPSSPTILVTRRGVGYYVKNPSDE

SEQ ID NO: 8617 - DNA, 672 bp, Bacillus cereus
  CDS (1)..(672)
atgagtaaatatagggtgctagttgtagatgatgaaagtgatatgaggcaacttgttggaatgtacttagataatttcggatacgagtggggagaagctgaaaatggaaaagaagctctaaaaaaattagagacaaatcattatgatttcgttgtactagatattatgatgccagagatggatggactttcagtttgtaaagaaattagaaaaacgtcagatgtaccaataatatttttaacagcaaaaggtgaagagtggaatagggtgaacggcttacgtatgggagcagatgattatattgtaaagccatttagtcctggtgaattaattgctcgtatggaagctgtattaaggcgttatacaaagcaagagcaacaagaggaatttcagtttggaccgattcttattaatgaaaaaagtaggaaaattgaggtggatggtgagccaatttctcttacagtgaaagagtttgatttactctattttctttgccaacatacgggacaagtttttagccgagaacaattgctggaaaaggtatggggatatgattatgccggaagtacaagaaccgtagatacgcacgtgaaaacaatgcgtttgaagcttggagaaagtgggaactacattcaaactgtttggggtgtaggctataaatttgaggtgtaa

SEQ ID NO: 8618 - protein, 223 aa, Bacillus cereus
MSKYRVLVVDDESDMRQLVGMYLDNFGYEWGEAENGKEALKKLETNHYDFVVLDIMMPEMDGLSVCKEIRKTSDVPIIFLTAKGEEWNRVNGLRMGADDYIVKPFSPGELIARMEAVLRRYTKQEQQEEFQFGPILINEKSRKIEVDGEPISLTVKEFDLLYFLCQHTGQVFSREQLLEKVWGYDYAGSTRTVDTHVKTMRLKLGESGNYIQTVWGVGYKFEV

SEQ ID NO: 8619 - DNA, 678 bp, Bacillus cereus
  CDS (1)..(678)
atgctaccaaaaattttaatagtagatgacgatccacatattagagaacttgtttctgtatttttagagcgggaaggatttcaaacatatgaagcaattgatggtctagatgcacttcaaaaaataaatgaagtgaaagttgatatggttattcttgatatcatgatgccgaatatggatggatttgatgtatgttttgaattaagaaaatactatgatatccctattttgatgctaactgctaaaggagaaacatctcaaaaagtaaaagggtttcatcttggtacggatgattatcttgtaaaaccatttgatccgatagaactagtagtgagggtaaaggcgttattgaaacgttatcaaattactgtgtcgcaatcaattcaagttggaaatgtactgttaaaccgtaaaacatttgaagttataaccggagaacaaacggttacgttaccactaaaagaattcgaattgctctttactttaggttctaaagcgggaaggacttgttcgagagagcaattaattgaagatgtatggggatatgattttgaagggaatgagcgtacactagacgttcatataaatcggttacgtgagaagttccaagaagagaagtcgaaatttagtattaaaacgataagaggcttaggatatcgcttagaggtaagtaaatga

SEQ ID NO: 8620 - protein, 225 aa, Bacillus cereus
MLPKILIVDDDPHIRELVSVFLEREGFQTYEAIDGLDALQKINEVKVDMVILDIMMPNMDGFDVCFELRKYYDIPILMLTAKGETSQKVKGFHLGTDDYLVKPFDPIELVVRVKALLKRYQITVSQSIQVGNVLLNRKTFEVITGEQTVTLPLKEFELLFTLGSKAGRTCSREQLIEDVWGYDFEGNERTLDVHINRLREKFQEEKSKFSIKTIRGLGYRLEVSK

SEQ ID NO: 8621 - DNA, 690 bp, Bacillus cereus
  CDS (1)..(690): w means a or t/u
atgccaacaattttagttttagaagatgaaatacctattcgtagttttatcgtattaaatttgaaacgtgctggattttatgtgttagaagctagcacgggagaagaggcgttacagattttatgtgaacatactgttgatgtagcattgcttgatgtaatgttaccaggaattgatggttttcaagtttgtaaagcgatccgggaagaaaataaaaaaatcggtattattatgttaaccgcacgtgtgcaagatgaagataaggtacaaggattaggaattggtgcagatgattatatcgcaaagccgtttagtccagtggaattaactgcacgtatacaatcgttattaagaagaatagaagtacatgatgaaaaagcagatatgatcacatctggtccgttttcgttaaatgttatagaagaaagattatataaaaatggacaattagttgatttaacccctacagagtatatgatattacattatttaatgaatcaggctgcaaagccggtttcacgtgatgaaattttaaatatgatttggggaacgaattatgtaggtgagacgaaagtagtagatgtaaatatgaggcggttacgtcaaaagctagaatgtaatccgtcagaacctgaawttattcttactgtgtggggaaaaggatatgtgtggaaggaaagtataagatga

SEQ ID NO: 8622 - protein, 229 aa, Bacillus cereus
  misc_feature (213)..(213): Xaa can be Ile or Phe
MPTILVLEDEIPIRSFIVLNLKRAGFYVLEASTGEEALQILCEHTVDVALLDVMLPGIDGFQVCKAIREENKKIGIIMLTARVQDEDKVQGLGIGADDYIAKPFSPVELTARIQSLLRRIEVHDEKADMITSGPFSLNVIEERLYKNGQLVDLTPTEYMILHYLMNQAAKPVSRDEILNMIWGTNYVGETKVVDVNMRRLRQKLECNPSEPEXILTVWGKGYVWKESIR

SEQ ID NO: 8623 - DNA, 720 bp, Bacillus cereus
  CDS (1)..(720)
atgaacaatcgtattttagtagttgatgatgaggagtttatcttaactttaatcgaatttaatttacaacaagctggttttgaagtgataacagcgatggatggagaaatggcgcttcaaaaagcgacaacagaacgtccagatttaattatattagatttaatgcttccaaaaatggatggtatggaagtatgtaaagaattacgattgcagcgcgttatgacgccgattttaatgttaacagcaaaagatgatgaatttgataaggtgctaggtcttgaacttggggcagatgattatatgacgaagccatttagcccaagggaagttgttgcgcgtgtgaaggcaattttacgccgcacgaaattacaacaagaagagcaagttacagaatcgtctgatgaagagagcattacaattgctgaacttaaaattttaccagagttttatgaggcttatttccaaggaagaaagcttgaattaacaccaaaagaatttgaactacttgtttatcttgcgaaaaataagagtcgcgtgttgacgcgtgatcaattattaagtgctgtatggaattatgatttcgctggtgatacacgaattgttgacgttcatattagccatttacgcgataaaattgaacaaaatacgaaaaaaccgacgtacattaaaacgatacgtggtttaggatataaattagaggagccaaaaggggatgaataa

SEQ ID NO: 8624 - protein, 239 aa, Bacillus cereus
MNNRILVVDDEEFILTLIEFNLQQAGFEVITAMDGEMALQKATTERPDLIILDLMLPKMDGMEVCKELRLQRVMTPILMLTAKDDEFDKVLGLELGADDYMTKPFSPREVVARVKAILRRTKLQQEEQVTESSDEESITIAELKILPEFYEAYFQGRKLELTPKEFELLVYLAKNKSRVLTRDQLLSAVWNYDFAGDTRIVDVHISHLRDKIEQNTKKPTYIKTIRGLGYKLEEPKGDE

SEQ ID NO: 8625 - DNA, 672 bp, Bacillus cereus
  CDS (1)..(672)
atgaaaatacttgtagtggatgatgaatcgagtattcgtaatttgattcggatgcagcttgagatggaaggatatgaagtgcttacggcggctgacgggagagaagctttagagagatggaatgaaggaccggatgttttgattttggatgttatgcttccagatacagatgggtatgagttacttcgtttgttccgggagaaggatcgggatattccagtgctcatgttaactgcgaagagtcagatgaatgataaattgcttggcttgcagcttggtgcagatgattatgtgacgaagccatttaattatgcggagcttattcttcgggtcaagaatatgacgcggcgcgtgaagaagaaggaggtaacggtaagccatgaagtaatcggggcgggagagataacgatttgtcctaaggaaagaaaagtgcatgtgagtgggcaagagattcagttaacgtacagagagtttaatttatgtcagttgtttgtttccaatccgcagcgtgtatttatgagagatgagttacttgagaaagtatggggatttgagtatatcggaaatacgagagcggttgatattatggtgcaaagactgcggaagaagttagggaatagcggagaatatattaagacaatttatggcgttggttataaactggattgttaa

SEQ ID NO: 8626 - protein, 223 aa, Bacillus cereus
MKILVVDDESSIRNLIRMQLEMEGYEVLTAADGREALERWNEGPDVLILDVMLPDTDGYELLRLFREKDRDIPVLMLTAKSQMNDKLLGLQLGADDYVTKPFNYAELILRVKNMTRRVKKKEVTVSHEVIGAGEITICPKERKVHVSGQEIQLTYREFNLCQLFVSNPQRVFMRDELLEKVWGFEYIGNTRAVDIMVQRLRKKLGNSGEYIKTIYGVGYKLDC

SEQ ID NO: 8627 - DNA, 678 bp, Thermus thermophilus
  CDS (1)..(678)
atgaaggtccttttggtggacgacgacccggccatcctcgaggtcctcggggcctttctgaggggggccgggtttgaggtcttggaggcggaggacggggaaaaggccttggaactctttccccaggccgatctggtcatcctggacctgatgctccccaaggtgggaggcctcgaggtggcccgcctcatccgccaggagcgccccgagcttcccctcctcatcctcaccgccaagggggaggaggaggaccgggttctgggcctggagcttggggcggacgattacgtggtcaagcccttcagccccagggaggtggtggcccgggtcaaggccctgttgcgccgggccgggctaagggaggagctcgtctacggtcccttgcgcctcctccccacccggcgggaggcctacctggcgggaaagcccctccccctctcccggctggagtttgacctcctcttaaccctcgcccagcacccgggggtggttttcagccgggagaggcttttggaaagggtctgggggcccggcttccccggggtggaccgggtggtggacgtccacatcgccgcccttcggaagaagctcggggacgatccggaaaacccccgcttcattgaaacggtgcggggcgtgggttaccgcttcaaggacccggatgcgcctcttccttag

SEQ ID NO: 8628 - protein, 225 aa, Thermus thermophilus
MKVLLVDDDPAILEVLGAFLRGAGFEVLEAEDGEKALELFPQADLVILDLMLPKVGGLEVARLIRQERPELPLLILTAKGEEEDRVLGLELGADDYVVKPFSPREVVARVKALLRRAGLREELVYGPLRLLPTRREAYLAGKPLPLSRLEFDLLLTLAQHPGVVFSRERLLERVWGPGFPGVDRVVDVHIAALRKKLGDDPENPRFIETVRGVGYRFKDPDAPLP

SEQ ID NO: 8629 - DNA, 690 bp, Desulfovibrio vulgaris
  CDS (1)..(690)
atggcaaaagaacggattctggtcgtcgaggatgacgaggatatccttcagctgctccgtttcacgctcgaggcggccggtttcgaggtcgtcacggccgccacgggacgagacgggctcgagagcgcgcagcggcatgttccggggctggtactgctcgaccttatgctgccgggcatgagcggtttcgacgtatgccgcgaactcaagcgcacccccgccacggagcatgtaccggtcatcatgctgaccgcccgtggtgaagaggtcgaccgcatcgtggggcttgaactgggggccgacgattacgtcatcaaacccttcagcccgcgtgaactggtcttgcgcatccgtgccgtgctcaagcgcgtgacaggggcgcaagagcctgcaccccgtggacagtggaacgtggacgggctgtttctcgatgaagaggcccaccgcgtggaagttgacggtgaagaggcgctgcttaccgcgacggagttcaggttgcttgctgaacttgtccggaaccgtgggcgtgtccgcactcgtgaccagctgctgaacacggtgtggggctacgaattcgagggatatgcacgcacggtcgatacccatgtgcgtcgcttgcgccagaagataggccgcttcgccgccatgatcgaaacgatcaggggtgtcggctacaggttcaaggagtaa

SEQ ID NO: 8630 - protein, 229 aa, Desulfovibrio vulgaris
MAKERILVVEDDEDILQLLRFTLEAAGFEVVTAATGRDGLESAQRHVPGLVLLDLMLPGMSGFDVCRELKRTPATEHVPVIMLTARGEEVDRIVGLELGADDYVIKPFSPRELVLRIRAVLKRVTGAQEPAPRGQWNVDGLFLDEEAHRVEVDGEEALLTATEFRLLAELVRNRGRVRTRDQLLNTVWGYEFEGYARTVDTHVRRLRQKIGRFAAMIETIRGVGYRFKE

SEQ ID NO: 8631 - DNA, 690 bp, Pseudomonas stutzeri
  CDS (1)..(690)
atgaacggcaagagcatactgatcgtcgatgacgaggcgccgatccgggagatgatcgtcgtcgccctggaaatggccggctatgactgtctcgaagcagagaacacccagcaggcccacgcactgatcatcgaccgcaagccggacctgatcctgctcgactggatgctgcccggcacttcgggcatcgagctggcgcgccgcctcaagcgcgacgagctgaccgccgacacgccgatcatcatgctcaccgccaagggtgaagaggacaacaagatccagggcctggaagtcggcgccgacgactacatcaccaagcccttctcgccgcgcgagctggtcgcccgcctgaaggccgtgctgcgccgcgcgacgccagtggacagcgaatcgccgatcgagatcggcggcctgctgctcgatccggtcagccaccgcgtcaccatcgacggcaaaccggccgagatgggccccaccgaataccgtctgctgcaattcttcatgacccaccaggagcgcgcctacacccgcagccagctgctcgatcaggtctggggcggcaatgtctatgtcgaggagcgcactgtcgatgtgcatatccgccggctgcgcaaggcgctcggtgaggcctacgagaacctggtgcagacggtacgcggcaccggttatcgtttctccagcaaaagctga

SEQ ID NO: 8632 - protein, 229 aa, Pseudomonas stutzeri
MNGKSILIVDDEAPIREMIVVALEMAGYDCLEAENTQQAHALIIDRKPDLILLDWMLPGTSGIELARRLKRDELTADTPIIMLTAKGEEDNKIQGLEVGADDYITKPFSPRELVARLKAVLRRATPVDSESPIEIGGLLLDPVSHRVTIDGKPAEMGPTEYRLLQFFMTHQERAYTRSQLLDQVWGGNVYVEERTVDVHIRRLRKALGEAYENLVQTVRGTGYRFSSKS

SEQ ID NO: 8633 - DNA, 804 bp, Bacillus amyloliquefaciens
  CDS (1)..(804)
atggcttattttctgtgggagagaagtgttgatttttttaacgatacacagacattgggtataataatgacaatgacttcaaggagtgatcaatatatgtcacggcttcacagcaaagtattaatcatagacgacgaaaaagaaattttggaactgatcaaaaccgtattaataagagaaggcattgatcgcgtagtgaccgcttcgactgcccgtgacggattggctcaatttcatcaagaaaatcccgatctggtgatattggatatcatgctgccagacggtgaaggctatgatatctgcaagcaaataagagacatttcacacgttcctattatctttttgtctgcaaagggggaggaaacggataaaattgtagggcttgccatcggcggggacgactacattacaaaacccttcagccctaaggaagttgcatatcgagtcaaagcgcagctgagacgggtctcttacttacagccttctcaaaccggaaccataataaaaaaagggccatttgagttaaaccaacaacaagccgagctcaccaaaaatgaagcggctattgagttaacacctaaagaacttatgcttatgacctattttctgcagcatcccaatcgggtgatcagtaaagaaacactctatcaagctgtatggggagaagatttcttcggttctgacaacacggtgatggttcatatacgcaggctccgtgagaaaatagaaaacaccccatcaaaaccagactttctcgtcactgtgaaagggttaggctacaaatttgttgtaaaggatgcgtaa

SEQ ID NO: 8634 - protein, 267 aa, Bacillus amyloliquefaciens
MAYFLWERSVDFFNDTQTLGIIMTMTSRSDQYMSRLHSKVLIIDDEKEILELIKTVLIREGIDRVVTASTARDGLAQFHQENPDLVILDIMLPDGEGYDICKQIRDISHVPIIFLSAKGEETDKIVGLAIGGDDYITKPFSPKEVAYRVKAQLRRVSYLQPSQTGTIIKKGPFELNQQQAELTKNEAAIELTPKELMLMTYFLQHPNRVISKETLYQAVWGEDFFGSDNTVMVHIRRLREKIENTPSKPDFLVTVKGLGYKFVVKDA

SEQ ID NO: 8635 - DNA, 714 bp, Rhodopseudomonas palustris
  CDS (1)..(714)
atggctgcgcgcattctggtagttgaagacgaggaagcgctgacgacgctgctgcgatacaatctggaatccgagggctacgaggtcgagacggtggcccgcggcgacgatgccgacacccggatgaaagagcgcattcccgatctggtggtgttggactggatgttgccgggcctgtccggcatcgagctgtgccgccggctgcgggcgcggccggaaaccaagcagctgccgatcatcatgctgacagcgcgcggcgaagagagcgaacgcgttcgcgggctcgcgaccggtgccgacgattacatcgtcaagccgttttcggtgccggagctgctggcgcgggtgaagggcctgctgcgccgcgcggcgccggagcggctcgccaccgtgctggcctatggcgatctcgagctcgaccgcgacaagcggcgggtcgcgcgttccggccggccgatcgatctcggcccgaccgagtatcgcttgctcgagttcttcctggagcatccgggccgggtgttcagccgcgaacagctgctcgacggcgtctgggggcgcgacatctatatcgatgagcgcaccgtcgacgtgcacatcggccgcctccgcaagctgctcaatatcggccgcgagcaggatccgatccgcaccgtccgcggtgccggctacgccctcgacgaccgctttgccaaggtcgaaggcagcccgtcgtag

SEQ ID NO: 8636 - protein, 237 aa, Rhodopseudomonas palustris
MAARILVVEDEEALTTLLRYNLESEGYEVETVARGDDADTRMKERIPDLVVLDWMLPGLSGIELCRRLRARPETKQLPIIMLTARGEESERVRGLATGADDYIVKPFSVPELLARVKGLLRRAAPERLATVLAYGDLELDRDKRRVARSGRPIDLGPTEYRLLEFFLEHPGRVFSREQLLDGVWGRDIYIDERTVDVHIGRLRKLLNIGREQDPIRTVRGAGYALDDRFAKVEGSPS

SEQ ID NO: 8637 - DNA, 681 bp, Corynebacterium diphtheriae
  CDS (1)..(681)
atgacctctatcttgttggttgaagacgaagagtcgctagccgatcccctcgcgttcttgttgcgcaaggaaggttttgatgtagtaatcgccggtgatggccccagcgccttggtggagtttgatcgcaacgccatcgatattgtgctgcttgacctcatgcttcctggcatgtcgggtacggatgtgtgcaagcgcctgcgagcagtatcctcagtccccgtgatcatggtgacggcacgggactcggagatcgacaaggtggtaggcctagaactcggtgccgacgactacgtgaccaaaccatattcttctcgcgagctcattgcccgaatccgtgccgtgctgcgtcgcggcggggagacaatcgaagaatcggatgagatcctcggcagcggccgaatccacatggatgtggaacgccacaccgtgaccgtcgacggcgaagagatctccatgccgctaaaagaattcgacctgttggaatacctcatgcgcaactcggggcgcgtgctcacccgtggccagctcatcgaccgcgtgtggggtgccgactacgtaggggataccaaaaccttggatgtgcacattaaacgcctgcgctccaagatcgaaccagaaccctccgcgccatgccacgtgattactgtgcgcggtctgggctacaagtacgaagactag

SEQ ID NO: 8638 - protein, 226 aa, Corynebacterium diphtheriae
MTSILLVEDEESLADPLAFLLRKEGFDVVIAGDGPSALVEFDRNAIDIVLLDLMLPGMSGTDVCKRLRAVSSVPVIMVTARDSEIDKVVGLELGADDYVTKPYSSRELIARIRAVLRRGGETIEESDEILGSGRIHMDVERHTVTVDGEEISMPLKEFDLLEYLMRNSGRVLTRGQLIDRVWGADYVGDTKTLDVHIKRLRSKIEPEPSAPCHVITVRGLGYKYED

SEQ ID NO: 8639 - DNA, 699 bp, Corynebacterium diphtheriae
  CDS (1)..(699)
atggaaaggaccacggacggtatggcaccgaaaattttggttgtcgacgatgatcccgcgatttcagagatgctgaccatcgtgctggaggccgagggatttgagccggtcgcggtcactgatggggcagtagcagttgatgcctttaggacagaatcgcctgatctagtcctactcgatttgatgctgcctggtatgaatggcatcgacatttgtaggataatccggcaggaatcggcagttcctatcgtcatgctcacggcgaaaaccgacaccgtggacgtagtccttggtttggaatcaggtgcagatgactacatcaacaagccgtttaagccgaaagaactcatcgctcgactacgtgcacgcttgcgtcgtacagaggactctccgtccgaaaccattgagatcggggatcttacgatcgacgtcctaggccacgaagtcactcgaggagatgaggaaattcaactcactcctttagagtttgatttgctgcttgagcttgcaagcaaaccaggacaggtgttcacacgtgaggaacttctgcaaaaagtttggggctaccgtaatgcctcagacacgagactggtgaatgtccatgtgcagcgactgcgctcaaagatcgagaaagacccagaaaacccgcacatcgtgttaacagtgcgcggagtggggtataagacagggcaggagtag

SEQ ID NO: 8640 - protein, 232 aa, Corynebacterium diphtheriae
MERTTDGMAPKILVVDDDPAISEMLTIVLEAEGFEPVAVTDGAVAVDAFRTESPDLVLLDLMLPGMNGIDICRIIRQESAVPIVMLTAKTDTVDVVLGLESGADDYINKPFKPKELIARLRARLRRTEDSPSETIEIGDLTIDVLGHEVTRGDEEIQLTPLEFDLLLELASKPGQVFTREELLQKVWGYRNASDTRLVNVHVQRLRSKIEKDPENPHIVLTVRGVGYKTGQE

SEQ ID NO: 8641 - DNA, 678 bp, Bdellovibrio bacteriovorus
  CDS (1)..(678)
atggtggaagatgagcaggaaatccgggagctgatggctctgcacctgcttcgtcaagggtaccgagtgaccgaatgtgcttccgccgaagaagccctgaacgaaatgaatcgccagaactattccttgttcgtccttgattggatgctgccgggcttgagtggcgtcgacatcgtagataaaatcaaagccaaaaacaccggtgcctcagtactgatggtcaccgctaaaaccgaacctcaggacatcgttgccggccttgaaaaaggggccgacgactacatgaccaaacctttcaatccttccgttttcattgctcgaatcaaagctcttttgcgccgttcccaggtgcaggcggcggctccggccgcggatgatggcgaagtgtccttgttgggtcttaaaatcaattttaagtcttacgagatctcctataacggcgaacctctgcatttgactccgtccgagttcaagctgttgggggccctggtgcagaatcatggctgcgttttgacccgcgaacaactgattgaaaacattcagggcgagggtattaatgtggttggccgcactatcgacacccacgtcttcggattacgcaagaagttaggggagtggggagaccgtattgagactatccgtggcgttggatatcgggttaaagtagacatcgcatga

SEQ ID NO: 8642 - protein, 225 aa, Bdellovibrio bacteriovorus
MVEDEQEIRELMALHLLRQGYRVTECASAEEALNEMNRQNYSLFVLDWMLPGLSGVDIVDKIKAKNTGASVLMVTAKTEPQDIVAGLEKGADDYMTKPFNPSVFIARIKALLRRSQVQAAAPAADDGEVSLLGLKINFKSYEISYNGEPLHLTPSEFKLLGALVQNHGCVLTREQLIENIQGEGINVVGRTIDTHVFGLRKKLGEWGDRIETIRGVGYRVKVDIA

SEQ ID NO: 8643 - DNA, 768 bp, Corynebacterium glutamicum
  CDS (1)..(768)
atgttccaacgcgtggacgtcttaattgggaggaagtctgtcacggactggaagacgaaaagggtatcgatgaaaattttagttgttgatgacgagcaagctgtacgtgactccttgcgacgttccctttcgttcaacggatacaacgttgttctcgcagaagacggcatccaagcactagagatgattgacaaggaacagcctgctttggtgatcctcgatgtcatgatgcctggtatggacggacttgaggtctgtcgccaccttcgcagcgaaggcgatgatcggccaattcttattcttactgcccgcgataatgtttctgatcgtgttggtggcctcgatgcaggcgcagatgactatttggctaaaccatttgctcttgaagagctgttggcgcgcgtccgttcactggtgcgtcgctctgcagtggaatcaaatcagagttccagcattgaacaggctctattatcttgtggcgatttgacgcttgacccagaaagtcgagatgtctaccgcaacggacgcgccatcagccttactcgaacagagttcgcgctcctgcaattgctcctcaaaaaccaaaggaaagtgctcactcgcgcccagattttggaagaggtatggggctgcgatttccccacttcaggcaatgccctcgaggtctacattggataccttcgacgcaagactgaattggaaggagaagaccgcctgatccatacagtacgaggagtcggatacgtcctgcgagagaccgctccgtga

SEQ ID NO: 8644 - protein, 255 aa, Corynebacterium glutamicum
MFQRVDVLIGRKSVTDWKTKRVSMKILVVDDEQAVRDSLRRSLSFNGYNVVLAEDGIQALEMIDKEQPALVILDVMMPGMDGLEVCRHLRSEGDDRPILILTARDNVSDRVGGLDAGADDYLAKPFALEELLARVRSLVRRSAVESNQSSSIEQALLSCGDLTLDPESRDVYRNGRAISLTRTEFALLQLLLKNQRKVLTRAQILEEVWGCDFPTSGNALEVYIGYLRRKTELEGEDRLIHTVRGVGYVLRETAP

SEQ ID NO: 8645 - DNA, 759 bp, Corynebacterium glutamicum
  CDS (37)..(759)
gtggtattccccccggccgaagcgatactggggtctatggctgaccgcacaccgaccaccgccacgcccccggggcgggtgctggtcgtcgatgatgaacaacccctggctcagatggtggcctcctacctcatccgggccggcttcgacacccgccaggcgcacaccggcacccaggccgtggacgaggcccgtcgcttttcccccgatgttgtggtgctggatctggggctgcccgaactcgacggcctggaggtgtgccgacggatccgcaccttctcggactgctacatcctcatgctcaccgcgcgtggcagcgaggacgacaagatcagcggtttgaccctgggggcggatgactacatcaccaaaccttttagcatccgggaactggtgacccgggtgcatgcggtgctgcgccgcccgcgcaccagcaccaccccaccgcaggtgaccacccccttgatcgttggtgacctcatccttgaccccgtcgcccatcaggtgtgggtgggggagacgaccgtggagctcacccgcacggagttcgagctgctggttgccctggccctgcgccccggccaggtgctgacccgccacgacctgatcaccgaggtctgggacaccacctgggtcggcgatgaacgcatcgtcgatgtccacatcggcaacttgcgtcgcaagctcggcaccgacacccggggccgggggtttatcgacaccgtgcgtggcgtgggctaccgggtggggcagccatag

SEQ ID NO: 8646 - protein, 240 aa, Corynebacterium glutamicum
MADRTPTTATPPGRVLVVDDEQPLAQMVASYLIRAGFDTRQAHTGTQAVDEARRFSPDVVVLDLGLPELDGLEVCRRIRTFSDCYILMLTARGSEDDKISGLTLGADDYITKPFSIRELVTRVHAVLRRPRTSTTPPQVTTPLIVGDLILDPVAHQVWVGETTVELTRTEFELLVALALRPGQVLTRHDLITEVWDTTWVGDERIVDVHIGNLRRKLGTDTRGRGFIDTVRGVGYRVGQP

SEQ ID NO: 8647 - DNA, 690 bp, Photobacterium profundum
  CDS (1)..(690)
atggtaagaaggattcttgttgtagaagacgaagcaccaatccgcgagatgttgtgttttgttctagaacaaaaaggctatcaacccattgaagccgaagattatgatgatgcattagaaaaaatttgcgaaccttatcctgaattgattctaatggattggatgttaccggggggctcaggcattaacctgattaagcacctaaagcgtgatgagctaacgcgtcagatccctgtagtaatgttaactgcacgcggtgaagaagaagataaagtgcgtggcttagaagtgggtgctgatgattacatcaccaaaccattttcaccgaaagagctaatggcacgtcttaaagcggtaatgcgccgtgtatcacctacgtcactggatgatgttattgatgtacaaggtttgaaattagatcctgtgtcgcaccgtgtaacaacgaatgatgaaccattagacatggggccaacagagtttaagatgctgcatttctttatgacacaccaagagcgtgtatatagtcgtgagcagttgttgaacaatgtatggggtactaacgtgtatgttgaagatcgtacggttgatgtacacattcgtcgtttgcgtaaagcgcttgaagcgggcgggcacgataaaatggtacaaaccgttcgtggtgcgggttaccggttctcgacacgtttgtaa

SEQ ID NO: 8648 - protein, 229 aa, Photobacterium profundum
MVRRILVVEDEAPIREMLCFVLEQKGYQPIEAEDYDDALEKICEPYPELILMDWMLPGGSGINLIKHLKRDELTRQIPVVMLTARGEEEDKVRGLEVGADDYITKPFSPKELMARLKAVMRRVSPTSLDDVIDVQGLKLDPVSHRVTTNDEPLDMGPTEFKMLHFFMTHQERVYSREQLLNNVWGTNVYVEDRTVDVHIRRLRKALEAGGHDKMVQTVRGAGYRFSTRL

SEQ ID NO: 8649 - DNA, 21 bp, artificial sequence
  primer
atggcgagacgtattctggtc

SEQ ID NO: 8650 - DNA, 26 bp, artificial sequence
  primer
ttaaaagcgggttgaaaaacgatatc

SEQ ID NO: 8651 - protein, 11 aa, artificial sequence
  MISC_FEATURE (1)..(11): consensus for the disclosure of xaa see table XV
XXXXXXXXXXX

SEQ ID NO: 8652 - protein, 14 aa, artificial sequence
  MISC_FEATURE (1)..(14): consensus for the disclosure of xaa see table XV
XXPXXXXXXXXXGX

SEQ ID NO: 8653 - protein, 80 aa, artificial sequence; identical to SEQ ID NO: 7429
  MISC_FEATURE (1)..(80): consensus Xaa in all positions is any amino acid.

SEQ ID NO: 8654 - protein, 10 aa, artificial sequence
  MISC_FEATURE (1)..(10): consensus for the disclosure of xaa see table XV
VXXKXXKXXX

SEQ ID NO: 8655 - protein, 20 aa, artificial sequence
  MISC_FEATURE (1)..(20): consensus for the disclosure of xaa see table XV
XXXXXXKXXXNXXAGXXTXL

SEQ ID NO: 8656 - protein, 113 aa, artificial sequence; identical to SEQ ID NO: 5303
  MISC_FEATURE (1)..(113): consensus Xaa in all positions is any amino acid.

SEQ ID NO: 8657 - protein, 29 aa, artificial sequence
  MISC_FEATURE (1)..(29): consensus for the disclosure of xaa see table XV
XDPXXPKXXXSXXXXXXXXXRXXXXXXXP

SEQ ID NO: 8658 - protein, 12 aa, artificial sequence
  MISC_FEATURE (1)..(12): consensus for the disclosure of xaa see table XV
XXXXXXXXXXXW

SEQ ID NO: 8659 - protein, 22 aa, artificial sequence
  MISC_FEATURE (1)..(22): consensus for the disclosure of xaa see table XV
XXXXXXXXXXXXXXYXXXXXXY

SEQ ID NO: 8660 - protein, 75 aa, artificial sequence; identical to SEQ ID NO: 5300
  MISC_FEATURE (1)..(75): consensus Xaa in all positions is any amino acid.

SEQ ID NO: 8661 - protein, 53 aa, artificial sequence; identical to SEQ ID NO: 5292
  MISC_FEATURE (1)..(53): consensus for the disclosure of xaa see table XV

SEQ ID NO: 8662 - protein, 75 aa, artificial sequence; identical to SEQ ID NO: 5293
  MISC_FEATURE (1)..(75): consensus for the disclosure of xaa see table XV

SEQ ID NO: 8663 - protein, 100 aa, artificial sequence; identical to SEQ ID NO: 5294
  MISC_FEATURE (1)..(100): consensus for the disclosure of xaa see table XV

SEQ ID NO: 8664 - protein, 46 aa, artificial sequence; identical to SEQ ID NO: 5295
  MISC_FEATURE (1)..(46): consensus for the disclosure of xaa see table XV

SEQ ID NO: 8665 - protein, 688 aa, artificial sequence; identical to SEQ ID NO: 5296
  MISC_FEATURE (1)..(688): consensus Xaa in all positions is any amino acid

SEQ ID NO: 8666 - protein, 23 aa, artificial sequence
  MISC_FEATURE (1)..(23): consensus Xaa in all positions is any amino acid.
LEXLAXLXSLXXVDXXXIRXLIN

SEQ ID NO: 8667 - protein, 36 aa, artificial sequence
  MISC_FEATURE (1)..(36): consensus Xaa in all positions is any amino acid.
MLKKXSXEXXXXXXXPXXRXXRPLWXXXXXXXSVYL

SEQ ID NO: 8668 - protein, 179 aa, artificial sequence
  MISC_FEATURE (1)..(179): consensus Xaa in all positions is any amino acid.
AXXTXXXXXXXPXXXXAXXXXXLLXXXRRXXXTXPXXXXXXLEXLAXLXSLXXVDXXXIRXLINXXTXXXNXXXEXXMLKKXSXEXXXXXXXPXXRXXRPLWXXXXXXXSVYLXXXXXXXKXEXXXREXXLXXXVEXLEXXLXXLXXXXKXXXXXXXXXXXEXXXXXPWYXRWXWXXXX

SEQ ID NO: 8669 - protein, 14 aa, artificial sequence
  MISC_FEATURE (1)..(14): consensus for the disclosure of xaa see table XV
XXXXXXXXXXXXXX

SEQ ID NO: 8670 - protein, 7 aa, artificial sequence
  MISC_FEATURE (1)..(7): consensus for the disclosure of xaa see table XV
XXXXXXX

SEQ ID NO: 8671 - protein, 44 aa, artificial sequence
  MISC_FEATURE (1)..(44): consensus for the disclosure of xaa see table XV
XXXXXXXXXXXXXXXXXXXGXDXXXXKPXXXXXXXXXXXXXXXX

SEQ ID NO: 8672 - protein, 253 aa, artificial sequence
  MISC_FEATURE (1)..(253): consensus Xaa in all positions is any amino acid.
LXVXDXXXXXXXXXXXLXXXGXXXXXXXXXXXXAXXXXXXXXXXXXXXXXXXXDXXXLDXMXPXXXXGXXXXXXXRXXXXXXXXPXXMXTAXXXXXDXXXGLXXGADDYXXKPFXXXEXXARXXAXLRRXXXXXXXXXXXXXXXXXXXXXXXXXXXXXXXXXXXXXXXXXXXXXXXXXXLXXXEXXLLXXXXXXXXXXXXRXXLXXXXWXXXXXXXXXXRXVDXXXXXLRXXXXXXXXXXXXXXXXTXXGXGY

SEQ ID NO: 8673 - DNA, 2079 bp, Saccharomyces cerevisiae; identical to SEQ ID NO: 1273
  CDS (1)..(2079)

SEQ ID NO: 8674 - protein, 692 aa, Saccharomyces cerevisiae; identical to SEQ ID NO: 1274

SEQ ID NO: 8675 - DNA, 2253 bp, Neurospora crassa; identical to SEQ ID NO: 1275
  CDS (1)..(2253)

SEQ ID NO: 8676 - protein, 750 aa, Neurospora crassa; identical to SEQ ID NO: 1276

SEQ ID NO: 8677 - DNA, 24 bp, Primer
atggggaagagagtatacgatcca

SEQ ID NO: 8678 - DNA, 23 bp, Primer
tcactccagcttaaacatggcgg

SEQ ID NO: 8679 - DNA, 1062 bp, Escherichia coli K12; identical to SEQ ID NO: 2732
  CDS (1)..(1062)

SEQ ID NO: 8680 - protein, 353 aa, Escherichia coli K12; identical to SEQ ID NO: 2733

SEQ ID NO: 8681 - DNA, 1444 bp, Pseudomonas fluorescens; identical to SEQ ID NO: 2734
  CDS (156)..(1214)

SEQ ID NO: 8682 - protein, 352 aa, Pseudomonas fluorescens; identical to SEQ ID NO: 2735

SEQ ID NO: 8683 - DNA, 1484 bp, Haemophilus influenzae; identical to SEQ ID NO: 2736
  CDS (278)..(1342)

SEQ ID NO: 8684 - protein, 354 aa, Haemophilus influenzae; identical to SEQ ID NO: 2737

SEQ ID NO: 8685 - DNA, 1131 bp, Thermus aquaticus; identical to SEQ ID NO: 2738
  CDS (62)..(1084)

SEQ ID NO: 8686 - protein, 340 aa, Thermus aquaticus; identical to SEQ ID NO: 2739

SEQ ID NO: 8687 - DNA, 1196 bp, Aquifex pyrophilus; identical to SEQ ID NO: 2740
  CDS (51)..(1097)

SEQ ID NO: 8688 - protein, 348 aa, Aquifex pyrophilus; identical to SEQ ID NO: 2741

SEQ ID NO: 8689 - DNA, 1023 bp, Rickettsia prowazekii; identical to SEQ ID NO: 2742
  CDS (1)..(1023)

SEQ ID NO: 8690 - protein, 340 aa, Rickettsia prowazekii; identical to SEQ ID NO: 2743

SEQ ID NO: 8691 - DNA, 1329 bp, Myxococcus xanthus; identical to SEQ ID NO: 2744
  CDS (201)..(1229)

SEQ ID NO: 8692 - protein, 342 aa, Myxococcus xanthus; identical to SEQ ID NO: 2745

SEQ ID NO: 8693 - DNA, 1394 bp, Legionella pneumophila; identical to SEQ ID NO: 2746
  CDS (166)..(1212)

SEQ ID NO: 8694 - protein, 348 aa, Legionella pneumophila; identical to SEQ ID NO: 2747

SEQ ID NO: 8695 - DNA, 1224 bp, Treponema pallidum subsp. pallidum (syphilis spirochete); identical to SEQ ID NO: 2748
  CDS (1)..(1224): k means g or t/u

SEQ ID NO: 8696 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 8697 - DNA, 1050 bp, Clostridium acetobutylicum; identical to SEQ ID NO: 2750
  CDS (1)..(1050)

SEQ ID NO: 8698 - protein, 349 aa, Clostridium acetobutylicum; identical to SEQ ID NO: 2751

SEQ ID NO: 8699 - DNA, 1047 bp, Listeria innocua; identical to SEQ ID NO: 2752
  CDS (1)..(1047)

SEQ ID NO: 8700 - protein, 348 aa, Listeria innocua; identical to SEQ ID NO: 2753

SEQ ID NO: 8701 - DNA, 1137 bp, Brucella melitensis; identical to SEQ ID NO: 2754
  CDS (1)..(1137)

SEQ ID NO: 8702 - protein, 378 aa, Brucella melitensis; identical to SEQ ID NO: 2755

SEQ ID NO: 8703 - DNA, 1062 bp, Salmonella enterica subsp. enterica serovar Typhi; identical to SEQ ID NO: 2756
  CDS (1)..(1062)

SEQ ID NO: 8704 - protein, 353 aa, Salmonella enterica subsp. enterica serovar Typhi; identical to SEQ ID NO: 2757

SEQ ID NO: 8705 - DNA, 1074 bp, Nostoc sp. PCC 7120; identical to SEQ ID NO: 2758
  CDS (1)..(1074)

SEQ ID NO: 8706 - protein, 357 aa, Nostoc sp. PCC 7120; identical to SEQ ID NO: 2759

SEQ ID NO: 8707 - DNA, 1044 bp, Xylella fastidiosa; identical to SEQ ID NO: 2760
  CDS (1)..(1044)

SEQ ID NO: 8708 - protein, 347 aa, Xylella fastidiosa; identical to SEQ ID NO: 2761

SEQ ID NO: 8709 - DNA, 1164 bp, Lactococcus lactis subsp. lactis; identical to SEQ ID NO: 2762
  CDS (1)..(1164)

SEQ ID NO: 8710 - protein, 387 aa, Lactococcus lactis subsp. lactis; identical to SEQ ID NO: 2763

SEQ ID NO: 8711 - DNA, 2025 bp, Borrelia burgdorferi (Lyme disease spirochete); identical to SEQ ID NO: 2764
  CDS (25)..(1122)

SEQ ID NO: 8712 - protein, 365 aa, Borrelia burgdorferi (Lyme disease spirochete); identical to SEQ ID NO: 2765

SEQ ID NO: 8713 - DNA, 1728 bp, Deinococcus radiodurans; identical to SEQ ID NO: 2766
  CDS (399)..(1490)

SEQ ID NO: 8714 - protein, 363 aa, Deinococcus radiodurans; identical to SEQ ID NO: 2767

SEQ ID NO: 8715 - DNA, 1071 bp, Caulobacter crescentus; identical to SEQ ID NO: 2768
  CDS (1)..(1071)

SEQ ID NO: 8716 - protein, 356 aa, Caulobacter crescentus; identical to SEQ ID NO: 2769

SEQ ID NO: 8717 - DNA, 1199 bp, Thermotoga maritima; identical to SEQ ID NO: 2770
  CDS (67)..(1137)

SEQ ID NO: 8718 - protein, 356 aa, Thermotoga maritima; identical to SEQ ID NO: 2771

SEQ ID NO: 8719 - DNA, 1662 bp, Arabidopsis thaliana (mouse-ear cress); identical to SEQ ID NO: 2772
  CDS (368)..(1498)

SEQ ID NO: 8720 - protein, 376 aa, Arabidopsis thaliana (mouse-ear cress); identical to SEQ ID NO: 2773

SEQ ID NO: 8721 - DNA, 1038 bp, Aquifex aeolicus; identical to SEQ ID NO: 2774
  CDS (1)..(1038)

SEQ ID NO: 8722 - protein, 345 aa, Aquifex aeolicus; identical to SEQ ID NO: 2775

SEQ ID NO: 8723 - DNA, 1062 bp, Chlamydophila pneumoniae, Chlamydia pneumoniae; identical to SEQ ID NO: 2776
  CDS (1)..(1062)

SEQ ID NO: 8724 - protein, 353 aa, Chlamydophila pneumoniae, Chlamydia pneumoniae; identical to SEQ ID NO: 2777

SEQ ID NO: 8725 - DNA, 1047 bp, Neisseria meningitidis; identical to SEQ ID NO: 2778
  CDS (1)..(1047)

SEQ ID NO: 8726 - protein, 348 aa, Neisseria meningitidis; identical to SEQ ID NO: 2779

SEQ ID NO: 8727 - DNA, 1032 bp, Campylobacter jejuni; identical to SEQ ID NO: 2780
  CDS (1)..(1032)

SEQ ID NO: 8728 - protein, 343 aa, Campylobacter jejuni; identical to SEQ ID NO: 2781

SEQ ID NO: 8729 - DNA, 1065 bp, Chlamydia muridarum, Chlamydia trachomatis MoPn; identical to SEQ ID NO: 2782
  CDS (1)..(1065)

SEQ ID NO: 8730 - protein, 354 aa, Chlamydia muridarum, Chlamydia trachomatis MoPn; identical to SEQ ID NO: 2783

SEQ ID NO: 8731 - DNA, 1050 bp, Bacillus halodurans; identical to SEQ ID NO: 2784
  CDS (1)..(1050)

SEQ ID NO: 8732 - protein, 349 aa, Bacillus halodurans; identical to SEQ ID NO: 2785

SEQ ID NO: 8733 - DNA, 1229 bp, Streptococcus pneumoniae; identical to SEQ ID NO: 2786
  CDS (26)..(1192)

SEQ ID NO: 8734 - protein, 388 aa, Streptococcus pneumoniae; identical to SEQ ID NO: 2787

SEQ ID NO: 8735 - DNA, 1251 bp, Agrobacterium tumefaciens; identical to SEQ ID NO: 2788
  CDS (1)..(1251)

SEQ ID NO: 8736 - protein, 416 aa, Agrobacterium tumefaciens; identical to SEQ ID NO: 2789

SEQ ID NO: 8737 - DNA, 1044 bp, Staphylococcus aureus; identical to SEQ ID NO: 2790
  CDS (1)..(1044)

SEQ ID NO: 8738 - protein, 347 aa, Staphylococcus aureus; identical to SEQ ID NO: 2791

SEQ ID NO: 8739 - DNA, 1506 bp, Acinetobacter calcoaceticus; identical to SEQ ID NO: 2792
  CDS (403)..(1452)

SEQ ID NO: 8740 - protein, 349 aa, Acinetobacter calcoaceticus; identical to SEQ ID NO: 2793

SEQ ID NO: 8741 - DNA, 1479 bp, Brucella abortus; identical to SEQ ID NO: 2794
  CDS (316)..(1398)

SEQ ID NO: 8742 - protein, 360 aa, Brucella abortus; identical to SEQ ID NO: 2795

SEQ ID NO: 8743 - DNA, 981 bp, Streptococcus pyogenes; identical to SEQ ID NO: 2796
  CDS (1)..(981)

SEQ ID NO: 8744 - protein, 326 aa, Streptococcus pyogenes; identical to SEQ ID NO: 2797

SEQ ID NO: 8745 - DNA, 1349 bp, Leptospira biflexa; identical to SEQ ID NO: 2798
  CDS (107)..(1270)

SEQ ID NO: 8746 - protein, 387 aa, Leptospira biflexa; identical to SEQ ID NO: 2799

SEQ ID NO: 8747 - DNA, 1762 bp, Xanthomonas campestris pv. campestris; identical to SEQ ID NO: 2800
  CDS (159)..(1190)

SEQ ID NO: 8748 - protein, 343 aa, Xanthomonas campestris pv. campestris; identical to SEQ ID NO: 2801

SEQ ID NO: 8749 - DNA, 1212 bp, Aeromonas salmonicida; identical to SEQ ID NO: 2802
  CDS (151)..(1212)

SEQ ID NO: 8750 - protein, 353 aa, Aeromonas salmonicida; identical to SEQ ID NO: 2803

SEQ ID NO: 8751 - DNA, 1433 bp, Azotobacter vinelandii; identical to SEQ ID NO: 2804
  CDS (311)..(1360)

SEQ ID NO: 8752 - protein, 349 aa, Azotobacter vinelandii; identical to SEQ ID NO: 2805

SEQ ID NO: 8753 - DNA, 1108 bp, Acetobacter polyoxogenes; identical to SEQ ID NO: 2806
  CDS (35)..(1081)

SEQ ID NO: 8754 - protein, 348 aa, Acetobacter polyoxogenes; identical to SEQ ID NO: 2807

SEQ ID NO: 8755 - DNA, 1230 bp, Neisseria gonorrhoeae; identical to SEQ ID NO: 2808
  CDS (133)..(1179)

SEQ ID NO: 8756 - protein, 348 aa, Neisseria gonorrhoeae; identical to SEQ ID NO: 2809

SEQ ID NO: 8757 - DNA, 1649 bp, Bacteroides fragilis; identical to SEQ ID NO: 2810
  CDS (351)..(1307)

SEQ ID NO: 8758 - protein, 318 aa, Bacteroides fragilis; identical to SEQ ID NO: 2811

SEQ ID NO: 8759 - DNA, 1349 bp, Methylobacillus sp; identical to SEQ ID NO: 2812
  CDS (293)..(1327)

SEQ ID NO: 8760 - protein, 344 aa, Methylobacillus sp; identical to SEQ ID NO: 2813

SEQ ID NO: 8761 - DNA, 1320 bp, Vibrio anguillarum; identical to SEQ ID NO: 2814
  CDS (166)..(1212)

SEQ ID NO: 8762 - protein, 348 aa, Vibrio anguillarum; identical to SEQ ID NO: 2815

SEQ ID NO: 8763 - DNA, 1394 bp, Anabaena variabilis; identical to SEQ ID NO: 2816
  CDS (125)..(1201)

SEQ ID NO: 8764 - protein, 358 aa, Anabaena variabilis; identical to SEQ ID NO: 2817

SEQ ID NO: 8765 - DNA, 1334 bp, Bacillus subtilis; identical to SEQ ID NO: 2818
  CDS (215)..(1258)

SEQ ID NO: 8766 - protein, 347 aa, Bacillus subtilis; identical to SEQ ID NO: 2819

SEQ ID NO: 8767 - DNA, 1348 bp, Proteus mirabilis; identical to SEQ ID NO: 2820
  CDS (151)..(1218)

SEQ ID NO: 8768 - protein, 355 aa, Proteus mirabilis; identical to SEQ ID NO: 2821

SEQ ID NO: 8769 - DNA, 1384 bp, Pseudomonas aeruginosa; identical to SEQ ID NO: 2822
  CDS (145)..(1185)

SEQ ID NO: 8770 - protein, 346 aa, Pseudomonas aeruginosa; identical to SEQ ID NO: 2823

SEQ ID NO: 8771 - DNA, 1352 bp, Pseudomonas cepacia; identical to SEQ ID NO: 2824
  CDS (223)..(1266)

SEQ ID NO: 8772 - protein, 347 aa, Pseudomonas cepacia; identical to SEQ ID NO: 2825

SEQ ID NO: 8773 - DNA, 1047 bp, Synechococcus sp; identical to SEQ ID NO: 2826
  CDS (1)..(1047)

SEQ ID NO: 8774 - protein, 348 aa, Synechococcus sp; identical to SEQ ID NO: 2827

SEQ ID NO: 8775 - DNA, 1190 bp, Aquaspirillum magnetotacticum; identical to SEQ ID NO: 2828
  CDS (112)..(1146)

SEQ ID NO: 8776 - protein, 344 aa, Aquaspirillum magnetotacticum; identical to SEQ ID NO: 2829

SEQ ID NO: 8777 - DNA, 1841 bp, Rhizobium leguminosarum bv. viciae; identical to SEQ ID NO: 2830
  CDS (32)..(1087)

SEQ ID NO: 8778 - protein, 351 aa, Rhizobium leguminosarum bv. viciae; identical to SEQ ID NO: 2831

SEQ ID NO: 8779 - DNA, 1047 bp, Rhizobium meliloti; identical to SEQ ID NO: 2832
  CDS (1)..(1047)

SEQ ID NO: 8780 - protein, 348 aa, Rhizobium meliloti; identical to SEQ ID NO: 2833

SEQ ID NO: 8781 - DNA, 2762 bp, Mycobacterium tuberculosis; identical to SEQ ID NO: 2834
  CDS (311)..(2683)

SEQ ID NO: 8782 - protein, 790 aa, Mycobacterium tuberculosis; identical to SEQ ID NO: 2835

SEQ ID NO: 8783 - DNA, 1249 bp, Methylomonas clara; identical to SEQ ID NO: 2836
  CDS (123)..(1151)

SEQ ID NO: 8784 - protein, 342 aa, Methylomonas clara; identical to SEQ ID NO: 2837

SEQ ID NO: 8785 - DNA, 1065 bp, Enterobacter agglomerans; identical to SEQ ID NO: 2838
  CDS (1)..(1065)

SEQ ID NO: 8786 - protein, 354 aa, Enterobacter agglomerans; identical to SEQ ID NO: 2839

SEQ ID NO: 8787 - DNA, 1125 bp, Streptomyces lividans; identical to SEQ ID NO: 2840
  CDS (1)..(1125)

SEQ ID NO: 8788 - protein, 374 aa, Streptomyces lividans; identical to SEQ ID NO: 2841

SEQ ID NO: 8789 - DNA, 1347 bp, Rhodobacter sphaeroides; identical to SEQ ID NO: 2842
  CDS (220)..(1251)

SEQ ID NO: 8790 - protein, 343 aa, Rhodobacter sphaeroides; identical to SEQ ID NO: 2843

SEQ ID NO: 8791 - DNA, 1065 bp, Vibrio cholerae; identical to SEQ ID NO: 2844
  CDS (1)..(1065)

SEQ ID NO: 8792 - protein, 354 aa, Vibrio cholerae; identical to SEQ ID NO: 2845

SEQ ID NO: 8793 - DNA, 1068 bp, Rhodobacter capsulatus; identical to SEQ ID NO: 2846
  CDS (1)..(1068)

SEQ ID NO: 8794 - protein, 355 aa, Rhodobacter capsulatus; identical to SEQ ID NO: 2847

SEQ ID NO: 8795 - DNA, 1533 bp, Helicobacter pylori; identical to SEQ ID NO: 2848
  CDS (275)..(1318)

SEQ ID NO: 8796 - protein, 347 aa, Helicobacter pylori; identical to SEQ ID NO: 2849

SEQ ID NO: 8797 - DNA, 1065 bp, Synechocystis sp; identical to SEQ ID NO: 2850
  CDS (1)..(1065)

SEQ ID NO: 8798 - protein, 354 aa, Synechocystis sp; identical to SEQ ID NO: 2851

SEQ ID NO: 8799 - DNA, 1351 bp, Arabidopsis thaliana (mouse-ear cress); identical to SEQ ID NO: 2852
  CDS (1)..(1320)

SEQ ID NO: 8800 - protein, 439 aa, Arabidopsis thaliana (mouse-ear cress); identical to SEQ ID NO: 2853

SEQ ID NO: 8801 - DNA, 1392 bp, Pseudomonas putida; identical to SEQ ID NO: 2854
  CDS (111)..(1178)

SEQ ID NO: 8802 - protein, 355 aa, Pseudomonas putida; identical to SEQ ID NO: 2855

SEQ ID NO: 8803 - DNA, 1053 bp, Mycobacterium tuberculosis; identical to SEQ ID NO: 2856
  CDS (1)..(1053)

SEQ ID NO: 8804 - protein, 350 aa, Mycobacterium tuberculosis; identical to SEQ ID NO: 2857

SEQ ID NO: 8805 - DNA, 1053 bp, Wolinella succinogenes; identical to SEQ ID NO: 2858
  CDS (1)..(1053)

SEQ ID NO: 8806 - protein, 350 aa, Wolinella succinogenes; identical to SEQ ID NO: 2859

SEQ ID NO: 8807 - DNA, 1110 bp, Vibrio vulnificus; identical to SEQ ID NO: 2860
  CDS (1)..(1110)

SEQ ID NO: 8808 - protein, 369 aa, Vibrio vulnificus; identical to SEQ ID NO: 2861

SEQ ID NO: 8809 - DNA, 1068 bp, Photorhabdus luminescens; identical to SEQ ID NO: 2862
  CDS (1)..(1068)

SEQ ID NO: 8810 - protein, 355 aa, Photorhabdus luminescens; identical to SEQ ID NO: 2863

SEQ ID NO: 8811 - DNA, 1110 bp, Gloeobacter violaceus; identical to SEQ ID NO: 2864
  CDS (1)..(1110)

SEQ ID NO: 8812 - protein, 369 aa, Gloeobacter violaceus; identical to SEQ ID NO: 2865

SEQ ID NO: 8813 - DNA, 1053 bp, Chromobacterium violaceum; identical to SEQ ID NO: 2866
  CDS (1)..(1053)

SEQ ID NO: 8814 - protein, 350 aa, Chromobacterium violaceum; identical to SEQ ID NO: 2867

SEQ ID NO: 8815 - DNA, 1128 bp, Synechococcus sp; identical to SEQ ID NO: 2868
  CDS (1)..(1128)

SEQ ID NO: 8816 - protein, 375 aa, Synechococcus sp; identical to SEQ ID NO: 2869

SEQ ID NO: 8817 - DNA, 1128 bp, Rhodopirellula baltica; identical to SEQ ID NO: 2870
  CDS (1)..(1128)

SEQ ID NO: 8818 - protein, 375 aa, Rhodopirellula baltica; identical to SEQ ID NO: 2871

SEQ ID NO: 8819 - DNA, 1113 bp, Prochlorococcus marinus subsp; identical to SEQ ID NO: 2872
  CDS (1)..(1113)

SEQ ID NO: 8820 - protein, 370 aa, Prochlorococcus marinus subsp; identical to SEQ ID NO: 2873

SEQ ID NO: 8821 - DNA, 1140 bp, Prochlorococcus marinus; identical to SEQ ID NO: 2874
  CDS (1)..(1140)

SEQ ID NO: 8822 - protein, 379 aa, Prochlorococcus marinus; identical to SEQ ID NO: 2875

SEQ ID NO: 8823 - DNA, 1140 bp, Prochlorococcus marinus; identical to SEQ ID NO: 2876
  CDS (1)..(1140)

SEQ ID NO: 8824 - protein, 379 aa, Prochlorococcus marinus; identical to SEQ ID NO: 2877

SEQ ID NO: 8825 - DNA, 1038 bp, Helicobacter hepaticus; identical to SEQ ID NO: 2878
  CDS (1)..(1038)

SEQ ID NO: 8826 - protein, 345 aa, Helicobacter hepaticus; identical to SEQ ID NO: 2879

SEQ ID NO: 8827 - DNA, 1119 bp, Haemophilus ducreyi; identical to SEQ ID NO: 2880
  CDS (1)..(1119)

SEQ ID NO: 8828 - protein, 372 aa, Haemophilus ducreyi; identical to SEQ ID NO: 2881

SEQ ID NO: 8829 - DNA, 1048 bp, Campylobacter lari; identical to SEQ ID NO: 2882
  CDS (9)..(1043)

SEQ ID NO: 8830 - protein, 344 aa, Campylobacter lari; identical to SEQ ID NO: 2883

SEQ ID NO: 8831 - DNA, 1077 bp, Burkholderia fungorum; identical to SEQ ID NO: 2884
  CDS (1)..(1077)

SEQ ID NO: 8832 - protein, 358 aa, Burkholderia fungorum; identical to SEQ ID NO: 2885

SEQ ID NO: 8833 - DNA, 963 bp, Mycobacteriophage CJW1; identical to SEQ ID NO: 2886
  CDS (1)..(963)

SEQ ID NO: 8834 - protein, 320 aa, Mycobacteriophage CJW1; identical to SEQ ID NO: 2887

SEQ ID NO: 8835 - DNA, 1563 bp, Zymomonas mobilis; identical to SEQ ID NO: 2888
  CDS (231)..(1250)

SEQ ID NO: 8836 - protein, 339 aa, Zymomonas mobilis; identical to SEQ ID NO: 2889

SEQ ID NO: 8837 - DNA, 1038 bp, Bacillus megaterium; identical to SEQ ID NO: 2890
  CDS (1)..(1038)

SEQ ID NO: 8838 - protein, 345 aa, Bacillus megaterium; identical to SEQ ID NO: 2891

SEQ ID NO: 8839 - DNA, 1038 bp, Bacillus megaterium; identical to SEQ ID NO: 2892
  CDS (1)..(1038)

SEQ ID NO: 8840 - protein, 345 aa, Bacillus megaterium; identical to SEQ ID NO: 2893

SEQ ID NO: 8841 - DNA, 1044 bp, Bacillus amyloliquefaciens; identical to SEQ ID NO: 2894
  CDS (1)..(1044)

SEQ ID NO: 8842 - protein, 347 aa, Bacillus amyloliquefaciens; identical to SEQ ID NO: 2895

SEQ ID NO: 8843 - DNA, 1047 bp, Listeria monocytogenes; identical to SEQ ID NO: 2896
  CDS (1)..(1047): m means a or c

SEQ ID NO: 8844 - protein, 348 aa, Listeria monocytogenes; identical to SEQ ID NO: 2897
  misc_feature (228)..(228): Xaa can be Pro or Gln

SEQ ID NO: 8845 - DNA, 1035 bp, Oryza sativa; identical to SEQ ID NO: 2898
  CDS (1)..(1035)

SEQ ID NO: 8846 - protein, 344 aa, Oryza sativa; identical to SEQ ID NO: 2899

SEQ ID NO: 8847 - DNA, 1035 bp, Campylobacter lari; identical to SEQ ID NO: 2900
  CDS (1)..(1035)

SEQ ID NO: 8848 - protein, 344 aa, Campylobacter lari; identical to SEQ ID NO: 2901

SEQ ID NO: 8849 - DNA, 2035 bp, Borrelia hermsii; identical to SEQ ID NO: 2902
  CDS (256)..(1326)

SEQ ID NO: 8850 - protein, 356 aa, Borrelia hermsii; identical to SEQ ID NO: 2903

SEQ ID NO: 8851 - DNA, 1487 bp, Chlamydomonas reinhardtii; identical to SEQ ID NO: 2904
  CDS (121)..(1365)

SEQ ID NO: 8852 - protein, 414 aa, Chlamydomonas reinhardtii; identical to SEQ ID NO: 2905

SEQ ID NO: 8853 - DNA, 1669 bp, Streptococcus suis; identical to SEQ ID NO: 2906
  CDS (469)..(1500)

SEQ ID NO: 8854 - protein, 343 aa, Streptococcus suis; identical to SEQ ID NO: 2907

SEQ ID NO: 8855 - DNA, 1439 bp, Peanut witches; identical to SEQ ID NO: 2908
  CDS (218)..(1228)

SEQ ID NO: 8856 - protein, 336 aa, Peanut witches; identical to SEQ ID NO: 2909

SEQ ID NO: 8857 - DNA, 1377 bp, Myxococcus xanthus; identical to SEQ ID NO: 2910
  CDS (201)..(1277)

SEQ ID NO: 8858 - protein, 358 aa, Myxococcus xanthus; identical to SEQ ID NO: 2911

SEQ ID NO: 8859 - DNA, 1404 bp, Acidiphilium facilis; identical to SEQ ID NO: 2912
  CDS (187)..(1251)

SEQ ID NO: 8860 - protein, 354 aa, Acidiphilium facilis; identical to SEQ ID NO: 2913

SEQ ID NO: 8861 - DNA, 1059 bp, Actinobacillus actinomycetemcomitans; identical to SEQ ID NO: 2914
  CDS (1)..(1059)

SEQ ID NO: 8862 - protein, 352 aa, Actinobacillus actinomycetemcomitans; identical to SEQ ID NO: 2915

SEQ ID NO: 8863 - DNA, 1565 bp, Alcaligenes eutrophus; identical to SEQ ID NO: 2916
  CDS (194)..(1255)

SEQ ID NO: 8864 - protein, 353 aa, Alcaligenes eutrophus; identical to SEQ ID NO: 2917

SEQ ID NO: 8865 - DNA, 1047 bp, Amycolatopsis mediterranei; identical to SEQ ID NO: 2918
  CDS (1)..(1047)

SEQ ID NO: 8866 - protein, 348 aa, Amycolatopsis mediterranei; identical to SEQ ID NO: 2919

SEQ ID NO: 8867 - DNA, 1035 bp, Bacteroides thetaiotaomicron; identical to SEQ ID NO: 2920
  CDS (1)..(1035)

SEQ ID NO: 8868 - protein, 344 aa, Bacteroides thetaiotaomicron; identical to SEQ ID NO: 2921

SEQ ID NO: 8869 - DNA, 1194 bp, Bifidobacterium longum; identical to SEQ ID NO: 2922
  CDS (1)..(1194)

SEQ ID NO: 8870 - protein, 397 aa, Bifidobacterium longum; identical to SEQ ID NO: 2923

SEQ ID NO: 8871 - DNA, 1062 bp, Bordetella pertussis; identical to SEQ ID NO: 2924
  CDS (1)..(1062)

SEQ ID NO: 8872 - protein, 353 aa, Bordetella pertussis; identical to SEQ ID NO: 2925

SEQ ID NO: 8873 - DNA, 1089 bp, Bradyrhizobium japonicum; identical to SEQ ID NO: 2926
  CDS (1)..(1089)

SEQ ID NO: 8874 - protein, 362 aa, Bradyrhizobium japonicum; identical to SEQ ID NO: 2927

SEQ ID NO: 8875 - DNA, 2058 bp, Campylobacter fetus; identical to SEQ ID NO: 2928
  CDS (401)..(1438)

SEQ ID NO: 8876 - protein, 345 aa, Campylobacter fetus; identical to SEQ ID NO: 2929

SEQ ID NO: 8877 - DNA, 1458 bp, Chloroflexus aurantiacus; identical to SEQ ID NO: 2930
  CDS (116)..(1171)

SEQ ID NO: 8878 - protein, 351 aa, Chloroflexus aurantiacus; identical to SEQ ID NO: 2931

SEQ ID NO: 8879 - DNA, 1053 bp, Chlamydophila caviae; identical to SEQ ID NO: 2932
  CDS (1)..(1053)

SEQ ID NO: 8880 - protein, 350 aa, Chlamydophila caviae; identical to SEQ ID NO: 2933

SEQ ID NO: 8881 - DNA, 1087 bp, Chromatium vinosum; identical to SEQ ID NO: 2934
  CDS (1)..(1044)

SEQ ID NO: 8882 - protein, 347 aa, Chromatium vinosum; identical to SEQ ID NO: 2935

SEQ ID NO: 8883 - DNA, 1346 bp, Clostridium perfringens; identical to SEQ ID NO: 2936
  CDS (172)..(1230)

SEQ ID NO: 8884 - protein, 352 aa, Clostridium perfringens; identical to SEQ ID NO: 2937

SEQ ID NO: 8885 - DNA, 1053 bp, Clostridium tetani; identical to SEQ ID NO: 2938
  CDS (1)..(1053)

SEQ ID NO: 8886 - protein, 350 aa, Clostridium tetani; identical to SEQ ID NO: 2939

SEQ ID NO: 8887 - DNA, 1161 bp, Corynebacterium efficiens; identical to SEQ ID NO: 2940
  CDS (1)..(1161)

SEQ ID NO: 8888 - protein, 386 aa, Corynebacterium efficiens; identical to SEQ ID NO: 2941

SEQ ID NO: 8889 - DNA, 1402 bp, Corynebacterium glutamicum; identical to SEQ ID NO: 2942
  CDS (133)..(1263)

SEQ ID NO: 8890 - protein, 376 aa, Corynebacterium glutamicum; identical to SEQ ID NO: 2943

SEQ ID NO: 8891 - DNA, 1409 bp, Corynebacterium pseudotuberculosis; identical to SEQ ID NO: 2944
  CDS (223)..(1332)

SEQ ID NO: 8892 - protein, 369 aa, Corynebacterium pseudotuberculosis; identical to SEQ ID NO: 2945

SEQ ID NO: 8893 - DNA, 1032 bp, Coxiella burnetii; identical to SEQ ID NO: 2946
  CDS (1)..(1032)

SEQ ID NO: 8894 - protein, 343 aa, Coxiella burnetii; identical to SEQ ID NO: 2947

SEQ ID NO: 8895 - DNA, 1047 bp, Enterococcus faecalis; identical to SEQ ID NO: 2948
  CDS (1)..(1047)

SEQ ID NO: 8896 - protein, 348 aa, Enterococcus faecalis; identical to SEQ ID NO: 2949

SEQ ID NO: 8897 - DNA, 1072 bp, Erwinia carotovora; identical to SEQ ID NO: 2950
  CDS (1)..(1029)

SEQ ID NO: 8898 - protein, 342 aa, Erwinia carotovora; identical to SEQ ID NO: 2951

SEQ ID NO: 8899 - DNA, 1137 bp, Fusobacterium nucleatum; identical to SEQ ID NO: 2952
  CDS (1)..(1137)

SEQ ID NO: 8900 - protein, 378 aa, Fusobacterium nucleatum; identical to SEQ ID NO: 2953

SEQ ID NO: 8901 - DNA, 1613 bp, Herbaspirillum seropedicae; identical to SEQ ID NO: 2954
  CDS (199)..(1254)

SEQ ID NO: 8902 - protein, 351 aa, Herbaspirillum seropedicae; identical to SEQ ID NO: 2955

SEQ ID NO: 8903 - DNA, 1143 bp, Lactobacillus plantarum; identical to SEQ ID NO: 2956
  CDS (1)..(1143)

SEQ ID NO: 8904 - protein, 380 aa, Lactobacillus plantarum; identical to SEQ ID NO: 2957

SEQ ID NO: 8905 - DNA, 1101 bp, Leptospira interrogans; identical to SEQ ID NO: 2958
  CDS (1)..(1101)

SEQ ID NO: 8906 - protein, 366 aa, Leptospira interrogans; identical to SEQ ID NO: 2959

SEQ ID NO: 8907 - DNA, 1126 bp, Mycoplasma mycoides; identical to SEQ ID NO: 2960
  CDS (79)..(1116)

SEQ ID NO: 8908 - protein, 345 aa, Mycoplasma mycoides; identical to SEQ ID NO: 2961

SEQ ID NO: 8909 - DNA, 1050 bp, Mycobacterium smegmatis; identical to SEQ ID NO: 2962
  CDS (1)..(1050)

SEQ ID NO: 8910 - protein, 349 aa, Mycobacterium smegmatis; identical to SEQ ID NO: 2963

SEQ ID NO: 8911 - DNA, 1044 bp, Oceanobacillus iheyensis; identical to SEQ ID NO: 2964
  CDS (1)..(1044)

SEQ ID NO: 8912 - protein, 347 aa, Oceanobacillus iheyensis; identical to SEQ ID NO: 2965

SEQ ID NO: 8913 - DNA, 1071 bp, Paracoccus denitrificans; identical to SEQ ID NO: 2966
  CDS (1)..(1071)

SEQ ID NO: 8914 - protein, 356 aa, Paracoccus denitrificans; identical to SEQ ID NO: 2967

SEQ ID NO: 8915 - DNA, 1320 bp, Pasteurella haemolytica; identical to SEQ ID NO: 2968
  CDS (157)..(1263)

SEQ ID NO: 8916 - protein, 368 aa, Pasteurella haemolytica; identical to SEQ ID NO: 2969

SEQ ID NO: 8917 - DNA, 1500 bp, Pasteurella multocida; identical to SEQ ID NO: 2970
  CDS (175)..(1239)

SEQ ID NO: 8918 - protein, 354 aa, Pasteurella multocida; identical to SEQ ID NO: 2971

SEQ ID NO: 8919 - DNA, 1023 bp, Porphyromonas gingivalis; identical to SEQ ID NO: 2972
  CDS (1)..(1023)

SEQ ID NO: 8920 - protein, 340 aa, Porphyromonas gingivalis; identical to SEQ ID NO: 2973

SEQ ID NO: 8921 - DNA, 1824 bp, Prevotella ruminicola; identical to SEQ ID NO: 2974
  CDS (501)..(1523)

SEQ ID NO: 8922 - protein, 340 aa, Prevotella ruminicola; identical to SEQ ID NO: 2975

SEQ ID NO: 8923 - DNA, 978 bp, Proteus vulgaris; identical to SEQ ID NO: 2976
  CDS (1)..(978)

SEQ ID NO: 8924 - protein, 325 aa, Proteus vulgaris; identical to SEQ ID NO: 2977

SEQ ID NO: 8925 - DNA, 1047 bp, Pseudomonas oleovorans; identical to SEQ ID NO: 2978
  CDS (1)..(1047)

SEQ ID NO: 8926 - protein, 348 aa, Pseudomonas oleovorans; identical to SEQ ID NO: 2979

SEQ ID NO: 8927 - DNA, 1068 bp, Pseudomonas putida; identical to SEQ ID NO: 2980
  CDS (1)..(1068)

SEQ ID NO: 8928 - protein, 355 aa, Pseudomonas putida; identical to SEQ ID NO: 2981

SEQ ID NO: 8929 - DNA, 1110 bp, Pseudomonas syringae; identical to SEQ ID NO: 2982
  CDS (46)..(1110)

SEQ ID NO: 8930 - protein, 354 aa, Pseudomonas syringae; identical to SEQ ID NO: 2983

SEQ ID NO: 8931 - DNA, 1980 bp, Pseudomonas tolaasii; identical to SEQ ID NO: 2984
  CDS (414)..(1472)

SEQ ID NO: 8932 - protein, 352 aa, Pseudomonas tolaasii; identical to SEQ ID NO: 2985

SEQ ID NO: 8933 - DNA, 1501 bp, Rhizobium etli; identical to SEQ ID NO: 2986
  CDS (242)..(1327)

SEQ ID NO: 8934 - protein, 361 aa, Rhizobium etli; identical to SEQ ID NO: 2987

SEQ ID NO: 8935 - DNA, 1098 bp, Rhizobium loti; identical to SEQ ID NO: 2988
  CDS (1)..(1098)

SEQ ID NO: 8936 - protein, 365 aa, Rhizobium loti; identical to SEQ ID NO: 2989

SEQ ID NO: 8937 - DNA, 1092 bp, Rhodopseudomonas palustris; identical to SEQ ID NO: 2990
  CDS (1)..(1092)

SEQ ID NO: 8938 - protein, 363 aa, Rhodopseudomonas palustris; identical to SEQ ID NO: 2991

SEQ ID NO: 8939 - DNA, 1047 bp, Rhodopseudomonas viridis; identical to SEQ ID NO: 2992
  CDS (1)..(1047)

SEQ ID NO: 8940 - protein, 348 aa, Rhodopseudomonas viridis; identical to SEQ ID NO: 2993

SEQ ID NO: 8941 - DNA, 1074 bp, Shewanella oneidensis; identical to SEQ ID NO: 2994
  CDS (1)..(1074)

SEQ ID NO: 8942 - protein, 357 aa, Shewanella oneidensis; identical to SEQ ID NO: 2995

SEQ ID NO: 8943 - DNA, 1235 bp, Spirulina platensis; identical to SEQ ID NO: 2996
  CDS (54)..(1151)

SEQ ID NO: 8944 - protein, 365 aa, Spirulina platensis; identical to SEQ ID NO: 2997

SEQ ID NO: 8945 - DNA, 1074 bp, Staphylococcus epidermidis; identical to SEQ ID NO: 2998
  CDS (25)..(1074)

SEQ ID NO: 8946 - protein, 349 aa, Staphylococcus epidermidis; identical to SEQ ID NO: 2999

SEQ ID NO: 8947 - DNA, 1140 bp, Streptococcus agalactiae; identical to SEQ ID NO: 3000
  CDS (1)..(1140)

SEQ ID NO: 8948 - protein, 379 aa, Streptococcus agalactiae; identical to SEQ ID NO: 3001

SEQ ID NO: 8949 - DNA, 1119 bp, Streptomyces ambofaciens; identical to SEQ ID NO: 3002
  CDS (1)..(1119)

SEQ ID NO: 8950 - protein, 372 aa, Streptomyces ambofaciens; identical to SEQ ID NO: 3003

SEQ ID NO: 8951 - DNA, 1134 bp, Streptomyces avermitilis; identical to SEQ ID NO: 3004
  CDS (1)..(1134)

SEQ ID NO: 8952 - protein, 377 aa, Streptomyces avermitilis; identical to SEQ ID NO: 3005

SEQ ID NO: 8953 - DNA, 1152 bp, Streptococcus mutans; identical to SEQ ID NO: 3006
  CDS (1)..(1152)

SEQ ID NO: 8954 - protein, 383 aa, Streptococcus mutans; identical to SEQ ID NO: 3007

SEQ ID NO: 8955 - DNA, 1137 bp, Streptococcus pyogenes; identical to SEQ ID NO: 3008
  CDS (1)..(1137)

SEQ ID NO: 8956 - protein, 378 aa, Streptococcus pyogenes; identical to SEQ ID NO: 3009

SEQ ID NO: 8957 - DNA, 1356 bp, Streptococcus parasanguis; identical to SEQ ID NO: 3010
  CDS (118)..(1263)

SEQ ID NO: 8958 - protein, 381 aa, Streptococcus parasanguis; identical to SEQ ID NO: 3011

SEQ ID NO: 8959 - DNA, 1416 bp, Streptomyces rimosus; identical to SEQ ID NO: 3012
  CDS (229)..(1359)

SEQ ID NO: 8960 - protein, 376 aa, Streptomyces rimosus; identical to SEQ ID NO: 3013

SEQ ID NO: 8961 - DNA, 1916 bp, Streptococcus thermophilus; identical to SEQ ID NO: 3014
  CDS (555)..(1694)

SEQ ID NO: 8962 - protein, 379 aa, Streptococcus thermophilus; identical to SEQ ID NO: 3015

SEQ ID NO: 8963 - DNA, 1271 bp, Streptomyces violaceus; identical to SEQ ID NO: 3016
  CDS (75)..(1208)

SEQ ID NO: 8964 - protein, 377 aa, Streptomyces violaceus; identical to SEQ ID NO: 3017

SEQ ID NO: 8965 - DNA, 1068 bp, Synechococcus elongatus; identical to SEQ ID NO: 3018
  CDS (1)..(1068)

SEQ ID NO: 8966 - protein, 355 aa, Synechococcus elongatus; identical to SEQ ID NO: 3019

SEQ ID NO: 8967 - DNA, 1023 bp, Thermus thermophilus; identical to SEQ ID NO: 3020
  CDS (1)..(1023)

SEQ ID NO: 8968 - protein, 340 aa, Thermus thermophilus; identical to SEQ ID NO: 3021

SEQ ID NO: 8969 - DNA, 1405 bp, Thiobacillus ferrooxidans; identical to SEQ ID NO: 3022
  CDS (196)..(1236)

SEQ ID NO: 8970 - protein, 346 aa, Thiobacillus ferrooxidans; identical to SEQ ID NO: 3023

SEQ ID NO: 8971 - DNA, 1314 bp, Tropheryma whipplei; identical to SEQ ID NO: 3024
  CDS (1)..(1314)

SEQ ID NO: 8972 - protein, 437 aa, Tropheryma whipplei; identical to SEQ ID NO: 3025

SEQ ID NO: 8973 - DNA, 1411 bp, Vibrio cholerae; identical to SEQ ID NO: 3026
  CDS (183)..(1247)

SEQ ID NO: 8974 - protein, 354 aa, Vibrio cholerae; identical to SEQ ID NO: 3027

SEQ ID NO: 8975 - DNA, 1044 bp, Vibrio parahaemolyticus; identical to SEQ ID NO: 3028
  CDS (1)..(1044)

SEQ ID NO: 8976 - protein, 347 aa, Vibrio parahaemolyticus; identical to SEQ ID NO: 3029

SEQ ID NO: 8977 - DNA, 996 bp, Wigglesworthia glossinidia brevipalpis; identical to SEQ ID NO: 3030
  CDS (1)..(996)

SEQ ID NO: 8978 - protein, 331 aa, Wigglesworthia glossinidia brevipalpis; identical to SEQ ID NO: 3031

SEQ ID NO: 8979 - DNA, 1035 bp, Xanthomonas axonopodis; identical to SEQ ID NO: 3032
  CDS (1)..(1035)

SEQ ID NO: 8980 - protein, 344 aa, Xanthomonas axonopodis; identical to SEQ ID NO: 3033

SEQ ID NO: 8981 - DNA, 1594 bp, Xenorhabdus nematophilus; identical to SEQ ID NO: 3034
  CDS (142)..(1218)

SEQ ID NO: 8982 - protein, 358 aa, Xenorhabdus nematophilus; identical to SEQ ID NO: 3035

SEQ ID NO: 8983 - DNA, 1044 bp, Xylella fastidiosa; identical to SEQ ID NO: 3036
  CDS (1)..(1044)

SEQ ID NO: 8984 - protein, 347 aa, Xylella fastidiosa; identical to SEQ ID NO: 3037

SEQ ID NO: 8985 - DNA, 1020 bp, Zymomonas mobilis; identical to SEQ ID NO: 3038
  CDS (1)..(1020)

SEQ ID NO: 8986 - protein, 339 aa, Zymomonas mobilis; identical to SEQ ID NO: 3039

SEQ ID NO: 8987 - DNA, 1660 bp, primary endosymbiont of Sitophilus oryzae; identical to SEQ ID NO: 3040
  CDS (11)..(1078)

SEQ ID NO: 8988 - protein, 355 aa, primary endosymbiont of Sitophilus oryzae; identical to SEQ ID NO: 3041

SEQ ID NO: 8989 - DNA, 1110 bp, Azospirillum lipoferum; identical to SEQ ID NO: 3042
  CDS (1)..(1110)

SEQ ID NO: 8990 - protein, 369 aa, Azospirillum lipoferum; identical to SEQ ID NO: 3043

SEQ ID NO: 8991 - DNA, 1017 bp, Geobacter sulfurreducens; identical to SEQ ID NO: 3044
  CDS (1)..(1017)

SEQ ID NO: 8992 - protein, 338 aa, Geobacter sulfurreducens; identical to SEQ ID NO: 3045

SEQ ID NO: 8993 - DNA, 1230 bp, Mycobacterium paratuberculosis; identical to SEQ ID NO: 3046
  CDS (1)..(1230)

SEQ ID NO: 8994 - protein, 409 aa, Mycobacterium paratuberculosis; identical to SEQ ID NO: 3047

SEQ ID NO: 8995 - DNA, 1083 bp, Lactobacillus johnsonii; identical to SEQ ID NO: 3048
  CDS (1)..(1083)

SEQ ID NO: 8996 - protein, 360 aa, Lactobacillus johnsonii; identical to SEQ ID NO: 3049

SEQ ID NO: 8997 - DNA, 1245 bp, Treponema denticola; identical to SEQ ID NO: 3050
  CDS (1)..(1245)

SEQ ID NO: 8998 - protein, 414 aa, Treponema denticola; identical to SEQ ID NO: 3051

SEQ ID NO: 8999 - DNA, 1068 bp, Wolbachia pipientis wMel; identical to SEQ ID NO: 3052
  CDS (1)..(1068)

SEQ ID NO: 9000 - protein, 355 aa, Wolbachia pipientis wMel; identical to SEQ ID NO: 3053

SEQ ID NO: 9001 - DNA, 1074 bp, Desulfovibrio vulgaris; identical to SEQ ID NO: 3054
  CDS (1)..(1074)

SEQ ID NO: 9002 - protein, 357 aa, Desulfovibrio vulgaris; identical to SEQ ID NO: 3055

SEQ ID NO: 9003 - DNA, 1557 bp, Bacillus licheniformis; identical to SEQ ID NO: 3056
  CDS (369)..(1415)

SEQ ID NO: 9004 - protein, 348 aa, Bacillus licheniformis; identical to SEQ ID NO: 3057

SEQ ID NO: 9005 - DNA, 1119 bp, Corynebacterium diphtheriae; identical to SEQ ID NO: 3058
  CDS (1)..(1119)

SEQ ID NO: 9006 - protein, 372 aa, Corynebacterium diphtheriae; identical to SEQ ID NO: 3059

SEQ ID NO: 9007 - DNA, 1038 bp, Mycoplasma mycoides; identical to SEQ ID NO: 3060
  CDS (1)..(1038)

SEQ ID NO: 9008 - protein, 345 aa, Mycoplasma mycoides; identical to SEQ ID NO: 3061

SEQ ID NO: 9009 - DNA, 1134 bp, Bdellovibrio bacteriovorus; identical to SEQ ID NO: 3062
  CDS (1)..(1134)

SEQ ID NO: 9010 - protein, 377 aa, Bdellovibrio bacteriovorus; identical to SEQ ID NO: 3063

SEQ ID NO: 9011 - DNA, 1086 bp, Parachlamydia sp; identical to SEQ ID NO: 3064
  CDS (1)..(1086)

SEQ ID NO: 9012 - protein, 361 aa, Parachlamydia sp; identical to SEQ ID NO: 3065

SEQ ID NO: 9013 - DNA, 1071 bp, Photobacterium profundum; identical to SEQ ID NO: 3066

SEQ ID NO: 9014 - protein, 356 aa, Photobacterium profundum; identical to SEQ ID NO: 3067

SEQ ID NO: 9015 - DNA, 24 bp, Primer
atggctatcgacgaaaacaaacag

SEQ ID NO: 9016 - DNA, 27 bp, Primer
ttaaaaatcttcgttagtttctgctac

SEQ ID NO: 9017 - DNA, 1374 bp, Escherichia coli K12
  CDS (1)..(1374)
atgatggaaggtcaacagcacggcgagcagctaaagcgcggccttaaaaaccgccatattcagcttatcgcgctgggtggcgcgatagggaccgggttattcctgggtagcgcctccgtaatacagtccgcagggccagggattatcctgggttacgccattgctggttttatcgcctttctgatcatgcgtcagctgggtgaaatggtggtcgaagaacctgtcgcaggctcctttagccactttgcttataaatactggggcagttttgccggtttcgcctctggctggaactactgggtactgtacgttttagttgccatggctgagctgactgccgtgggtaaatacattcagttctggtatccggaaatccccacctgggtttctgccgccgtattctttgtggtgattaacgccatcaacctgaccaacgttaaagtgtttggcgagatggagttctggtttgccattatcaaagttatcgcggtggtagcgatgatcatcttcggcggctggctgctattcagtggcaacggcggcccgcaggcgaccgttagcaacctgtgggatcagggtggtttcctgccgcacggcttcaccgggctggtgatgatgatggcgattatcatgttctcgttcggtggtctggaactggtggggatcaccgcagcagaagctgataacccggagcaaagtataccgaaagcaactaaccaggttatctaccgcatcctgattttctatattggttcgttagccgttctgctctcactgatgccgtggacccgcgttaccgccgataccagtccgtttgtgctgatcttccacgagttaggcgatacctttgtggcgaatgcgctgaacatcgtggtactgactgcggcgctctccgtgtacaacagctgcgtatattgcaacagccgtatgctgtttggtctggcacaacagggtaatgcgccaaaagcgctggcgtctgtcgataaacgtggtgtaccagtaaataccattctggtgtctgcactggtaacggcgttgtgcgtactgattaactaccttgccccagagtccgctttcggactgttaatggcgctggtggtatctgcactggtaatcaactgggcgatgattagcctggcgcatatgaaattccgtcgcgccaagcaggaacaaggcgtggtaactcgcttccctgctctgctttatccgctgggtaactggatctgcctgctgtttatggcggcggtactggtgattatgctgatgaccccaggaatggcgatttcggtatacctgatcccggtatggctgatcgtgttaggtatcggctatctgtttaaagagaaaaccgccaaagccgtaaaagcgcattaa

SEQ ID NO: 9018 - protein, 457 aa, Escherichia coli K12
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 9019 - DNA, 2256 bp, Escherichia coli
  CDS (636)..(2012)
aagcttaaactcatggtgccgatgacgttgatgattatcttcgtgctgttgtatctggcgttccgtcgggtgggcgaaagcgttgctgattatcagcagcgtaccgtttgcgctggtgggcggcatctggttgctgtggtggatgggctttcatctttccgtggcgacgggcactggctttatcgcctcgccggggtcgccgccgaatttggcgtggtgatgctgatgtatttacgtcacgccatagaggccgtgccgtcgttgaataatccacaaacattcagcgagcagaagctggatgaggcgttatatcacggcgcggtcctgcgcgtgcgcccgaaagcgatgacggtggcggtgattatcgccggtctgctgccgattctgtggggaacgggggctggttcagaggtgatgagccggattgccgcgccgatgattggcggcatgatcaccgcacctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcatgaaaaacgcgtcaaccgtatcggaagatactgcgtcgaatcaagagccgacgcttcatcgcggattacataaccgtcatattcaactgattgcgttgggtggcgcaattggtactggtctgtttcttggcattggcccggcgattcagatggcgggtccggctgtattgctgggctacggcgtcgccgggatcatcgctttcctgattatgcgccagcttggcgaaatggtggttgaggagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgttgattaaagtgctggcaatcatcggtatgatcggctttggcctgtggctgctgttttctggtcacggcggcgagaaagccagtatcgacaacctctggcgctacggtggtttcttcgccaccggctggaatgggctgattttgtcgctggcggtaattatgttctccttcggcggtctggagctgattgggattactgccgctgaagcgcgcgatccggaaaaaagcattccaaaagcggtaaatcaggtggtgtatcgcatcctgctgttttacatcggttcactggtggttttactggcgctctatccgtgggtggaagtgaaatccaacagtagcccgtttgtgatgattttccataatctcgacagcaacgtggtagcttctgcgctgaacttcgtcattctggtagcatcgctgtcagtgtataacagcggggtttactctaacagccgcatgctgtttggcctttctgtgcagggtaatgcgccgaagtttttgactcgcgtcagccgtcgcggtgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgtctggcgcatctgcgttttcgtgcagcgatgcgacgtcaggggcgtgaaacacagtttaaggcgctgctctatccgttcggcaactatctctgcattgccttcctcggcatgattttgctgctgatgtgcacgatggatgatatgcgcttgtcagcgatcctgctgccggtgtggattgtattcctgtttatggcatttaaaacgctgcgtcggaaataaggcattcacgctacatccgacaaaacgatgtcaaccatccgaaaccgctctcatccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttagtaaacgcgtagatct

SEQ ID NO: 9020 - protein, 458 aa, Escherichia coli
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 9021 - DNA, 1709 bp, Helicobacter pylori
  CDS (68)..(1627)
aaaaaaccttaaaacgcttaaaaaactatcgcttgatcaagctcttttactatttaatctttaaaaaatgcttttgatcgttttttttaaattttattttcaatattcaattaaaaaaaaatcattttattttatttttgttataattcaagctatttttattttcaatctaaggaggtgtcgcatggacaatcaaaagataacgcatcaaaatatcacgcaaaaacaaggcgagcttaaaagagacatgaaaatgcgccatctcttaatgattgcatttggaggagcgatcggcacagggctttttgtaggcactgggggtaatattgcgagcgctggccctttagggaccttgatcgcttattgttttggagggcttgtggtctattgtatcatgctctctttaggcgaattggctagcgtttatcccactacaggaagttttggggattatgcggctaaattcataggccctggcacgggctatatggttttttggatgtattggcttggctgggtgatcacggtggcgttagaatacatcgctataggcatgctcatgcaacgctggtttgcggatattcccatccattattgggttattttatgcattgcgttagtttttttattgaactttttttcggttaaaatttttgccgagggcgagtttttctttagcctgattaaagttttagcggtgatcgcttttataggcattggcgcgattgggattatttatcaaatctattcgcatgggtttggttctatttttgataatttccattttggcgataaggggtttttccctaatgggagcgcagcggtttttagcgcgatgctcgctgttatttttgctttcactggcacagaggtgattggggtggctgtgggagagactaaaaacgctagcgaagtgatgcccaaagcgattaaagcgaccttgtggcggattgtctttttctttttaggctctgtgtttgtcatttctgtttttttacccatgaatgattcttctatcacgcaaagcccttttgtgagcgttttagaacgcattaatttgccctttattggcatgggtatcccttatgtggctgatataatgaacgctgttatcattacggcgatgttttctaccgctaattcagggctttatggagcgagccgcatgatttatgggctgtccaaacaaaagatgttttttaaggttttttcccaactcaaccgacaaggcacgcccacttatgcgatgtttttttccctttctttttctctcatagggcttttagtccaaatttatgccaaagaaaatgtcgtggaagctttgattaatgtgatcagtttcacggtgattattgtgtgggttagcgtgtctgtttcgcaatattctttccgcaagcaatacttaaaagccgggcattctttagaggatttgccttataaagccccctttctaccctttttgcaactcatagggatcactgggtgtgccatcggcgtgattggttcggctatggataaggatcaacgcattgggatgattttaacgattgttttcgctgttatttgttacattggatactattttacacaaaaagctaatgaaaataacaaaaaagatttgatataatcttttcttaattttgaagtttagcaaattttaaggaagtaaccatgatgaaaaaaaccctttttatctctttggctttagc

SEQ ID NO: 9022 - protein, 519 aa, Helicobacter pylori
MLLIVFFKFYFQYSIKKKSFYFIFVIIQAIFIFNLRRCRMDNQKITHQNITQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFADIPIHYWVILCIALVFLLNFFSVKIFAEGEFFFSLIKVLAVIAFIGIGAIGIIYQIYSHGFGSIFDNFHFGDKGFFPNGSAAVFSAMLAVIFAFTGTEVIGVAVGETKNASEVMPKAIKATLWRIVFFFLGSVFVISVFLPMNDSSITQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSVSQYSFRKQYLKAGHSLEDLPYKAPFLPFLQLIGITGCAIGVIGSAMDKDQRIGMILTIVFAVICYIGYYFTQKANENNKKDLI

SEQ ID NO: 9023 - DNA, 1413 bp, Bacillus subtilis
  CDS (1)..(1413)
atgaactctgcccacaacaagaatgagacaacctttcagagaagtatgaaaagccggcacctctttatgctttccttgggaggtgtcatcggaaccgggctgtttttaagctcaggttataccattcagcaagcaggcccggccggaacgatactcgcctacttagtcggggccggcatcgtctatctggtcatgctatgcctcggtgagctgtcagtcgccatgcctgtgaccggcgcctttcacacctatgcagccaaatacatagggccgggcaccggatttacggtcgcttggctgtattggctgacatggaccgtggcattgggatcagaattcacagcagccggcctgttaatgcagcgctggttcccccatacatcggtttggatgtggagtgccgtctttgcgctgttcatcttcttgcttaacgcattttcggtcaagtttttcgctgaatcagaattttggttttccagcatcaaagtattagccattgtattatttattcttttaggcggctctgccatgttcggcatcatcccgatcaaaggcggagaagccgctccgatgctgtccaacttcacggcggaaggcgggctttttcccaatggatttgtcccgattttgatgacgatgctgtccgtcaattttgccttttcgggaacggaactaatcggaatcgcagccggtgaaagcgttgatcctgacaagacgataccaaaagcgataaaaacaacggtctggcgtctctcgctcttctttgtcggaacaatttttgtgctgtcagggctgattccgattcaagatgcaggtgtcatcaaaagcccgtttgtcgctgtctttgacagagtcggtgtaccatacgcagccgatatcatgaactttgttatcctgacagcgatcctgtcagcggctaattccggactctacgcttcttcccggatgctgtggtctttatcaaaagaaaaaacgcttcatccgacatttgcaaagctgacgtcaaaaggaaccccttttaacgcgctggtgttcagcatgatcggcggcattctgtcgttgctgtccagcgtatttgcgccagacactgtatacgttgtgctcgtgtcgatttccggttttgccgtcgttgtcgtgtggatgggaatcgctgcttctcaattcatgttcagaaaacgttatatcgaagcgggaaacaaggttactgatttgaaatacagaacccctttgtatccgttcgtgccgattgctgcgttcctgttatgcctggcttccgtcgttggcattgcctttgatccgaatcaaagaatcgcactctattgcggcgttccatttatggccatttgctatgcaatatattatgtaaaaaaccgcaaaagccagccggctgctgatatgactcattcaaaataa

SEQ ID NO: 9024 - protein, 470 aa, Bacillus subtilis
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 9025 - DNA, 1428 bp, Helicobacter pylori
  CDS (1)..(1428)
atggaacatcaaaataccacgcaaaaacaaggcgagcttaaaagagacatgaaaatgcgccatctcttgatgattgcctttgggggagcgatcggcacagggctttttgtaggcactgggggtaatattgcgagtgctggccctttagggaccttgatcgcttattgttttggagggcttgtggtctattgcatcatgctctctttaggcgagttggctagcgtttaccccactacgggaagttttggggattatgcggctaaattcataggccctggcacgggctatatggttttttggatgtattggcttggctgggtaatcacggttgcgttagaatacatcgctataggcatgctcatgcaacgctggtttgtaaatattcccatccattattgggtcatttcatgcattgcgttggtttttttattgaactttttttcggttaaaatttttgccgagggcgagtttttctttagcctgattaaagttttagcggtgatcgcttttataagcattggcgtaattgggatcatttatcaaatctatttgcatgggtttagttctatttttgataacttccattttggcgataaggggtttttccctaacgggagcgaggcggtttttagcgcgatgctcgctgttatttttgctttcactggcacagaagtcattggagtggctgtaggcgagactaaaaacgctagcgaagtgatgcccaaagcgattaaagcgactttgtggcggattgtctttttctttttaggctctgtgtttgtcatttctgtttttttacccatgagcgattcttctatcgcgcaaagcccctttgtgagcgttttagaacgcatcaacttgccctttattggcatgggtatcccttatgtggctgatataatgaacgctgttatcattacggcgatgttttctaccgctaattcagggctttatggagcgagccgcatgatttatgggctgtccaaacaaaagatgttttttaaagttttttcccaactcaaccgacaaggcacgcccacttatgcgatgtttttttccctttctttttccctcatagggcttttagtccaaatttatgccaaagaaaatgtcgtggaagctttgattaatgtgatcagtttcacggtgattatcgtgtgggttagcgtgtccatttcgcaatattctttccgcaagcaatatttaaaagccgggcattctttagaggatttgccttataaagcccctttcctgccctttttgcaactcatagggatcactgggtgtattatcggtgtgattggttcggctatggataaggatcaacgcatcgggatgattttaacgattgtttttgctgttgtgtgttacattggatactattttacacaaaaagctaatgaaaataacaaaaaagatttgatataa

SEQ ID NO: 9026 - protein, 475 aa, Helicobacter pylori
MEHQNTTQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFVNIPIHYWVISCIALVFLLNFFSVKIFAEGEFFFSLIKVLAVIAFISIGVIGIIYQIYLHGFSSIFDNFHFGDKGFFPNGSEAVFSAMLAVIFAFTGTEVIGVAVGETKNASEVMPKAIKATLWRIVFFFLGSVFVISVFLPMSDSSIAQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSISQYSFRKQYLKAGHSLEDLPYKAPFLPFLQLIGITGCIIGVIGSAMDKDQRIGMILTIVFAVVCYIGYYFTQKANENNKKDLI

SEQ ID NO: 9027 - DNA, 1341 bp, Lactococcus lactis subsp. lactis
  CDS (1)..(1341)
atggaaactaatcaatccttaaagaaaaaaatggccgcacgccatattactatgattgctcttggtggagcaattggtgctggtcttttcaaaggaagctcatcagccattgctgccgctggtccctctgtcttaatcgcttattttatcggaggaatcgttctttattttgtaatgaagagtttagaaaagcttgttctaagttcaaaagatccacacggcttgtccggacttgttcagccttatctgggtaatcatacggctgattttacggactgggtttattggtcaatgtggatgattaatatcattgctgaggctgttgctgctgcaagttttttgcagctctggtttgctaatgttcccacttgggtttttgtcttgattattgcccttttaacttcccttattaacttattctcagttgctctctttgctgagacagaatactggttggcatttattaaaattagtgttgttattttgttgattatttttggtgtttttcttgtggcaaaacaaatttttgatactaatctagtgactactttctctggaatgaccgctcatggtggctttgctcctcatggctttaaaggggtcattaattctttattaattgttatctattcgtatggtggttctgaattaattgctattacagttagtgaaacagaagatcctaaaagagccattcctaaagccatccgcggtgtaatcgggcgaattatttcattttatattattccgatgttcttacttcttgtgatttataattggcaaacgttggctacttcttcaatgagcccttttgtgatggtctttaataaaatgcatattccttttgctggcgatattgtcaacttgattatcattcttgccctcttctcatcaattaattctggaatctatgcttcatctcgccttttgtatttccgtttaaaaaatcgtcaaggtaaaatggctcaaagaatggctcatttaaataaacatcacgttcctcaaagagcagttattttctgttcaggtacactttatatcggtgttgttctttcttattttgtcggtgatcgtttgtttaattacttggctggttccctttcttacactgttttagccgtttggattttaattagtctcgctggttttggtctctctcttaaaacaaaatcattatccggtagaacaatgagtctcttagcactgattgctctctttctcattctgattggtattttatttactaatccaattggtgtgactgtcttcacagcaattctttatttcatcatctttatcagttatcaaaaaaagaatgattctgtcagtaatttaaactaa

SEQ ID NO: 9028 - protein, 446 aa, Lactococcus lactis subsp. lactis
METNQSLKKKMAARHITMIALGGAIGAGLFKGSSSAIAAAGPSVLIAYFIGGIVLYFVMKSLEKLVLSSKDPHGLSGLVQPYLGNHTADFTDWVYWSMWMINIIAEAVAAASFLQLWFANVPTWVFVLIIALLTSLINLFSVALFAETEYWLAFIKISVVILLIIFGVFLVAKQIFDTNLVTTFSGMTAHGGFAPHGFKGVINSLLIVIYSYGGSELIAITVSETEDPKRAIPKAIRGVIGRIISFYIIPMFLLLVIYNWQTLATSSMSPFVMVFNKMHIPFAGDIVNLIIILALFSSINSGIYASSRLLYFRLKNRQGKMAQRMAHLNKHHVPQRAVIFCSGTLYIGVVLSYFVGDRLFNYLAGSLSYTVLAVWILISLAGFGLSLKTKSLSGRTMSLLALIALFLILIGILFTNPIGVTVFTAILYFIIFISYQKKNDSVSNLN

SEQ ID NO: 9029 - DNA, 1521 bp, Lactococcus lactis subsp. lactis
  CDS (1)..(1521)
atgagtctgagtcaaacaagtcggtgtagaataaattttattagggagagaattttggaaaattcttcaaactcaactactgagacgcaagtaaaacgcggcttaaaatcacgtcatgtttccatgattgcccttggcggaacaatcggaactggattgtttctgacttcaggcgatgtcattcacacggcaggaccatttggtgcactgactgcctatgttcttatcggagcaatggtttacttcctcatgacatcacttggtgaaatggccacttatttacccacttctggttctttttcagactatggaacacgttatgttgacccagcttttggttttgctctaggttggaattactggttaaactgggcaattaccgtagcggttgatttaacagccgttgccctttgtatcaaattctggttaccagatgttccaagttggattttttcactgattgccttaattattgtctttgcaatcaatgccttatcagttaaaacttttggcgaaactgaatattggttgtcagccattaaaattactgttgttgttttattcttgattattggtttcttatctatttttggaattatgggcggtcatattgacgtcgctaaaaatctttcagttggtaatcatggttttgtcggaggacttggtagtttcactaccggcggagggattctcggcgtactcttagtcgctggtttctctttccaaggaacagaattgctcggaattacagctggcgaagctgaaaatcctgaaaaatcaattcctaaagctatgaactctatcttctggcgtattcttgtcttttatatcttatctatcttcgtgatggcggctatcattccatttaccgacccacacttagttggaggaaattcagctgctcaaagccctttcacaattgtatttgaacgtgttggtctctctattgcagcttctatcatgaacgccgttgttttaacttctgtcgtttcagcagcaaattctggaatgtatgcctctactcggatgctttattcactagctaaagatggtggcgcaccaaagattttctcaaaaacttcaaaaaacgggatccctttcattgctttattagctacaactgctattgctttactcacattcttgacatcaatttacggagttagcttctttacattcctcgtctcagcctctggtttaacaggatttattgcttggattgggattgcaattagccacttccgcttccgccgcgcctatgttgctcaaggaaaagatgttaaaaaattaccttatcatgcaaaactattcccatttggtccaatcttagccttaattatgaccgttttagtcacactcggccaagacccaatgcttctttttggtaaaacttgggtgcaaggtgtcatcatgtatgccgcaattccactcttcttcatcctttacttgggttataaatttaaaaacaaaacgaaacttatcccccttaaagaggttgatttaagtcgtcataaagattaa

SEQ ID NO: 9030 - protein, 506 aa, Lactococcus lactis subsp. lactis
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 9031 - DNA, 1494 bp, Salmonella enterica subsp. enterica serovar Typhi
  CDS (1)..(1494)
atgaaaacacagactacgcacgccgcagaacaacatgcggcgaaacgacgctggctgaacgcccatgaagaggggtatcacaaagcgatggggaatcgtcaggttcagatgattgctatcggcggcgcgattggcaccggtttatttttaggtgcaggcgcccgattgcaaatggccggaccggcactggcgctggtctatctgatatgcggcattttttcttttttcattttacgcgcgctgggcgaactggtattgcatcgcccttccagcgggagcttcgtctcctacgcccgtgaatttttgggtgaaaaagcggcctacgtagcaggctggatgtactttattaactgggcgatgaccgggatcgtcgatatcaccgcagtggcgttatacatgcactactggggcgcatttggcgacgttccgcaatgggtgtttgcgctcggcgcgttaaccattgtcggtaccatgaacatgatcggcgtaaaatggtttgccgaaatggagttctggttcgcgctgataaaagtactcgccattgttatcttcctggtggtaggcacgatttttctcggtaccggtcaaccgcttgagggtaatgccaccggttttcacctgattacagataatggcggctttttcccgcacggcctgttgcccgcgctggtactgattcagggcgtggtgttcgcttttgcttcgattgaattggtcggtaccgccgctggggagtgcaaagatccacagacgatggtgccaaaagccatcaatagcgtgatctggcgtattggtcttttctatgtaggatcggtcgtattgctggttttgctgctgccgtggaacgcctaccaggcggggcaaagtccgtttgtcaccttcttttctaaacttggcgtgccttatatcggcagtattatgaatatcgtggtgttaaccgccgcgctttccagcctgaactccgggctttactgtacggggagaattttacgttcaatgtcgatgggggggtccgcgccgaaattcatggcgaaaatgagccgtcagcatgtgccctatgcgggtattctggcgactctggtggtttacgtggtcggcgtgttccttaattatctggtcccctcccgcgtgtttgagatcgttcttaattttgcctcgctcggcattatcgcgtcgtgggcgtttatcatggtgtgccagatgcgtttacgccaggcgataaaagaaggcaaagccgcagacgtcagttttaaactgcccggcgcgcctttcacctcctggttaacgctgctgtttttattaagcgtgctggtactcatggcgtttgactacccgaatggaacttacactatcgcctcgttgccgctgatcgctattctgctggtcgccggctggtttggcgtgcgacgtcgcgtggcggagatccatcgcactgcgccagtgacggcggattcgacagagagtgtcgtattgaaagaagaagcagcgacataa

SEQ ID NO: 9032 - protein, 497 aa, Salmonella enterica subsp. enterica serovar Typhi
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQTMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 9033 - DNA, 1377 bp, Listeria monocytogenes
  CDS (1)..(1377)
atggaagagcaaaaagaagaattgcaaagagggctgaaaaatagacacattcagttaatcgcgattggcggagcaattggtacagggctttttctaggagcagggaagtcaattcatttggcaggtccatctatcatgttagtttacttaattattggggctattttattctttgttatgagagctttgggtgaattattaatacataacccaacaacaggatcttttacagaatttgcagagcaatttattggaccgtgggctggctttattacgggctggacatattggttctgctggattgtgactggcattgcggaaattacggcagttggcatgtacgtaaaattttgggtgccagatttaccgcaatggattccagcacttgcatgtgttttgatacttctattgtttaacttggcaaccgttaaagcttttggtgaaatcgaattttggtttgcgattattaaagtggttgtcattattgccttaattgttattggatttgtactcgtgtttattggttacaaacatggcactagtacagcatcattttctaatttagtagattatggtggctttttcccaaatggaattgccgggttcttattagcatttcaaatggcgacattttcttttgtcggaattgaacttgttggggttaccgcaggagaagcggatgatccagagcggacccttccaaaagcaattaacaatattccgattcggattttaattttttatattggcgcactactcgtattaatgtcgatttatccgtggagcaatattgatccaaacacaagcccattcgttagcgtctttacgatgattgggattccagcagctgccggaattattaactttgtggttttaacggctgctatgtcttcctgtaatagtgggattttcagtacgagccggatgctttatactctttctgcagaaggaaaagcaccgaaaaaaatgcatcatttgagctctaatggggttccggcaacagcgttaatcacatctacagcatgtttacttattggtgtgtttttaaattatttcttaccggaacaagtatttatattagtaacaagtatcgcgacgatttgctttatctgggtttggggagttattctagtggctcatttacgttttcgtcataaacatccggaaatctcagaaaaaagtaaattcaaaatgccattatctcctttaatgaactgggttagcttaattttcttcggaggattactagttatccttggttttgcagcagatacaagaatcgcgctctttgttacaccagtatggttcttgattttaggtatagcttatcagattttaaaagcttccaatcgaaagacaaaaattcgacataattaa

SEQ ID NO: 9034 - protein, 458 aa, Listeria monocytogenes
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEISEKSKFKMPLSPLMNWVSLIFFGGLLVILGFAADTRIALFVTPVWFLILGIAYQILKASNRKTKIRHN

SEQ ID NO: 9035 - DNA, 1494 bp, Brucella melitensis
  CDS (1)..(1494)
atgtgcctgaaacgacatataggagagggtgcagctacgcgcattcgcgcgcagtgtgattatgcgtttaccaacataagaggcgcttgcatgaatactatatcaaagccttccgttgatttgcaccgggaggaggaacctcatcttgcacgtaatctatccaatcgacacctccagctgatcgccatcggcggcacgatcggcaccggccttttcatggggtcgggcaaagccgtttcgctggcggggccttcgatcctgctcatctatgcgatcaccggcttcatgctgtttttcgtcatgcgcgcgctgggcgaaattctgctttccaacctgcaatatcgctccttcgcggacttcgcgggtgactatctggggccatgcgcacaatttttcaccggctggacctactggctatgctggatcgtgacggccgtggccgaagtcgtggccgttcccggctatgtctcattctggtttcctcatctggcgccgtggatcccggccctcggcctcatcacaatactgctgatactgaatctgccgaccgtgcgcaattttggtgaaatcgaattctggttcgccctcatcaaaattatcaccattatcgggctgattattactggcatatacatgctcatgacgggctttgtcttgcccaatggcacccaggcatcaattgcccatctgtggaaccatggcgggttcttccccaatggttctcttggctttatcgccgggttccagatatcggtttttgctttcgtcggtatcgaactcgtgggcacggctgctgcggaggccgaaaacccgatgcgaaacctgccgaaggcgatcaataatatcccgatccgtatcgttcttttttatattggcgcgctgtttgtcatcatcaccgtcactccgtggaatcaggtggacccgaattcaagtcccttcgtggccatgttctcgctcgccggtatcggcatagcagcccatttcataaattttgtcgttctgacttcggcatcgtcgagttcaaattccggcatctactcgacctcgcgcatggtctacggccttgccactgtcgggcttgcaccgaaagccttcagtaaactgagcaatcgcaaggtgccggtccacgcgctaatcttctcttgcatattcctgctgtcgagcgtggttctgctttatgcaggccagagcatgatccaggtcttcacactcgtcacgacgatttcggcgctcctgttcattttcatctggtcgattatcctggtgtcttacctgcaatatcgccgcaagcaccccgaacggcatgaaaaatccaccttcaagatgcccggtggacgtgcatctgtcgttatggtcttcattttctttgccttcgtcctttgggcgctgacacaggaaccggatacgttagccgcgatgaaagtcacgccattgtggttcgtgcttctgggcattgcctattgggtcatgaaattaaagcaaaagcagagctaa

SEQ ID NO: 9036 - protein, 497 aa, Brucella melitensis
MCLKRHIGEGAATRIRAQCDYAFTNIRGACMNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVPGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGGRASVVMVFIFFAFVLWALTQEPDTLAAMKVTPLWFVLLGIAYWVMKLKQKQS

SEQ ID NO: 9037 - DNA, 1392 bp, Yersinia pestis
  CDS (1)..(1392)
atggcagacaacgcagagaaaaaaggattacaccgtgggctggaagctcggcatatcgaactgatagcgttgggcggtaccattggtgtcgggttatttatggggtcagcaagcacgttgaaatgggcagggccgtcagtattactggcttatatcattgcgggcttatttgtattcttcattatgcgcgcaatgggggaaatgctgtatctggagcccgtggctggatccttcgcagtctatgcgcataagtatctcagtccctattttggctatctgacggcttggggctactggtttatgtggattgcggtggggatatctgaaattaccgccattggcgtctatgttcagttttggttcccagaaatcccgcaatggctaccggctatcgctggggtggcgattgtggcattagcgaatctggctgcggtcaaattgtatggcgagctagagttttggtttgccatgatcaaggtcacgacgatcattgtgatgattttggttggcttaggcgtgatattttttggcttcggtaatcacggccagccgattggcttcgataacctgaccgcccatggcggtttctttgccggggggtggaaaggcttcctgtttgcgctgtgtattgtggtcgcgtcttaccaaggtgttgaactggtcggtattacggcgggagaagccagaaatccacaggtgacgttaagaagagcgatcaacaacatcttatggcgaattttgattttctacgtcggtgcaatatttgtcattgtcaccatttttccctggaatgggattggtacagagggtagccccttcgtactgaccttcgccaaaataggaatagtggccgcggcgggtattattaacttcgtgatactgaccgccgctctctcaggttgtaacagtggtatgtatagcggcgggcgtatgttgtatgccttggcaaaaaatcgtcagctaccggccggcctgaccaaactgtcggctagcggtgtaccggtgtactgcattgcgatcaccatcctgtgtctactggtggggtcgagcctgaattacattattcccaacccgcagcaagtgtttgtttatgtctacagtgccagcgtgttacctggcatggtgccgtggtttgtggtcttggtctgtcagttacgttttcggcaggtacataaagctgccctacagcagcacccgtttaaatctatcctattcccctatgtgaactacctcaccatcgcattcctgatttgtgtattagtgggaatggggataaacccagatactcgcttatcattactggttggggcaatttttctggcattagtgacgggatgctattttgtgctggggatgcataaacccaaggccatggaagcggaacgcctataa

SEQ ID NO: 9038 - protein, 463 aa, Yersinia pestis
MADNAEKKGLHRGLEARHIELIALGGTIGVGLFMGSASTLKWAGPSVLLAYIIAGLFVFFIMRAMGEMLYLEPVAGSFAVYAHKYLSPYFGYLTAWGYWFMWIAVGISEITAIGVYVQFWFPEIPQWLPAIAGVAIVALANLAAVKLYGELEFWFAMIKVTTIIVMILVGLGVIFFGFGNHGQPIGFDNLTAHGGFFAGGWKGFLFALCIVVASYQGVELVGITAGEARNPQVTLRRAINNILWRILIFYVGAIFVIVTIFPWNGIGTEGSPFVLTFAKIGIVAAAGIINFVILTAALSGCNSGMYSGGRMLYALAKNRQLPAGLTKLSASGVPVYCIAITILCLLVGSSLNYIIPNPQQVFVYVYSASVLPGMVPWFVVLVCQLRFRQVHKAALQQHPFKSILFPYVNYLTIAFLICVLVGMGINPDTRLSLLVGAIFLALVTGCYFVLGMHKPKAMEAERL

SEQ ID NO: 9039 - DNA, 1404 bp, Salmonella enterica subsp. enterica serovar Typhi
  CDS (1)..(1404)
atggtagatcaggtaaaagtcgcagccgacgaacaggctccggctgaacagtcgctacggcgcaatcttacaaaccgtcatatacagcttatcgctattggcggcgctattggtaccggtctgtttatgggatcgggtaaaacgatcagtctcgccggaccgtcgatcatttttgtgtatatgatcatcggttttatgctttttttcgtgatgcgcgccatgggggaattgctgctctcgaatctggaatataaatcgtttagcgattttgcttccgacctgcttggcccctgggcgggatatttcaccggctggacgtactggttttgctgggtagtgaccggtatggctgacgtggtggcgattaccgcctacgcgcagttctggtttcccggcctttccgattgggtcgcctcgctggcggtagtggtcctgctgctaagcctcaacctcgccaccgttaaaatgtttggtgaaatggaattttggtttgctatggtcaaaatcgtcgccatcgtggcgttgattgtggttgggttggtgatgattgcgatgcactttaaatcgccgaccggcgttgaagcgtctttcgcgcatctgtggaatgacggcggctggttcccgaaaggtattagcgggttctttgccggtttccagattgcggtgttcgccttcgtgggcattgagctggtcggtactaccgccgcagaaactaaagatccggaaaaatcgctgccgcgcgcgatcaactcaataccgatccgtatcatcatgttctacgtctttgcgctgattgtcattatgtcggtaacgccgtggagttcagtcgtaccggataagagcccgtttgttgagctgtttgtactggtgggtctgcctgccgccgcgagcgtgatcaactttgttgtgctgacctcggcggcgtcttccgccaacagcggcgtcttctcgaccagccgtatgctgtttggcctggcgcaagaaggcgtggcgccaaaagcgttcgctaagctatcgaaacgcgcggtaccggcgaaaggcctgaccttctcctgtatctgcctgctgggcggcgtggttatgctgatggtcaacccgagcgtgattggcgcattcaccatgatcactacggtttcggccatcctgtttatgtttgtctggaccatcattctgtgttcatacctggtgtaccgcaaaaagcgtccccacctgcatgaaaaatccatctataagatgccgctcggtaagctgatgtgctgggtctgcatggcgttctttgcgttcgtgctggtattgctgacgctggaagatgatacgcgccaggcgctgatcgtgacgccgctgtggtttatcgcgttgggtctgggctggctgttcctgcgtaagaacaaactggctaaatga

SEQ ID NO: 9040 - protein, 467 aa, Salmonella enterica subsp. enterica serovar Typhi
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVVLLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLFLRKNKLAK

SEQ ID NO: 9041 - DNA, 1461 bp, Listeria monocytogenes
  CDS (1)..(1461)
atgaaaaaagaaacacatggcgagattcgtcgtgacttaaaaacaaggcatttgtccatgattgccattggtggttcgatcgggacgggattatttttagcaagtggtaatgcgattcatactgccggacctggtggcgcgttggttgcttatgttgcaatcgggattatggtgtactttttaatgacaagtttaggcgaaatggctacttacatgcctgtatctggttcatttagtacgtatgctagtcgatttgttgacccagctttcgggtttgcacttggttggaattattggtttaactgggcaattacgctagcagtcgatatttccaccgcggcgattattgttcaattttggctaccgaatactcctgcttggctatggagcgcgattttcttaattttgatttttggcttaaatgcgctttcggtaaaagcttacggagaatcagaatattggttttcgattattaaagtggccacggttattattttccttatcgtcggcgtgctaactattgttggaattcttggcggcgaagttattggcttttctaactttacagctggcgatgctccgtttaaaggtggtttttttgccatcttaggtaccttcttaattgctggattttctttccaagggactgaaatggttggtattgcggcaggtgaaagtgctactccagaaaccagtgtgccaaaagcgattaaacaagtgttctggcggattttgttattttatatttttgcgattttcattattgggatgattattccttatactaacccgaacttacttagtgccgaggcaactgatgtggcaattagcccatttacactcgtatttgaaaaagctggtcttgcatttgcggcttcagtgatgaatgcggttatcctgacttctgttctatctgctggtaattcaggtctttacgcttccaccagaatgctttgggcgatggctcgcgataaaaaagcacctaaattcttgggaaaagtaaaccgtcgtggtattccgatggcagcattaatcgttacgacgattgttggtgccatgacattcattacaacgctaacagaaaatggcacagtaatttatacgtggttactttctgcctctggtttaactggatttatcgcttgggtcggcatcgctatcagtcattaccgtttccgaaaagcatttatcaaacaagggcatgacttaagtgaactaaaatataaagcgaaatttttcccattcggacctattttagcacttgttttatgtattttagtcattgtcggtcaagattacgcggcatttttaaaaccagaatttacgaatccggcttggtggcaaaaaatcggcatttcgtatatcggtcttcccattttcctagttttttggctatcttttaaatttacaaataaaactaaagttattccactggaagactgcaaatttgatcaaaaataa

SEQ ID NO: 9042 - protein, 486 aa, Listeria monocytogenes
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 9043 - DNA, 1401 bp, Salmonella enterica subsp. enterica serovar Typhi
  CDS (1)..(1401)
atggggcaattgtcagaatcacatgcattagggggcgggctgaaatcacgccacgtcaccatgttatcgatcgccggcgtcatcggcgccagcctgtttgtcggttccagcgtggcgattgcggaggccggccctgcggtactgctggcctatctgttcgcaggacttttagtcgtcatgattatgcgaatgctggctgaaatggccgtcgccacaccggataccggttctttttccacctatgcggataaagcgatcggcccctgggccgggtataccatcggctggttatactggtggttttgggtgctggttattccgctggaggccaatattgccgccattattctgaattcatggataccgggtattccggtgtggctattttcattagtgattacgcttgccttaaccggaagcaatttattgagcgtcaaaaattacggtgaattcgaattctggctggcgctatctaaagtaattgccattctggcgtttatcgcgctgggcgcggcggcgattagcggtttttatccgtatgccgaggtaagcggtatttcccggctctgggatcacggcggttttatgcctaacggcttcggtgcggtgttaagcgccatgttgatcaccatgttctcttttatgggcgcggaaatcgtcactattgctgccgcggaatccgatacgccggataaacatatcgtacgcgccaccaattctgttatctggcgaatttccatcttttacctgtgttccatttttgtggtagtggcgctgatcccgtggaatatgccgggtctgaaaagcgtaggttcgtaccgttcggtactggagctgcttcatattccgcacgcaaaattcattatggactgcgtgattttattgtcggtgaccagttgtctgaactccgcattatataccgcctcccggatgctctattcccttagccgccgcggcgatgcgcctgcgataatgggaaaaactaaccgtagcaaaacgccctgggtggcggttctcctctctaccggcgcggcctttttaaccgttatcgtcaattattacgccccggcaaaagtgtttaaatttcttatcgacagttccggcgccatcgcgctgctggtctatctggtgattgcgatttcgcaattgcggatgcgtaaaattctgctggcgcagggcggagaaattaagttgaaaatgtggctttatccgtggctcacctggctggttatcggctttatctgctttgttctggtggtgatgctatttcgaccggcacagcaactagaagtcatttcaacggggctgttagggctgggcataataggtactgtccctattatgtctcgctggaaaaaactgataaggtggcaaaaagcccccctgcaaaacctacgttag

SEQ ID NO: 9044 - protein, 466 aa, Salmonella enterica subsp. enterica serovar Typhi
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALSKVIAILAFIALGAAAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 9045 - DNA, 1512 bp, Yersinia pestis
  CDS (1)..(1512)
atgactcagcaaaatactaaaatcccagcgcagcagggtgcacagcgcttacgccgggagcttaaatcgcggcatttagccatgattgctatcggtggttctattggtaccggtttatttgttgcctctggtgcaacggtatcgcaagccggtccagggggggcattgctctcctacgcattgattggcttgatggtttacttcctgatgaccagcttgggagaattggctgcgttcatgccagtttcaggctcattctctacttatggttctaaatatgtcgaggaaggctttggctttgccctaggttggaactactggtacaactgggcggtaaccatcgcagttgacttggtagccgcacagttagtgatgaactactggttcccggacgcgcccggttggatctggagtgctttattcctgggcctgatgttcttactgaactacatctcagtgaaaggtttcggtgaagcggaatattggttctcgctgattaaagtgacaaccgtggttatcttcatcatcgttggtgtcatgatgatcaccggtatcatgaaagggggcgaaacggcgggttggcataactggactatcggtgatgcaccatttgctggtggtttctctgccatgattggggtggccatgatcgtcggcttctccttccaagggactgaattgattggtattgcggctggggaatccaaagatccaggcaaaaatattccaaaggcaattcgcaaagtgttctggcgtattctgttgttctatatcttcgctattctgattattagcctgattattccgtataccgatcccagtttgttacgcaacgatgtgaaagatatcagcgtcagcccgttcacactggtattccagaatgcgggtctgttatcagcagcggcagtgatgaatgcggttattttgaccgctgttttatcggcgggtaactcggggatgtatgcctcgacccgtatgctgtttaccttagcctctgaaggcaaagcaccgcgtattttcgccaagttatctaagggcggtgtccctcgtaatgcgctgtatgccacgacagtcgttgcaggtttgtgcttcctgagctccatgtttggtaaccaaactgtgtatttgtggttactgaatacctcggggatgactgggtttatcgcctggttgggtattgccatcagccactaccgcttccgtcggggctatatgatgcagggccgtgacttgaacgacttaccgtatcagtctggtttcttccctctggggccaatttttgccttcgtcctgtgtctaatcatcacgttaggccagaattatcaggcattcctgcaagaccgtattgattggtatggcgtgacggcaacctatattggtattccattgttcctggtgatttggtttggctataagctcagccgtggtacccgggtagtgaaataccaagagatggaattcccaaaatggcgtgatgagagtgaagagcatcagaaaccgacaagtcggtga

SEQ ID NO: 9046 - protein, 503 aa, Yersinia pestis
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 9047 - DNA, 1425 bp, Yersinia pestis
  CDS (1)..(1425)
atgggaaagatggtagaccaatccaaaatagtggcagagccgttacaagaacctgaagaacacctccaacgaagcctctccaatcggcatatccaactcatcgccattggcggtgccataggtaccgggttgtttatgggatcgggcaaaaccatcagccttgccgggccgtcgatcattttcgtctatatgatcattggttttatgttgtttttcgtgatgcgggcaatgggtgaactgttgctatcgaatctgaactataaatcattcagtgatttctccgctgacttacttggcccttgggctggttttttcaccggttggacttactggttttgttgggtcatcaccggtattgctgatgtagtggccatcaccgcttatgcacagttctggttccctgatttctctcaatgggttgcctcgctattagtcgttttactgttgttgtcactgaacttggccacagtaaaaatgtttggtgagatggagttctggtttgccatgattaaaatcgtggctatcgtggcgctaatttttgctggcctaaccatggtcttagtcagctatcagtcaccatctggtaccaccgcttcatttacgcatttatggagtgacggaggtatgttcccgaaagggatcagtggattctttgctggcttccaaattgccgtttttgcctttgtaggtattgaactggttgggaccacagcggcagaaaccaaagacccagaggtggttttaccacgagccattaactccattccgattcgcataatcatgttttatgttttctcattaattatgattatgtcggtaacgccgtggagttcagtcgtcgcggataaaagcccgtttgttgagttattcgtcttggtcgggctgcccgcagcggccagtgtcattaactttgtggtattaacctctgcggcctcctcggccaacagtggcgtgttctccaccagcaggatgttgttcgggctggcgaaagaaggcaatgcacctaagcaatttggcaagctatcacgccgttcggttcctgccactggcctgacattctcttgtatctgtctgttaggcggggtggtgctgatttatcttatcccgaacgtgatgacggtctttaccttggttaccactgtttcggccattctgtttatgttcgtctggaccatcatcctttgctcttatttggtgtatcgcaaaagacgcccagcactgcataaaaaatccatctacaaaatgccagccggtatttttatgtcatgggtttgtatggcgtttttcgcctttgttttggtactgctgacattggaaagtgatacccgtcaggcgttaattgttacaccgctatggtttgtcattttgactgccagctatatcttcctgaaaaaacgcagagcccgtttatataacagtaaataa

SEQ ID NO: 9048 - protein, 474 aa, Yersinia pestis
MGKMVDQSKIVAEPLQEPEEHLQRSLSNRHIQLIAIGGAIGTGLFMGSGKTISLAGPSIIFVYMIIGFMLFFVMRAMGELLLSNLNYKSFSDFSADLLGPWAGFFTGWTYWFCWVITGIADVVAITAYAQFWFPDFSQWVASLLVVLLLLSLNLATVKMFGEMEFWFAMIKIVAIVALIFAGLTMVLVSYQSPSGTTASFTHLWSDGGMFPKGISGFFAGFQIAVFAFVGIELVGTTAAETKDPEVVLPRAINSIPIRIIMFYVFSLIMIMSVTPWSSVVADKSPFVELFVLVGLPAAASVINFVVLTSAASSANSGVFSTSRMLFGLAKEGNAPKQFGKLSRRSVPATGLTFSCICLLGGVVLIYLIPNVMTVFTLVTTVSAILFMFVWTIILCSYLVYRKRRPALHKKSIYKMPAGIFMSWVCMAFFAFVLVLLTLESDTRQALIVTPLWFVILTASYIFLKKRRARLYNSK

SEQ ID NO: 9049 - DNA, 1470 bp, Salmonella enterica subsp. enterica serovar Typhi
  CDS (1)..(1470)
atgggttccaaaactaaaaccacagaagcgcccgcgctacgtcgcgaattaaaggcgcgtcacctgacgatgattgccattggcggctccatcgggacaggtcttttcgttgcatctggtgcgacaatttctctggcggggccaggcggcgcgctgttttcttatattctgattggtttgatggtctacttcctgatgaccagtcttggcgagctggcggcctatatgccggtatctggctcgtttgcgacatatggtcagaactatgtggaagaaggctttggtttcgcgctgggctggaactactggtacaactgggcggtgactatcgctgttgacctggttgccgcacaattggtgatgggctggtggttcccggacacgccgggctggatctggagcgcgctattcctctgcgtcattttcttgctgaactacatttctgtacgcggttttggcgaggcggagtactggttctcgttaattaaagtcgcgaccgttattatcttcatcatcgttggcgtagcgatgattatcggcatctttaaaggtgtcgagccggtcggctggagcaactggacgacgggcgatgcgcctttcgctggcggttttgcggcaatgattggcgtcgcgatgatcgtgggcttctctttccagggaactgagctgattggtattgccgccggggaatctgaaaacccggagaagaatattccgcgcgcggtgcgtcaggtgttctggcgtattctgctgttttatgttttcgcgattttgattatcagcctgatcattccttataccgatccaaacctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtaaggccccgcgtatttttgcgaaattgtcccgcggcggcgtaccgcgcaatgcgctttatgccaccaccgtgattgccggtctttgctttttgacctcaatgttcggcaaccagacggtctatctgtggctgttgaacacctccggtatgacgggcttcatcgcctggctggggattgccattagccattatcgcttccgtcgcggttacgtgttacaagggtatgatgtgaatgatttgccgtaccgttccgggttcttcccgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggcacgcatttcgtgcgctatagcgaaatgcacttcccggaacgcgttaaaaagtaa

SEQ ID NO: 9050 - protein, 489 aa, Salmonella enterica subsp. enterica serovar Typhi
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 9051 - DNA, 1392 bp, Yersinia pestis
  CDS (1)..(1392)
atggaattaccagttaaaaataagcttaaacgtggcctgacgacacgtcatattcgttttattgcattgggttcagcgatagggactggcctattctatggttcggctgatgcgataagaatggccggaccaagcgtgttgttggcatacctgattggtggtgtggtggcatttgtcatcatgcgtgctttgggtgagatgtcggtcaataacccacaagccagctctttctctcgttatgcgcaagattgtcttgggccgatggcaggttatatcaccggctggacgtattgttttgagatcttgattgtggctattgctgatgtgacagctttcggtatctatatggggctctggttcccagatgttgctcattgggtatgggtgctgagtgttgtcttgatcatcggcgcggtcaatatgatgagtgtgaaagtcttcggtgagcttgagttctggttctcgtttttcaaagttgccaccattatcatcatgattttagccggtatcggtatcattgtttggggtattggtaacggtggtcagccaacgggtatccataatttatggactaacggtggcttcttcagtaatggctttgttggcatgctcctgtcattacaattggtgatgtttgcctatggcggtattgagattattggtattactgccggtgaagccgaggatccgaaaaaatcgattccgaaagcaatcaactcagtaccatggcgtattttagtcttttacgtcgggaccctgtttgtgattatgtccatttacccatggaatcaagtgggcacgaacggtagtccgttcgttctgaccttccagcatatggggatcactattgctgccggtattttgaactttgtggttatcaccgcttctgtatctgcaattaacagcgatgtgtttggtgtcgggcgtatgctgaatgggatggcagaacaaggccatgcaccaaaagcttttactgctatttctaaacgcggtgtgccgtgggtcacggtgctggtgatgatgtgtgccatgctaattgcggtttatctgaactacatcatgccggaaaatgttttcttggttattgcgtcattagcgacgtttgctactgtctgggtctggatcatgatcctattctctcagattgctttccgccgttcactgagtaaagatcaggttaaagcactggatttcccactgcgtggtggaacctttacttcggtgctagccatcattttcctggtatttattatcggtcttattggttggttccctacgactcgaatctcactgtatgtcggattagtgtggatcgtgctgttgctggtggggtattactttaaggtcaagtatcagaaaaaacaggctacgctgatcaagaatgctgattaa

SEQ ID NO: 9052 - protein, 463 aa, Yersinia pestis
MELPVKNKLKRGLTTRHIRFIALGSAIGTGLFYGSADAIRMAGPSVLLAYLIGGVVAFVIMRALGEMSVNNPQASSFSRYAQDCLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 9053 - DNA, 1395 bp, Salmonella enterica subsp. enterica serovar Typhi
  CDS (1)..(1395)
atgaaaaacgcgtcaactgcatccggcgccagcgtgtcggatgccgcgtcgaagaatgaaccgacgcttcaacgggggttgcaaaaccgccatattcagctaatcgccctgggcggcgccattggcaccggactgtttctgggcatcggcccggcgattcaaatggcggggccggctgttttgttgggctatggcgttgccgggattatcgcttttctcattatgcgccagttgggtgaaatggtcgtggaagagccggtttccggatcgtttgcccacttcgcctggaaatattgggggccgtttgcgggctttttgtcgggctggaactattgggtcatgtttgtgctggtcgggatggcggagctgaccgcggcgggcatctatatgcagtactggctgcctgacgtaccaacatgggtatgggcggcggtgttttttattatcattaatgccgtgaatctggtgaacgttcgtctgtatggcgaaacggaattctggttcgcgctcattaaagtgctggcgattatcggcatgataggttttggtctgtggctgctgttctccggccacggcggcgaacatgccagcattgataacctctggcgttataacggtttcttcgctaccggttggcatggtttgcttctgtcgctggcggtgattatgttttcttttggcggactggagctgatcggcattactgcggcggaagcgcgcgatccgcaaaaaagcatcccgaaagcggtgaatcaggtggtataccgtattttgctgttctacatcggttcgctggtggtgttgctggcgctctatccatgggtagaggtgaaatccaatagcagcccttttgtgatgatcttccataacctggacagtaatgtggtggcttcggcgctgaatttcgttatcctggtcgcgtcgctttcggtgtataacagcggcgtttattcgaatagccgaatgctgttcggcctgtccgtacaaggcaacgcgccgaaatttttaactcgcgtcagccatcgcggcgtgccggtgaactcgctgatgctgtccggagcgattacctcgctggtggtgctgatcaactatctgttgccgcaaaaagcgtttagcctgttgatggcgctggttgtcgcgacgctattgctaaactggataatgatctgtctcgcgcatttacgttttcgcgcggcgatgcgtcgtaaagggcgcgagacgcaatttaaggcgctgttctatcccgccggaaactatttgtgcattgcgtttctggcgctgattctggtgttaatgtgtacgatggacgatatgcgattgtcggcgattttgctgccggtatggattgtatttctgtttatcgcgtttaccgttttgcgccgtaaggctcattaa

SEQ ID NO: 9054 - protein, 464 aa, Salmonella enterica subsp. enterica serovar Typhi
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAVFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLMLSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 9055 - DNA, 1374 bp, Escherichia coli
  CDS (1)..(1374)
atggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtattcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgatgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaagcgtcgccacgatcgtcagctggctgaaaaccaataa

SEQ ID NO: 9056 - protein, 457 aa, Escherichia coli
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 9057 - DNA, 1380 bp, Bacillus subtilis
  CDS (1)..(1380)
atgataggcaattctagcaaagacaattttggccagcaacagaaattgtctagaggccttaaaaacaggcatatacaattaatggcgattggaggtgcaatcggtacaggtttatttttaggttcaggtaaatccatccattttgcaggaccatccattttatttgcttacttgatcaccggcgtattttgctttttcattatccgttcgctcggagaactgctcttatcaaatgcgggataccactcttttgttgattttgtaagggactatttaggaaacatggcagcatttatcactgggtggacctactggttctgttggatttccctcgcgatggctgatttaacggcggtcggcatttatacgcaatattggcttcccgatgtgcctcaatggctgccgggtcttcttgcgcttattatcctgctgatcatgaaccttgccaccgttaaacttttcggagaattagaattttggtttgcattgatcaaagtcattgccatactggctctgatcgtaactggtattctcctgattgcgaaaggtttttccgcagcttccggccctgccagcctcaacaacctttggagccacggcggcatgttcccaaatggatggcatgggtttatcctatctttccaaatggtcgtcttcgctttcgtgggtattgaacttgttggactgacagcaggtgaaacagaaaatccccaaaaagtgatccctaaagccatcaatcaaattcctgtccggattttacttttttatgttggcgcacttttcgtgattatgtgtatctatccttggaatgtgttgaatccaaacgaaagcccatttgttcaggtcttctctgcagtaggcatcgttgtggctgccagtttgatcaattttgttgtattaacatcagccgcatcagctgcaaatagcgctttattcagcacaagccgaatggtctattcacttgcaaaggatcatcacgcacctggactattaaagaaattaacttcttctaacgtgccaagcaatgcgctcttcttttcatccatcgccattctgattggcgttagtctgaattatttaatgcccgagcaagtcttcacgctgattacaagtgtttcaacaatatgcttcatttttatttggggcatcacggtgatttgccatttgaaatatcgaaaaacaaggcagcatgaagcgaaagcaaacaaatttaaaatgcctttttacccattatccaactatttaacacttgcatttctcgcgttcattcttgtcatattggcactggcgaatgatacacgtattgctttgtttgtcaccccggtctggtttgttttattgattattttgtataaggtgcaaacccagcagaggacataa

SEQ ID NO: 9058 - protein, 459 aa, Bacillus subtilis
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 9059 - DNA, 1410 bp, Pseudomonas aeruginosa
  CDS (1)..(1410)
atggatggtcaacatctgcaccagggcgagctgaagcgtggcctgaagaatcgccacatccagttgatcgcgctgggcggggcgatcggcaccgggctgttcctcggctcggcgggcgtcatcaagacggccggcccgtcgatgatcctcggttacgccattggcggcttcatcgccttcctgatcatgcgccagctcggcgagatgatcgtcgaggagccggtggccggctccttcagtcacttcgcacacaagtactggggcggattcgccggtttcctttccggctggaactactgggtgctgtacatcctggtgggcatgtcggagctgaccgcggtgggcaagtacatccagtattggtggccggacgtgccgacctgggcgacggcggcggcgttcttcgtgctgatcaacgcgatcaacctggccaacgtgaaagccttcggcgagaccgagttctggttcgcgatcatcaaggtagcggcgatcgtcggcatgatcctgctcggtatctacctgctggtcggcggcggtggcggaccgcaagcctcggtgagcaacctgtgggaccgcggcggcttcttccccaacggtctcagcggcctggtgatgaccctggcgatcatcatgttctccttcggggggctggagctggtgggtatcaccgccgccgaggcgtccgagccgcggaaggtgatcccgaaggcgatcaaccaggtgatctaccggatcctgatcttctatatcggcgccctggcggtgctgctctcgctgtatccatgggaccagttggtggagaccatcaacgcttccggcgacgactacagcggcagcccgttcgtgcagatcttctcgttgatcggcagcggcaccgcggccaacatcctcaacttcgtagtactcaccgcggcattgtcggtctacaacagcggcgtctactgcaacagccggatgctctacggcctggccgcccagggtgacgcgccgaaggtgctgatgtcggtggaccgccggggcgtgccggtgctgtcgatcctggtctcggcgctgatcaccttcctctgcgtgatcgtcaactacgtattgccgcacaaggcgctggagctgctgatgtcgctggtggtggcggcgctggtgatcaactgggcgatgatcagcctgtcgcacctgaagttccgcgcggcgatgaagcgccagggcgtggacaccttcttcaaggcgctctggtcgccgttcagcaactacctgtgcctggccttcgtgttgttcatccttggcatcatgctgatgatccccgggatcaacatctcggtgtacgccattccattctggctgctgctgatgtggttgtgctaccgggtcaagctgtcgctggcggaaaggcgcgggctcggccagcaggcctga

SEQ ID NO: 9060 - protein, 469 aa, Pseudomonas aeruginosa
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIVGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVLFILGIMLMIPGINISVYAIPFWLLLMWLCYRVKLSLAERRGLGQQA

SEQ ID NO: 9061 - DNA, 1428 bp, Pseudomonas aeruginosa
  CDS (1)..(1428)
atgtccaaagtcgtactggcttcacaactgccgaacaagcgcaacgcctcgctcgcgcccggcctgaaacaacgccacgtcaccatgctgtcgatcgccggggtgatcggcgccggcctgttcgtcggctccggccatgccatcgccgccgccggcccggccgccctgctcgcctacctgatcgccggcaccctggtggtgctggtcatgcgcatgctcggcgaaatggcggtcgcctcccccgataccggttccttctccacctacgccgaccgctccatcggccgctgggccggtttcaccatcggctggctctactggtggttctgggtgctggtgatcccactcgaagcgatcgccgccgcggccatcctcaacgcctggttcccggccatcgacacctggatcttcgccctcgcggtgaccttcctgctcaccgtcaccaacctcttcagcgtggcccgctacggcgagttcgagttctggttcgcgctgctcaaggtgatcgccatcatcgccttcatcgtgctcggcgcggtggccatcgtcggcggcctgccggagcgtgaggtcagcggcctgtccagcctgatggcgagccacggcggcttcgtgccgaacggctacggcgcggtgctcggcgccctgctgacgaccatgttcagcttcatgggcaccgagatcgtcaccatcgccgccgccgagtccaaggacccggcgaagcagatcacccgcgccaccaactcggtgatctggcggatcggcctgttctacctggtgtcgatcttcattgtgatctccatcgtgccgtggaacgacccgctgctgatccaggtcggctcctaccagcgcgccctggagctgctggacatcccgcacgccaagctgatcgtcgacctggtggtactggtcgccgtggccagttgcctgaactcggcgatctacacctcgtcgcggatggtcttctccctggccaagcgcggcgacgccccgagcgtgctcaagctgaccaacaccgcccacgtaccacgcccggcggtgctggccagcaccgcggtgggcttcctcaccaccatcgtcaactacttcgcaccggagaaggtcttcaccttcctcctcgccagctccggcgccgtggcgctactggtgtacctggtgatcgccgtggcccagttgcgcatgcgcaagcaattgcaggccagcggccagcccatcgagttccgtatgtggctatatccctggctgacctgggcggtgatcctgttcatcgtcgccgcgctgagcatcatgctgatcatgccggagcaccgacacgaggtgttcgccaccgctctgctgacgatcttcaccgtctgcctcgggctgctcaacgcgcgacgcaagccgcgcctcggcgaggactacgccgggaagacggcgcgggtctga

SEQ ID NO: 9062 - protein, 475 aa, Pseudomonas aeruginosa
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 9063 - DNA, 1470 bp, Clostridium acetobutylicum
  CDS (1)..(1470)
atgtctgcagagttagagaaagataaaaatggtgaattaaagagaagtttaaaaacacgacatatgaatatgattgccattggaggatcaattggtacaggtttgttttttactagtggtaatacaataagtacggcgggtccaggaggtgctattgcagcctatgctattatgggggtgcttgtgtattttttaatgacatcgctgggagaaatggctacaatgataccaaacgctggttcatttgaaacctatgcctcaaagtttgtagatccagcattaggttttgcattaggttggaactactggtttaactgggcgataactgttgcagcagaattagttgcaggcggacttgttgttaagttttggttgccaaatacagggacaactatttggagtataggatttttagttattttatttggtctgaatttgctatctgcaaaagcatatggtgaaggagaatactggttttcaagtataaaagtcgtaacaattatagtatttcttattatgggagtgcttattatatttggaataatgggcggacatggagtaggttttagcaattgggtgcttaaggatggaaaagggaattcagcaccatttgtaggtggaggaatggctatattaatgagctttttaactgccggattttcttttgctggcacagaggtagtaggtttagctgctggtgaagctgaaaatccggaaaaggatgtaccaaaagcaataaattcagttttttggagaatacttattttttatattggtgcaattatagttattggttttatcattccttttaatgattctaatttgcttaaaaatggtgtatcagatatagcgtatagtccatttactatagtgtttaaaagatctggaattgctcttgcagcgtcaataatgaatgcagttatactaacttctgtgctttcctgtggtaattcaggtctttatgcaggttcacgtatgatgtatgctatggctaaagaaggaaaagcaccaaagatatttggtaaattaaataaaagtggtgtaccactaaatgctcttatttttacttctgttattgcatcaacagcgttttttgcatcgcttattggtgacggtaagatatattcaattctttacaatttatcgggtataacaacatttataacatggcttggaatagcaatttgtcattatagatttagaaaagcttatattgctcaaggaaataaaattgaagatttaaagtataaggctttattgtatccatttggtcctatatttgcaatgatactttgtacagtagttttatttggtgctaatatatgggtgtttcaagcaaaaaccttcagttggttcgattttacaactaactatggaagcattcctttatttttatgtttttattttatatataaaaaagtgcataaaacaaggatagtttctttaatggagtgtgatcttaataagtag

SEQ ID NO: 9064 - protein, 489 aa, Clostridium acetobutylicum
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 9065 - DNA, 1410 bp, Bacillus subtilis
  CDS (1)..(1410)
atgaaccagtctcaatcaggattaaaaaaggaattaaagacccgccatatgacaatgatttcgattgccggtgtaatcggagccggcctatttgtaggcagcggtccagtgattcactcgaccggtccgggtgccgttgtttcttacgcgttagccggattattggtgatttttattatgagaatgctcggtgagatgtctgccgtaaacccgacgagcggatcgttttctcaatacgctcacgacgccatcggaccgtgggcaggatttacaatcggctggctgtactggtttttctgggtgatcgtcatagcgatcgaagccattgccggtgctggcattattcaatactggttccatgatattccgctgtggctgacaagtttgatcttgaccattgtgctcaccctgacaaacgtctactccgttaagtctttcggtgagtttgaatattggttctccctcattaaagttgtgactatcattgcttttctaatcgttggttttgcctttatttttggctttgcaccgggcagtgagccagtcggtttttcgaatcttacaggcaaaggcggatttttcccggagggcatcagctccgtattgctcggcattgtcgttgtcatcttctcttttatgggaactgaaatcgttgccattgcagcaggggaaacatccaacccgatcgaatctgtgacaaaagccaccagatccgttgtatggcgcatcatcgtcttttacgtgggctcaatcgccattgtcgtggcgctgttgccatggaattcagcaaatattttagaaagccctttcgtcgctgtacttgagcatataggagtgcccgcagccgcacagattatgaactttatcgtcctcacagccgtactctcttgcctgaattcaggtttgtataccacatccagaatgctgtattcacttgcagaaagaaatgaagcgccgcgccgttttatgaaattgagcaaaaaaggcgttcccgtacaagccattgtggccgggacatttttctcttatatcgcggtcgtaatgaactatttttcaccggataccgtctttttattcttagtcaactcatcaggcgcaatcgctttactcgtctatcttgtcatcgccgtttcccagctgaaaatgcggaaaaaactcgaaaaaacaaacccagaagcactgaagatcaaaatgtggctcttccctttcctaacctacttgaccatcatcgccatttgcggaattttagtgtccatggcgtttattgattccatgagagacgagctgctgctgacaggcgtcatcacgggaatcgttctgatttcttaccttgtgttcagaaaacgcaaggtgagcgagaaagcggctgccaacccagtcacacagcagcaacccgatatcctgccttaa

SEQ ID NO: 9066 - protein, 469 aa, Bacillus subtilis
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 9067 - DNA, 1392 bp, Bacillus subtilis
  CDS (1)..(1392)
atgcaaaaacaaaaacaagagctgcaccgcggactcgaagaaaggcatatttctttaatgtctttaggagctgctataggagtagggttgttcctcggctccgcatcagctattcaattagcagggcctggtattttggtagcgtatgccgcaagcggcctggtcatgttttttattatgagagcgcttggggaaatggccattcaaaaaccggtcgcaggctccttcagcaggtatgcgcgtgattatttgggaccgcttgcaggctatttaacaggttggaactactggtttttatgggttgtcacctgtatggccgaaatcactgctgtcggcatctatatggggttctggtttccggacgtgccaaactggatttgggcgttatcggcactggtcattatgacgggtgttaatttcctggctgtcaaagcttacggcgagctggaattttggttcgcattgattaaaattgttgcaatcttatccatgattgctgtcggtttattgatgattattgcaggagtcggcaatgggggcattgcaaccggaatcagcaatttgtggaacaacggaggatttttccctcatggattaaaaggggttttattgtctcttcaaatggtcatgttcgcctatttagggattgaaatgatcggggtgacggctggcgaagtaaaaaacccgcaaaaatcgttagccaaagcaatcgatacagtattttggcggattttgattttttatgtaggcgctttatttgtcattatgtctatttatccgtggcaggaaattggctctcaaggaagtccatttgttctcacatttcaaaaagtgggcattccatcggccgcaggtatcattaactttgtcgtgttgacagccgcgctgtcttcatgcaacagtggtattttcagcacagggcggatgctgtttaacttggcggaacagaaagaggcgccacaagcatatggtcagctgacgaaaggcggcatcccgggtaaagctgttctggcttcagcgggcgctttattagtcggagtgctgttaaactatgttgtccctgcgaaggtatttacttgggttacaagtattgcgacgttcggagcgatttggacgtgggcaatcattttgctttctcaaataaaatacaggaaaagtttgaagccggaagaaaagaaacaattaaagtacaaaatgcctttatttccgtttacgtcttatgtgtcattggcatttctagcattcgtcgtcattcttatggcttacagccctgatacaagagtagccgtgattatcgggccgatatggtttctcatcttgctggctgtgtactatggaaaagggtttcataaaaaaaatgcggctgctgccagcgaacgaaatatcagctga

SEQ ID NO: 9068 - protein, 463 aa, Bacillus subtilis
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 9069 - DNA, 1407 bp, Pseudomonas aeruginosa
  CDS (1)..(1407)
atgaacgacccccagggcttcgaggccatctcgcgccgcgaacagggcctgcaacggcggctctcggccgcgcagatgagcatgatcgccatcggcggcgccatcggcaccggcctgttcatgggcagcgccttcgccatcggtttcgcaggccccagcgtcctgctcagctacgccatcggcgcgctgatcaccctgctgctgatgggctgcctggcggaaatgaccgtggcccatgccacccccggctcgttcggcgccttcgccgagcactacgtcggcccgctggccgggttcctggtgcgctacgcctactgggcggccatcgtcctggcggtgggcaccgaggtcacggcggtggccatgtacatgaagtactggttcgccggtatcccggaatgggtctggatcatctccttctcgaccctgctgatcggcctgaacgccagcagcgtgaaagccttcggcaacttcgaatactgcttctcgacactgaagatcgccgccatcgtcgccttcatcctgctcggcgcctacctggtgttcggctccgccaacccggcctacggcgtgcacaactacagcgcccacggcggcttcttcccgcacggcctgaaaggcatgtggatcgccgtggtggtgtcgatcttcagttatctcagcgtggagatgatcgcggtcgccgccgccgaggccgaacatccggaacaggcggtgaggtcggcgttccgctcgaccatcgtgcgcctggtggtgttctacctgctgaccctggcgctgatgctcgccatcgtcccctgggaccaggccgggcagagccagagcccgttcgtcacggtgatgcaggcgatcggcctgcccggcgccaccggggtgatgaacttcgtggtgctggtggccgcgctgtcggcgatgaacagccagctctacatcaccacccggatgatgttcagcctgtcgcgcgcggggcacgcgccgaagggcctcggcgaactgagccgccagggcgtgccgctgaacgcgctgctgctgtcgagcgtcggtatcgccctggcgaccctgctcaacctggtctaccccgagcagtccttcaccctgatgatggcggtgtcgatgttcggcgccctcttcacctggctgatgatcttcttcacccacctctgcttccgccgccaccgcgcccgccacggcggcgcgccgctggccttccgcatgcgcctggcgccctggtcgacattgctcggcctggcgctgatggcggcgattctggtcaccaccttcttcaccgaggcgttccgcatgaccctggtcttcggcgtgccgttccttgcgctgctcagcgcactctacctggtcttcgtccgcaagcccggcagggattgtccgatagaacgggcaacgccctag

SEQ ID NO: 9070 - protein, 468 aa, Pseudomonas aeruginosa
MNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAAAEAEHPEQAVRSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 9071 - DNA, 1374 bp, Lactococcus lactis subsp. lactis
  CDS (1)..(1374)
atgaatacaaatcaaaatgaagaaaataagccctcacaacgtggtttaaaaaataggcatattcaacttattgccattgctggaacaattggtacgggattattcctcggtgccggaaaatcgattcacctcaccggcccatcaattatttttgtttatttaataatcggtgcgcttatgtatattctcctaagagctatcggggagatgctttaccaagatcccaatcaacattcctttttaaattttgtgtcacgttatctcggtgaaaaacctggttactttattcagtggtcttatttactggttgttgtttttgtagctatggctgagctaattgctattgggacttatattaatttttggttgccggatttaccaatttggatgacagaagtctttgtattagttcttctaactttattgaatactttaaatccaaaattttttggagaaaccgaattttggtttgggatgattaaaattgtggcgattattggtttgattttaacggcaataatcctcatttttagtcattatcatacaggaactgatactgtaagtgtaactaatatcaccaaaggcttcgagttcttcccaaatgggctttctaatttctttgaaagcttccagatggtcatgtttgcttttgtttcgatggaattcatcggaatgactgcagcagaaacagataatcctagaccaactttgaaaaaagcgattaaccaaattccaattcggattgtcctcttttatgttggggcactgttggcaattatgagtatctaccaatggcgcgatattccggctgataaatcaccatttgttaccattttccaactcattggaattaagtgggcagcggctttagtgaactttgtcgtactaacttctgctgcttcggctttaaactctgccctcttttcaatcactcgtaatctttattctttatcaaaactcaataatgataaaatacttaaaccatttactaaattttcaaaagctggtgtaccagtaaatgctttacttttcacctcattattaattctatttactccattcatctcgatgattcctgcgatttctaattcttttgtctttattacaagtgtcgcaaccaatctttttctagtggtttatctgatgaccttaattacttatcttaaatatcggaaatcaagcgattttgatcctaaagggtttgttttacctgcagcccacatctttattccattagccattgctggatttgtcttaatctttatttcactattctgctttaaagatacaattgttccggccattggttctgtgatttgggttcttatttttggactatttactttctttaaaaaaataaaaacagctgaataa

SEQ ID NO: 9072 - protein, 457 aa, Lactococcus lactis subsp. lactis
MNTNQNEENKPSQRGLKNRHIQLIAIAGTIGTGLFLGAGKSIHLTGPSIIFVYLIIGALMYILLRAIGEMLYQDPNQHSFLNFVSRYLGEKPGYFIQWSYLLVVVFVAMAELIAIGTYINFWLPDLPIWMTEVFVLVLLTLLNTLNPKFFGETEFWFGMIKIVAIIGLILTAIILIFSHYHTGTDTVSVTNITKGFEFFPNGLSNFFESFQMVMFAFVSMEFIGMTAAETDNPRPTLKKAINQIPIRIVLFYVGALLAIMSIYQWRDIPADKSPFVTIFQLIGIKWAAALVNFVVLTSAASALNSALFSITRNLYSLSKLNNDKILKPFTKFSKAGVPVNALLFTSLLILFTPFISMIPAISNSFVFITSVATNLFLVVYLMTLITYLKYRKSSDFDPKGFVLPAAHIFIPLAIAGFVLIFISLFCFKDTIVPAIGSVIWVLIFGLFTFFKKIKTAE

SEQ ID NO: 9073 - DNA, 1416 bp, Pseudomonas aeruginosa
  CDS (1)..(1416)
atgtcgtctgtcggcgaacagaaggttcaagacggctccctgaagcgcgagctcggtgagcgacacatccgcctgatggcgctcggcgcctgtatcggcgtcggcctgttcctgggctcggcgaaggccatccagatggccggcccggccatcatgatctcctacatcctcggcggcctggcgatcctggtgatcatgcgcgccctcggcgagatggcggtacacaatccggtggccggttccttcagccagtacgccaaggactacctgggcccgctggcgggcttcatcaccggctggaactactggttcctctggctggtgacctgtgtcgccgaaatcaccgccgtcgccgtctacatgggtatctggttccccgacgtgccgcgctggatctgggccctggcggccctggcgagcatgggcacgatcaacctcatcgcggtgcgtgccttcggcgagttcgagttctggttcgccctgatcaagatcgtcaccatcctggcgatggtggtggtcggcatcggcatgatcgccttcggcttcggcaacgacggcatcgccaccggaatctccaacctctgggcccacggcggcttcatgcccaatggcatccagggcgtgctgatgtcgctgcagatggtgatgttcgcctacctcggggtggaaatgatcggcctcaccgccggcgaagcgcgtaacccgaccaagaccattcccagcgcgatcaactcggtgttctggcgcatcctgctgttctatgtcggctcgctgttcgtgatcatgtcgctctatccgtggaacgagatcggcacccagggtagccccttcgtgatgaccttcgagcgcatgggcatcaagaccgccgccgggatcatcaacttcgtggtgatcaccgccgcgctgtcgtcctgcaatggcggcatcttcagtaccgggcgcatgctctacagcctggcccagcatcgccaggccccggccttcttcggcaaggcctcgcgcagcggcgtaccgcgccgggcgctgatcctgtcgatcctggcgctgctgctgggcgtgttgctgaactacctggtgccggagaaggtattcgtctgggtgacttccatcgccaccttcggcgcgatctggacctgggcgatgatcctgctggcccagttgcgcttccgcaagacgctcagcccggccgagtgcgacaagctgcaataccgcatgtggctgtacccggtcagttcctacctggcgctggcgttcctggtgatggtggtggtgctgatggccttcttcgaggacacccgcatcgccctctacatcggcccgccgttcatcctgctgctgaccgtcctgtactacgccttcaacctggcgccgaaggagcctgccggcaccggctcggtaagccgcgcggcgtcctga

SEQ ID NO: 9074 - protein, 471 aa, Pseudomonas aeruginosa
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPVSSYLALAFLVMVVVLMAFFEDTRIALYIGPPFILLLTVLYYAFNLAPKEPAGTGSVSRAAS

SEQ ID NO: 9075 - DNA, 1380 bp, Lactococcus lactis subsp. lactis
  CDS (1)..(1380)
atggaaaatcttcaagagaaacatgaagctcaacggggcttacagaaccgacatattcaacttattgctattgctggaacgattggtaccggactttttctaggagctgggaaaaccattcaaatgactggtccaagcgttatctttgcttatattcttattgggattgcgatgttctttttcttaagaacaatcggagaaatgctttacaacgaccctagtcagcattcatttttaaattttgtcacaaaatattcaggcgtcaggacaggttacttcactcagtggtcttattggttagttattgtttttgtttgtatctctgaattgacagcaatcggaacttatattcaattttggcttcctcaggttccactttggttgattgaaattgtcatgctagctcttctttttggacttaatactttaaattctcgcttttttggtgaaactgaattttggtttgcgatgattaaagtagcagcaatcattggaatgattgtcactgcgattattttagtagctggtaattttcactatagcactgttttaagcggaaaaaccgttcatgactctgcttcactaagcaacatttttgatggctttcaactcttcccacacggtgcttggaactttgttggtgccttacaaatggttatgtttgcctttacttctatggaatttattggaatgactgcggcagaaacagttaatcctaaaaagagtttaccaaaagcaattaatcaaattccagtacgtattttacttttctatgttggagcacttttggctattatggctattttcaactggcactacattccggctgataaatctccatttgttatggtttttcaacttattggaatcaaatgggcagcggcgctcattaactttgttgtcctgacttctgctgcttcagcgcttaatagttcattattttcagcaacacgaaatatgtactcacttgctcaacagcatgacaaaggaagattaactccttttacaaaactttctaaggcgggaattcctatcaatgccctttatatggcaactgctctctcgcttttggctcctgtcctgactcttattcctcagataaaaaatgctttcgattttgcagcctcttgtacgactaatttatttttagtggtttactttattaccctctacacttattggcaatatcgcaaatctgaagattacaatcctaaaggtttcttgacaccaaaacctcaaattaccgttccctttatcgtagctatctttgcaattgtctttgcttctttgtttttcaatgctgataccttttatccggccttgggagcaattgtctggacaattttctttggactctactcgcactataaaaaaatctaa

SEQ ID NO: 9076 - protein, 459 aa, Lactococcus lactis subsp. lactis
MENLQEKHEAQRGLQNRHIQLIAIAGTIGTGLFLGAGKTIQMTGPSVIFAYILIGIAMFFFLRTIGEMLYNDPSQHSFLNFVTKYSGVRTGYFTQWSYWLVIVFVCISELTAIGTYIQFWLPQVPLWLIEIVMLALLFGLNTLNSRFFGETEFWFAMIKVAAIIGMIVTAIILVAGNFHYSTVLSGKTVHDSASLSNIFDGFQLFPHGAWNFVGALQMVMFAFTSMEFIGMTAAETVNPKKSLPKAINQIPVRILLFYVGALLAIMAIFNWHYIPADKSPFVMVFQLIGIKWAAALINFVVLTSAASALNSSLFSATRNMYSLAQQHDKGRLTPFTKLSKAGIPINALYMATALSLLAPVLTLIPQIKNAFDFAASCTTNLFLVVYFITLYTYWQYRKSEDYNPKGFLTPKPQITVPFIVAIFAIVFASLFFNADTFYPALGAIVWTIFFGLYSHYKKI

SEQ ID NO: 9077 - DNA, 1383 bp, Clostridium acetobutylicum
  CDS (1)..(1383)
atggaaaaaaaagagttgtcacgagggctaaaagcacgtcatattgagctaatagctttaggtggtacaattggggtaggcttgttcatgggatcagctagtacaattaaatgggcaggaccatcagtgctgttagcttacggagtagcaggtatagctatgtacataattatgagaattatgggagaaatgctttatctagaaccattagcaggatcctttgcaaattacgcaaataaatatatatctcctttagctggatatataacagcttggtgttactggtttatgtggatagctgttggtatgtctgaaataacagctataggaatttacgtgaagttttggtttccggctttaccagcttggattccagcattaattggtgtggctattcttgccgctgctaatatggcttcagttaaattttacggtgaatttgaattttggttttctttaattaaggttgtaactattgtagttatgcttatagttggagtgggtttgattttctttggtattggtaatcatggtgtgcctattggatttaaaaatcttacagctcatggaggtttctttgctggtgggttaaaaggttggttgtttgctttatgtatggtaacggcatcatatcaaggagtagagcttattggaattacagcaggagaggcacaggatcctaaaaatacattaagaaaagcaactaaaaatattatttggcgtatactaatcttttacgttggtgctatatttgtaattgtaactatttatccatgggacaagattagtacacttggcagtccatctgttttaacttttgctaaaattggtattgcagcagcggccggtattataaattttgtagtacttacagcagcaatgtccggttgtaacagtggaatttacagctgtggtcgtatgctctatacattagctacaaatggtcaagcacctaaatttttagggaaattaaacaaggatggtgtaccagcaaatggtataagaacaactttagtttgtttacttataggtgtgatattaaactatatatatccaaattcaaaactatttgtttatatctatagtgcaagtgtgcttccaggaatggctccttggtttgtattatgcattagccaaataaaattcaggaaagagcatgcagaagaaatgaagatgcatccttttaaatcaaggctttttccatatgctaattatattgtagtagcatatctttgcttagttttaattggtatgtgctttaattcatcaactcagattcctttgtttattggtgctgtattctgtgctatcgttactatagcatattttgcttttggtatacacaagggtaaggtttcaaaagtagaagaattgcaagaatag

SEQ ID NO: 9078 - protein, 460 aa, Clostridium acetobutylicum
MEKKELSRGLKARHIELIALGGTIGVGLFMGSASTIKWAGPSVLLAYGVAGIAMYIIMRIMGEMLYLEPLAGSFANYANKYISPLAGYITAWCYWFMWIAVGMSEITAIGIYVKFWFPALPAWIPALIGVAILAAANMASVKFYGEFEFWFSLIKVVTIVVMLIVGVGLIFFGIGNHGVPIGFKNLTAHGGFFAGGLKGWLFALCMVTASYQGVELIGITAGEAQDPKNTLRKATKNIIWRILIFYVGAIFVIVTIYPWDKISTLGSPSVLTFAKIGIAAAAGIINFVVLTAAMSGCNSGIYSCGRMLYTLATNGQAPKFLGKLNKDGVPANGIRTTLVCLLIGVILNYIYPNSKLFVYIYSASVLPGMAPWFVLCISQIKFRKEHAEEMKMHPFKSRLFPYANYIVVAYLCLVLIGMCFNSSTQIPLFIGAVFCAIVTIAYFAFGIHKGKVSKVEELQE

SEQ ID NO: 9079 - DNA, 1476 bp, Clostridium acetobutylicum
  CDS (1)..(1476)
atgacgtctaaaaaagaacaaaagaatgagcttaagagaacactgacggcaaggcatatgaatatgatcgcaataggaggctctgttggaactggacttttttttgcaagtggaagtgcaataagcacagcaggaccaggaggagcgcttcttgcatatataatcacgggaattctagtttatgtactaatgatgtcactaggagaaatgtcaacactattacctatttcgggttcttttgaaacctatgctactagatttgtagatccagcacttggatttactcttggctggaactactggttttcttggtccatatgtgtggcatcggaattagttgcaggatcacttatagtgaagttttggtttcctcatactaatacaaccatttggagcataggatttttacttgtaatttttatactaaatattctttctgctaaagcttatggagaaagcgaatattggttttcaagtattaaggtagttactataatcatatttatcatagttggagtacttatgatatttggaattatgggaaatgattcacctggttttaaaaattgggttatatcgggaaatggttcgagagcaccgtttgtaggtggaatagcagcaattataaatgtttttttagttgcaggcttttcgttttcaggtacagaaatagttggacttgcagctggagaaacagaaaatcctgaggaaaacgtcccaaaggcaattaaatctgttttttggcgtatactactattttatatttgtgcaattataataataggctttctagttccttttaatgacaagaatctattaaaaagtggagttaataatatagcatatagtccatttacaatggtatttgcaaagtgtggaatagcttttgcggcaagtgctatgaatgctgtaattttaacctcagtactttcttgcggaaactcaggactttatgtatcatcacgtatgctatattctcttgcaaaagaaggaaaagcacctaagtttttagcaaaggtaaacaagcaaggtgtacctatgaatgcgttatatgcaacaactttagttgcatcctctgcatttttgtcatcacttattggtgaaggaaagatatactatgttttatacaatgcatctggaataacagcattgtttgcatggcttggtataggaatctgtcattacaggtttagaaaagcttatgtagcgcaaggaagagatttaaaggacttgaagtttaaggctaagttttatccttatggtcctattatggcaatagtgttatgcgtagtaataatatttggagctaacatatggatatttcaggctccaaagttcagttggtttgattttataagtaattacatttgtattcctatatttatagcactatatatagcatataaatacattaagaaaactaagctagttccgcttgaggaatgcgattttgaatataacggaaaagataaataa

SEQ ID NO: 9080 - protein, 491 aa, Clostridium acetobutylicum
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 9081 - DNA, 1428 bp, Bacillus subtilis
  CDS (1)..(1428)
atgaatcttcaggagaacagcagccaacagctaaaacgcacaatgaaaagcaggcacctatttatgatctcattgggaggcgtcataggcacaggacttttcctcagtacgggctatacgctacatcaagccggacccggcggtacgatactcgcttatgtaatcggcgggttgatgatgtacctcgtcatgcaatgtctcggcgaattgtcggttgccaatgcggtgaccggctcttttcaaaaatatgctacaacatttatcggtccatctaccggttttatggtcggcatcatgtactggatcaattgggtggtgacggtaggctctgagtttaccgcatccggtattctcatgcagcgctggttccctgacagcagtgtatggatgtggagtgcgatttttgcagcccttctttttatatgcaacgcattttcagttaagttatttgcggaaactgaattttggttttccagcgtaaagattgtcaccattattttatttatcattttaggaggagccgccatgtttggcctgatctctttaaacggaacggcggatgctcctatgttgtcaaacttcacagatcatggcgggttgtttccaaatggctttctcgccgtttttatcgcgatgatatctgtgagcttcgccttttccggtacagagttaatcggcgttacagcaggagaatcagcaaatcctcaaaaggatataccgcgatccatccgtaatgtcgcatggagaaccgtgatttttttcattggcgctgtcttcatattatccgggttgatttcatggaaggacgcaggcgtgattgaaagcccgtttgtcgccgtatttgcggagatcggaattccttacgctgctgatattatgaatttcgtaatattaacagccttgctgtctgtcgccaactcaggcttatatgcttcgacccgtatgatgtggtctttagcaaatgaaaacatgatcagctcccgttttaagaaagtgacatctaaaggcattcctttaaatgccttaatgatcagtatggctgtatcttgtttatctctcgtttccagtatcgtggcccctggaactgtctatgtggtgatggtcgcaattgctggatttgcaggagtcgtggtctggatgagcattgccttgtcccaactcttgtttcgaaagagatttttgaaaaaagggggggatgtaaaagatctgacatttcgcacgccgctttatcctcttatgcctatagccgctctcttattatgttctgcttcttgtatcggtcttgcttttgatcccaatcaaagaatcgcacttttctgcggagttccttgtatcatcctttgctatctcatctaccatttcaaaagaaatgttacaaaagcgaaaaaaatcagccaagaggaatatccagccgatcacatcctataa

SEQ ID NO: 9082 - protein, 475 aa, Bacillus subtilis
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 9083 - DNA, 1362 bp, Staphylococcus aureus
  CDS (1)..(1362)
atggctgaaaaattacaaagggaactgagcaatcgccacatacaattaattgcaattggcggtgcaattggtacaggcttattcttaggtgctggtcaaacgattgcattaaccggcccttcaattctattaacatacatcattataggatttatgttatttatgtttatgcgaggtttaggagaaatcattatacagaatactgaatttaaatctttcgcagatgtaaccaatacatatattgggccttttgcaggatttgttaccggatggacatactggttctgttggattattacaggtatggctgaagtaacggctgtggcaaaatatgttagcttttggttcccagaaattccaaactggataagtgcactattttgtgtactgttattaatgtcattcaacctacttagcgcaagacttttcggagaattagaattttggttctctatcattaaaatagcgacaattattggtttaatagtagttggtttcgtcatgattctatttgcatttaaaactcaattcgggcatgccagtttcacaaatctatatgaacacggcatattcgctaaaggtgcttctggattctttatgtctttccaaatggcactattctcatttgtaggaattgaaatgattggtgttacagctggggaaacaaaagatccagttaaaacaattccaaaagcaattaacagtgtacccattagaattttaatattttacgttggggcgttagcggttatcatgtctattatcccttggcagcaagttgatcctgataacagtccattcgtaaaattattcgcattgatcggaattccgtttgctgcgggcttgattaattttgtagtattaaccgctgctgcttcatcatgtaacagtggtatattctcaaatagccgtatgcttttcggtttatcaagtcaacaacaagcacctccgaacttttctaagacgaataaatatggcgttccacatgttgcaatctttgcttcatcagcattattacttgtggcagcattactaaactatattttcccagatgcgacaaaagtatttacgtatgtgactaccatctctacagtgttatttttagttgtatggggtctgattatcattgcatatatcaattatagtcgtaaaaacccagatctacataaaaatgctacgtacaaactattaggtggcaaatatatgggctacttaatatttgtattcttcatttttgtgttcgggttattatttattaatgttgatacaagacgtgcaatttattttattccgatttggtttatacttttagcatttatgtacttaagatataaacgtatcgctgctaaatcaaataaatag

SEQ ID NO: 9084 - protein, 453 aa, Staphylococcus aureus
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAFKTQFGHASFTNLYEHGIFAKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKNPDLHKNATYKLLGGKYMGYLIFVFFIFVFGLLFINVDTRRAIYFIPIWFILLAFMYLRYKRIAAKSNK

SEQ ID NO: 9085 - DNA, 1368 bp, Clostridium acetobutylicum
  CDS (1)..(1368)
atggatcaaacaaaatcaaaaaatcaaaatttatcaagaggtctaaaaaatcgtcatgttcagctgcttgctataggaggtgcaattggaactggattatttctcggttctggcaggtctattcacttagctggtccatctattttatttgcttacatgataacaggagcaatttgttttttagttatgcgtgctcttggggaattattagtttctaatttaaactatcactcatttgtagactttgtacaagattatttaggaaacggagcagccttcattactggttggacatactggttctgctggatttcacttgctatggctgatgtaactgccaccgggctttatgtacaatactggattccaagtctgcctagatgggttccaagccttgtaatactgttaattttattaattatgaaccttaccgcagtaagattatttggtgaaatggaattttggtttgctttaattaaagttgttgcaattttagcactaattatagttggtatttttatgatcattaaaggtttttccacaagtgctggcgctgctagctttacaaatctttggaagcatggcggctggtttccaaatggatcaaatggttttattctttctttccaaatggtggtatttgcctttaccggaatagaattagttggcttaactgctggtgaaactgaagatccagaacatgttattccaaaagctattaataatattccagttagaatcattattttctatataggagcacttgctgttataatgagcatttatccatggaattcaattaatccagataaaagtccatttgttcaagtatttgctgcagttggagtagcagcagcggcaactattgtaaattttgttgtactaacctcagctgcatctgcttgtaatagtggtatattcagcacaagccgtatggttttctctcttgctaatgaaaataatgcacctgaatcaatgaagaaattaacttctcacaaaataccttctaatgctacaatattttctgcagccgtaatccttattgcagttattcttaactatattatgccagaaggtgtatttgtactaattactagcatatcaacgttctgctttatcttcatttgggcaataatagttatatgccatattaaatatcgcaaggctaatccagagcttgcttctaaaaataattttaaaatgccactttatccaatagctaactacataattttagcatttttcgcttttgttatagttactttagctctcaatagcgaaacccgagtagctttatttgtaacacctgtatggtttatagttcttggaattatctactttatatctaaatctaaaaagaaaaattag

SEQ ID NO: 9086 - protein, 455 aa, Clostridium acetobutylicum
MDQTKSKNQNLSRGLKNRHVQLLAIGGAIGTGLFLGSGRSIHLAGPSILFAYMITGAICFLVMRALGELLVSNLNYHSFVDFVQDYLGNGAAFITGWTYWFCWISLAMADVTATGLYVQYWIPSLPRWVPSLVILLILLIMNLTAVRLFGEMEFWFALIKVVAILALIIVGIFMIIKGFSTSAGAASFTNLWKHGGWFPNGSNGFILSFQMVVFAFTGIELVGLTAGETEDPEHVIPKAINNIPVRIIIFYIGALAVIMSIYPWNSINPDKSPFVQVFAAVGVAAAATIVNFVVLTSAASACNSGIFSTSRMVFSLANENNAPESMKKLTSHKIPSNATIFSAAVILIAVILNYIMPEGVFVLITSISTFCFIFIWAIIVICHIKYRKANPELASKNNFKMPLYPIANYIILAFFAFVIVTLALNSETRVALFVTPVWFIVLGIIYFISKSKKKN

SEQ ID NO: 9087 - DNA, 1458 bp, Agrobacterium tumefaciens
  CDS (1)..(1458)
atgcattctggaaaaacggcacccgccgaacgtgaggtcttcgtcgaagaggatctcggttaccataaagccctgaagccgcgccaaatccagatgatcgccatcggtggcgccatcggcacggggctctttctgggtgccggtgggcgtctcgcgcaggcaggcccggcgctggttttcgtttatgcgctctgcggtttttttgcgtttctggtgctgcgcgcgctcggcgagctgatcatgcatcgcccgagctccggttccttcgtctcctacgcccgtgaattctacggcgagaaaatggcctttgcggccggctggatgtattggctgaactgggccatgacctcggtggctgatgtgaccgccgtcgcgctctacatgaatttcttcaagcaatatgttccgtggcttgcaggcattgatcagtgggtattcgccatgaccgcgctcgtggtcgtgctggcgatgaacatgctgtcggtgaaggtcttcggcgaactggagttctggttcagcctgatcaaggttctggctctcgccattttcctcgtcgttggcgtctatttcgttattttcggcacgcccattgaaggccatgtcaccggcttcagcctgattacggacaatggtggctttttcccgaacggcattcttcccgccttcgtgatcatacagggtgttgttttcgcttatgcctcgatcgagctgatcggcacggctgccggcgaaaccgaagacccgcgcaaggtcatgccgcgcgccatccgcgccgtggttctgcgcctcgtcgtcttttacgtcggctccgtgctacttttcacgctgcttctgccctacaccgcctacaaagcgggggagagccccttcgtcaccttcttcggctccatcggtgtagagggcgctgacgtgatcatgaacctcgtggttctgaccgccgtattgtcctcgctcaatgccggcctttattccactggtcgcattctccactccatggcggtctccggctcggcgccggcagcgctcgcgaagatgaacaagaacggtgtgccctatggcggcattgcggtcaccgctgttgtcacggttctcggcgtggccttgaacgcggtcgttccctcctccgccttcgagatcgcgctcaacctttcggcgctcggcatcatctgcgcatgggccgtcatcgtgctctgccagctgaagctctggcagctgtctcagcgcggcgagatcgtgcgtccggatttccgcatgttcggcgcgccctataccggcatcctcacgctcatcttcctgttcggcgtgctggtgctgatggccttcgattatcccgtcggctcgtggacgatcgcctcgctgatcgtcatcataccggctctggtcatcggctggtatctgctgcgcgaccgtatctatcgactggccgctgaacgggcaggatcgggagtgtcgcattga

SEQ ID NO: 9088 - protein, 485 aa, Agrobacterium tumefaciens
MHSGKTAPAEREVFVEEDLGYHKALKPRQIQMIAIGGAIGTGLFLGAGGRLAQAGPALVFVYALCGFFAFLVLRALGELIMHRPSSGSFVSYAREFYGEKMAFAAGWMYWLNWAMTSVADVTAVALYMNFFKQYVPWLAGIDQWVFAMTALVVVLAMNMLSVKVFGELEFWFSLIKVLALAIFLVVGVYFVIFGTPIEGHVTGFSLITDNGGFFPNGILPAFVIIQGVVFAYASIELIGTAAGETEDPRKVMPRAIRAVVLRLVVFYVGSVLLFTLLLPYTAYKAGESPFVTFFGSIGVEGADVIMNLVVLTAVLSSLNAGLYSTGRILHSMAVSGSAPAALAKMNKNGVPYGGIAVTAVVTVLGVALNAVVPSSAFEIALNLSALGIICAWAVIVLCQLKLWQLSQRGEIVRPDFRMFGAPYTGILTLIFLFGVLVLMAFDYPVGSWTIASLIVIIPALVIGWYLLRDRIYRLAAERAGSGVSH

SEQ ID NO: 9089 - DNA, 1404 bp, Pseudomonas aeruginosa
  CDS (1)..(1404)
atgacgcacgacacggggcttcggcgcggactgaacgcccgtcatattcgtttcatggcactggggtcggcgatcggcaccggcctgttctacggttccgcatcggccatccagatggccgggccggcggtgctgctggcctacctggtcgccggtgcggcggtgtacatggtgatgcgcgcgctcggcgagatggcagtgcacgagccggtgtccggctcgttcggccattacgccagcagctatctcggccccctggccgggttcgtcaccggctggacctacgctttcgagatgatcatcgtctgcctcgccgatgtcaccgcgttcggcatctacatggggttctggtttcccgacgtgccgcgctggatctgggtactgtccatcgtgctgttcatcggcgggctgaacctctgtcatgtcaaggtcttcggcgagctggagttctggctgtcgctggtcaaggtcggcgccatcgtcgcgatgatcctcgccgggctcggcatcatgttcttcggcttcagcctgggcggcgcggcgacgtccgccaccggcgtgcacaacctgtggcagcacggcggcttcctgcccaacggctgggccgggctggtcgcctcgctgtcggtggtggtattcgccttcggcggcatcgagatcatcggcatcaccgccggcgaggcgcaggacccgcagcgggtgatcccgcgggcgatcaatgcggtgccgctgcgcatcctgctgttctacgtgctgaccctgttcgtgctgatggcgatcttcccctggcagcagatcggcagcaacggcagtcccttcgtgcagatcttcgacggcctggggatcgagtcggccgcggcgatcctcaatgtcgtggtgatcaccgcggcgatttcggcgatcaacagcgacatcttcggcgccggtcgcatgctctacggcatggcccgccagggccaggcgccggtcggcttctcgcgggtgtcgcggcacggcgtgccgtggatgaccgtgctgctgatggcggtggccctgctgctcggcgtggcgctgaactacctgatcccgcagagcgtattcctgttgatcgcttccatcgccaccttcgccaccgtgtgggtctggctgatgatcctcctggcccaggtcggcatgcgccggcgcatggggccgcgccaggtcgccgcgctgaagttcccggtgccgctgtggccattcgcgccggcggcggcgatcgtcttcatgctgttcatcttcgtggtgctcggctatttcccggacacccgcccggccctgtgggtcggggctatctggatcgccttgctggtgatcgcctaccggcgctgggtcaggccgaagggcgatgccgcgcatggcgtgcttcaggcccagggagggctgtga

SEQ ID NO: 9090 - protein, 467 aa, Pseudomonas aeruginosa
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLGGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIALLVIAYRRWVRPKGDAAHGVLQAQGGL

SEQ ID NO: 9091 - DNA, 1413 bp, Pseudomonas aeruginosa
  CDS (1)..(1413)
atggctgacggcaaggaaaggctgcaactcacccgggccctggcgagccgccacatcttcatgctgtccctcggcggggtgatcggcaccgggctgttcatgggctccggcgtgaccatcaaccagggcggcccggccggcgcggtgctggcctacctggtggccggggtgctgatgtacctggtgatggtctgcctcggcgagctgtcggtgcagatgccggtctccggttcgttccaggcccacgcgacgcgtttcatcggcccggcgactggcttcatgatcggctgggtctactggatgagctgggcctccacggtaggcctggaattcaccgcggccgggatgctcatgacccgctggttcccggaggtgcccgtgtggctatggtcgggtttcttcgtggtcgtgctgttctccctcaatgccctggcgacccgcgctttcggcgaggccgagtactggttcgccgggatcaaggtggcggcgatcctggtgttcatcgtggtcggggggctggtgatcttcggcggtatcgaactgaagagcggtgcgccggcgccgatgttctccaacctggtcggcgagcggctgttccccaacggcctgtcggcggtgttcgcggtgatgatgacggtggtctatgccttccagggttgcgagatcatgggcgtcgccgccggcgagaccgagcgaccggagaagagcatcccgcgggcggtgcgcaacgtggtgttccgcgtactgatcttctacgtgctggccatcgtcgtgctttccgccatcattccctggcaacaggccgggctgatggaaagcccgttcgtgcaggtgttcgacatggtcgggattccctacgcggcggacctgatgaacttcgtcatcctcaccgccatcctctcggtaggcaactcgggcctgtacgcctcgacgcggatcctctgggcgatgtccaggtccggcatggccccgcgcggcctgtcgaagctcagcgcgcgcggcgtgccgctctacgcgttgctgatcaccctgtgcttcgccctgctctcgttgctgaccagcgtggtcgccgccgacaccctgttcatggtgctgatggcggtgagcgggatgtccggcaccgtcacctggatcgtcatcgcctacgcccaataccgcttccgccgcgagcacatggccagcggcggcacggtcgccgagctgaaatatgccgcgccgctgttcccgctggtgccgctggcctgcatcgccgtgtgctgctcgctgttcgtcttcctcgccctcgatcccacccagcggccgtccttgtactggggcttcggcttcatcgccgcctgctacctggcctattacgtggttcgtcgccggcagccgcagggactgggcgaccccgccctgggacgggccggctga

SEQ ID NO: 9092 - protein, 470 aa, Pseudomonas aeruginosa
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 9093 - DNA, 1434 bp, Lactococcus lactis subsp. lactis
  CDS (1)..(1434)
atggaaaatcaaaatcaggtcaagcgcaaccttaaacagcgccacatcaccatgattgcattgggtggtacaattggaacaggtttatttttaacttcaggagcaacaattagtcaagcaggtccctggggcgcagttcttgcttattgttttattggtattatggtttacttcgtaatgacttccttaggtgagatggcgacatatttgcctacctcaggttcattctccgattatggcggtcgttatgttgatcctgcttttggctttgcattagggtggaactattggctcaatggagcgattaccattgccgtggatttaacgacagcaggattgattacgcagttttggttcccgcaccttccgtcttggatattttcaggaattgcgacggtcttaatttttattattaatgttatggcggttggagcattcggggaaacagaatattggttatcaacgattaaagtgattacgattgtcctctttttagctattggtttacttaccatttttggagttttgggacaaggaaatgttgatgtcgttgccaatttaagtgctggcaatcatggctttgttggtggaatttcaggatttgttggagttttacttattgccggattctcttttcaaggaactgagcttttagggattaccgcaggtgaatctgaagacccaggtaagtcaattcctaaagcaatgaactctattttctggcgtatcttacttttttacatcttttcaatcattgtgattgctgcaattatcaattttaaagaccctcgcttgttaaatccaaattcgacagctgtcatgagtccatttactattgtctttaaaaatattggctttgcagttgcagcttcagttatgaatgcggtcattcttacttcggtaatttcatcagcaaattcagtaatgtatgcttcaacacgtattctttattcattgggacaagaaaaaggcgcaccaaaattctttggacgaacagcaaaaaatggaattcctttttatgccctattagccacaacaattatttgttttattgctttcttaactggaatatttggaacgcaaatttatcttttcttggttgatttatcatcactaacaggctttcttgcttggcttggaatttctatcagtcatatccgttttagaagagcctatattgctcaagggaaaaaattggaagatcttccttacaaagctaaatggttcccatttggtccaattgttgcgctcttgatgactgcggcgattgccattaatcttgacccagccatgctctttagtgagcactggggtgaaggcttagctttatacgctgcaattcctattttcattattctttattttggttataaatggaagtataatacaaaaattattccacttgaagaagtagatttgagtcgggaaaaataa

SEQ ID NO: 9094 - protein, 477 aa, Lactococcus lactis subsp. lactis
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 9095 - DNA, 1350 bp, Lactococcus lactis subsp. lactis
  CDS (1)..(1350)
atggaaaattctacaggcttgaagtcttctttaaagactcgccacattgttatgctctcacttgggggagcgattggttcaggactatttttaggttctggaaaagtcattgcacaggctgggccaagtgtattactctcatacatcttagctggactgacactttatgttgtcatgtatggtgttgggaaaatggtcatccatcaagatgaacataaggctggaatggccggagttgttgctccttttattggggaccactgggcgcattttgcggactgggtttactgggcaacttggatggccgtcctaattgcagaagaagcaggggtatcaactttccttgccatgctaattcctggagtgccattatgggttttcgccctgattgtagcagttcttggaacagcaatcaatctctggtcagttagagcttttgccgaaacggaatattggcttgcatttattaaagtcgctgttattttaattttaattgcactcggaatttatttattagttattaatgatgctcatcttggttttgttgctgataccgctcaaaaagtatcgactaaaagtacagcaccaagctttgctcctaatggcttttcaggatttttaacttcattattggttgttattttctcatttggtggttctgaattggcagcaattacagttgctgaaacggaaaatccaaaagtagcgattccgagagctattcgaggtgttttaattcggattattagtttttatgttattccaatctttttattcttgcatttattaccatggagcgaagttttaaatccagatgcagcaagtccatttgctacaatttttgctcgagtaggaattccacacgctgataaaatcgttctcgtaattattgttattgcaattttctcagcggttaactcagcaatttatgccacttcacgctcactctattcacgcattcaaggttcaaattcttatgtgggtcaaagattgggcaaattatctaaaaatcaagtcccaacgaatgcgattttagtttcatcatttgttttgtttattggtgtacttttgtcagcaattttgggtgatggattctggcaatttgtggctggttcgatttcatttacgatttcaatcgtttggattctccttttagttgctgctcttgttttatattttaaacataaagaagtaacgaattggtttgttaaattggcaacactcgttgtgcttatcgctttaacgattatcttcatcatgcaaattgtcactaatccatggactttgtcagtctttgctctagtgatttgcctcctttcttactttacttaccgaaagaaaaaagcataa

SEQ ID NO: 9096 - protein, 449 aa, Lactococcus lactis subsp. lactis
MENSTGLKSSLKTRHIVMLSLGGAIGSGLFLGSGKVIAQAGPSVLLSYILAGLTLYVVMYGVGKMVIHQDEHKAGMAGVVAPFIGDHWAHFADWVYWATWMAVLIAEEAGVSTFLAMLIPGVPLWVFALIVAVLGTAINLWSVRAFAETEYWLAFIKVAVILILIALGIYLLVINDAHLGFVADTAQKVSTKSTAPSFAPNGFSGFLTSLLVVIFSFGGSELAAITVAETENPKVAIPRAIRGVLIRIISFYVIPIFLFLHLLPWSEVLNPDAASPFATIFARVGIPHADKIVLVIIVIAIFSAVNSAIYATSRSLYSRIQGSNSYVGQRLGKLSKNQVPTNAILVSSFVLFIGVLLSAILGDGFWQFVAGSISFTISIVWILLLVAALVLYFKHKEVTNWFVKLATLVVLIALTIIFIMQIVTNPWTLSVFALVICLLSYFTYRKKKA

SEQ ID NO: 9097 - DNA, 1344 bp, Bacillus subtilis
  CDS (1)..(1344)
atgaaaaacgacaatcaaacgttaaaacgcacgatgacgtcccgccatattatgatgatggcgctgggcggagcaatcggcgcaggtttatttaaggggagcagctcagcgatcgatgtggcagggccatctgtcattatcgcatacctgctcggcgggattattttgctgtttattatgcaggggctggcggaaatggctgttcgaaaccgtaacgccagaaccttccgtgatcttgtccagcaggtattgggaaattacgctgcttactttttggactggatctactggaaaatgtgggtgcttaacattgcggctgaagctgttgtagctgcgattttcattcaatattggctgccgggctgcccgatctgggtgttggcattaggaatttctcttatcgtcacgattgtaaacttgctttctgttaaaatcttcgccgaaactgaatattggctggcaatgatcaagattaccgttattattatctttattattctgggattgctgctcttatttgtatcattcggtgatcatacagcatccggattttccaacctgacagaccacggcggatttttcccgcacggcggcacagggctgatcacggcgatgcttgtcgtcatctactcttacggcggtacagaaattatcggtgtaacgcttgcagagacaaaaaatccggaaaaggttgtcccgaaagctgtccgcagcacactgacacggattgtcgcgttttacctgctgccgtttttcatcatcgtcagcctgattccatggaaccaagtcaattccgttccggaaagtcctttcgtgatggtctttaaaatggtaggcattccgggcgcggatcatatcatgaatgcagtcatcctgctggcgatcatttcttctatgaattcaggtttatacggatcatcacgcattttgtatacacaggcaagtgacggaaggcttccaaaggtcttctcgaagctttcatcgaaaaacgtaccgatgtttgcgattctgatgtgcacttcttctctctatattggcgtattgatttctctgttcgcaggaagccaaacatttaattatttaatgggatcattgggatataccgttttattcatttggctgatcatcggattcgctcatttaaaatcgagaaaacagcaaacggaaacaccggcctattatgtaaaatggttcccgtacacgacatggtttgcgattgtggcattactcgccattctgatcggggtcatcatgacaacatcaattgtcattaccggcattactgcggcgatctaccttttgattacagttgcatatttggtcaaaggacgcaagcatcagtaa

SEQ ID NO: 9098 - protein, 447 aa, Bacillus subtilis
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 9099 - DNA, 1419 bp, Pseudomonas aeruginosa
  CDS (1)..(1419)
atggacggccaacatccgcattcgggcgagctcaagcgcggcctgaagaatcgtcacatccagttgatcgccctcggcggcgccatcggcaccggcctgttcctcggctcggccggggtgctcaagtcggcgggcccgtcgatgatcctcggctacgccatcgccggcttcatcgctttcatgatcatgcgccagctcggcgagatgatcgtcgaggagccggtcgccggctccttcagccacttcgcgcacaagtactggggcggcttcgccggcttcctctccggctggaactgctgggtgctgtacatcctggtcgggatgtcggaactgaccgcggtcggcaagtacatccactactggtggccggaggtgccgacctgggccacggcggcgttgttcttcgtcgtcgtcaacgcgatcaacctaaccaacgtcaaggccttcggcgaagccgagttctggttcgcgatcatcaaggtggtggcgatcatcggcatgatcctgctcggctgctacctgctgttcagcggcagcggcggtccgcaggcttcggtgagcaacctctgggcacacggcggtttcttccccaacggagtgagcggactggtgatggccatggcgatcatcatgttctccttcggtggcctggaaatgctcggcttcaccgcggccgaggcggacaagccgaggacggtgatcccgaaggcgatcaaccaggtgatctatcgcatcctgatcttctacatcggcgccctggtcgtgctgctctcgctgacgccctgggacagcctgctgcagaccctcaacgcttccggcgatgcctacagcggcagcccgttcgtgcagatcttctcgatgatcggcagcggcaccgccgcgcacctgctgaacttcgtggtgctcaccgccgcactgtcggtgtacaacagcggcacctattgcaacggccgcatgcttctcggcctggccgagcagggcgatgccccgcgcgcgctggccagggtcgacaagcgcggcgtaccggtacgcgccctggtggtatcggcgctggtgaccttcctcgcggtggtggtgaactatgtgatcccgcaccaggcgctggagctgctgatgtcgctggtggtggcggcgctggtgatcaactgggcgatgatcagcatggcgcacctgaagttccgcgcgcagatggaccgccagggcacccgcacgcacttccgcgcgttctggtatccgtacggcaactacctgtgcatggccttcgtggtgttcatcctcggcgtcatgttgctgatccccggcatccaggtctcggtctatgccatcccggtctggctgctggtgatgtgggcctgctaccgactcaagggagccccgcggccgatgccgggcctgcgggtgaagccggtcaccgagtga

SEQ ID NO: 9100 - protein, 472 aa, Pseudomonas aeruginosa
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 9101 - DNA, 1380 bp, Staphylococcus aureus
  CDS (1)..(1380)
atggagaacaatgaactacaaaggggattgagtgcccgtcaaattcaaatgattgcacttggtggtacgattggcgtggggcttttcatgggtgccacaagtacaattaaatggacaggcccatcagttatccttgcatatttaattgcgggtatctttttatttttaatcatgagagcaatgggggaaatgatttatttaaaccctacaacaggatcatttgcaacatttgcaagtgattatatacatcctgcagcaggttatatgacagcatggagtaatatattccaatggattgtagttggtatgagtgaggtcatcgcagtaggagaatatatgaagttttggttcccggaattgccaacttggattcctggtgttattgctattttattattaatggcagcgaatttattctcggtaaaagcgtttggagaatttgaattttggtttgctttaattaaagttgtaacaattattttaatgattattgctggttttggtcttattttctttggttttggaaatggtggccatgcggtaggtatttctaatctatggacaaatggcggatttatgccaaatggtattgttggtttcttctttgcattatcaattgtaattggttcataccaaggtgtggaactgataggtattacggcaggtgaaactaaagatcctcagaaaaatatcgttaaagcagtgaatggtgttatctggagaattttaattttctatttaggcgctatttttgttattgtttcagtgtatccttggaatcaattaggagacattggaagtccgtttgttgcaacatttgctaaaatcggtattacatttgcagctggattaattaactttgttgtattaactgcagcaatgtcaggatgtaactcaggtattttcagtgcgagtcgtatgatttatacacttgctcataaaggtgaaatgccaaaaatatttactaaaatcatgagaaatggtgtaccattgtacactgttgtagcagtatctcttggtattttaattggtgctttattaaacgtaattttacctttatatatcgatggagcgaagagtattttcgtatacgtttatagtgcgtctattttaccaggtatgattccttggtttatgattttattcagtcacttacgttttagaaaattacatcctgaagaattggaaggtcacccattcaaaatgcctggtggcgcagtaactaactatttaacaatcttattcttaatattagtattggttggtatggtatttaatgttgaaactagaatatcagtgctaattggtgtcatcttcttaacgattgtaacgatttattactttattagatataataaaaataatgtaaaagcaaaatag

SEQ ID NO: 9102 - protein, 459 aa, Staphylococcus aureus
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 9103 - DNA, 1041 bp, Staphylococcus aureus
  CDS (1)..(1041)
atggcaagaaaattgcatagagagttgaataacagacacatccaattgatagcaattgggggcgcaattggaactgggttattcctaggatcaggtcaaacaatatctttaactggtccatcactgttattcacatacatgattattggggttgtactattcgcttttatgcgcgcattaggcgaattgttgttgagcaatacaagatttaattcatttgttgatattgcaaatgaatatttaggcccttttggtggctttgtcattggctggacttactggttatgttggattgtatcaagtatgtcagacctaactgcgatgggacaatactttgcattttggtatccacaagtcccaaattggattaccgtgctatttattgttttaatcttgattagcttcaacttattaggtgccagattatttggtgaactggagttttggttctctattattaaagttgtcacaattattgcgatggttatcgttggtcttgtattaatctttttctcatttaaaacacattatggacatgcatcattcacaaacttaatcagtcacggcggcatgttccctggaggaacatttggtttcctaatgtcattccaaattgctgtatattcattcattggtattgaacttataggtgtaactgctggtgaaacgaaagatcctgaaaaaaccttaccgaaagcaattaataatgtacctatccgtattttattattctatatcggtggtctattagtaattatgtcagtcataccttggaatgatatcgatccaaatagtagccctttcgttaaactctttacattaatcggcgtgccatttgcagcaggcgtcgttaactttgtcgtgctaactgccgcggcctctgctacaaatagtggtatctattcgaatagtcgtatcttattcggactgtcacaacaagggttaggtcctaaagttttaaattggcgtgccttatttatcaatgttagtttcatcaattgcattacttatagcagccttgttaaactacattttccctaa

SEQ ID NO: 9104 - protein, 346 aa, Staphylococcus aureus
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNWRALFINVSFINCITYSSLVKLHFP

SEQ ID NO: 9105 - DNA, 1401 bp, Escherichia coli
  CDS (1)..(1401)
atggggcaatcatcgcaaccacatgagttaggcggcgggctgaagtcacgccacgtcaccatgttgtctattgccggtgttatcggcgcaagtctgtttgtcggttccagcgtcgccatcgccgaagcgggcccggcggtattactggcctatctgttcgccgggctactggtggttatgattatgcggatgttggcggaaatggcggttgccacgcccgataccggttcgttttccacctatgccgataaagccattggtcgctgggcgggctataccatcggctggttgtactggtggttttgggtactggttatcccgctggaagccaacatcgccgccatgatcctgcactcatgggttccaggcattcccatctggttattttccctcgtcattaccctcgccttaactggcagtaacttattaagcgttaaaaactacggcgaatttgagttctggctggcgctgtgcaaagtcatcgctatcctggcctttattttccttggtgcagtcgcaattagcggtttttacccgtatgccgaagtgagcgggatctcaagattgtgggatagcggcggctttatgcccaacggtttcggtgcggtattaagcgcgatgttgatcaccatgttctcgtttatgggcgcagaaattgtcaccattgccgccgcggaatccgacacgccggaaaaacatattgtccgcgccaccaactcggttatctggcgtatttctatcttctatttatgttctatttttgtcgtcgtggcattaattccgtggaatatgcccggactaaaagccgtcggttcttatcgctcggtactggaattgctcaatattccccatgcgaaattaatcatggactgcgtgatattactttccgtaaccagttgcctgaactcggcgctgtataccgcgtcaaggatgctctactccttaagtcgtcgcggtgatgctcccgcggtaatgggtaaaatcaaccgcagtaaaaccccgtacgtggcggtgttactctccaccggcgcggcattcttaacggtggtggtgaactattacgcgcctgcgaaggtatttaaatttctgatcgacagctccggcgctatcgccctgctggtttatttagtcatcgccgtttcacagttgcggatgcgcaaaattctgcgagcagaaggaagcgaaattcgcttgcgaatgtggctttatccgtggctcacctggctagtcatcggctttattacctttgtgttggtagtgatgctattccgtccggcgcaacagttagaagtgatctccaccggcttattagcgatagggattatctgtaccgtgccaattatggctcgctggaaaaagctggtattgtggcaaaaaacacccgttcataatacgcgctga

SEQ ID NO: 9106 - protein, 466 aa, Escherichia coli
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 9107 - DNA, 1386 bp, Escherichia coli
  CDS (1)..(1386)
atggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgtccctcgaaccggttaccggttcgttcgccgtttatgcgcatcgttatatgagcccgttctttggctatctcaccgcctggtcttactggtttatgtggatggcggtggggatctctgaaatcaccgccattggcgtttatgtccagttctggttcccggagatggcgcagtggatacccgcattgatcgcagtggcgctggtggcgttggcgaatctggcggcggtgcggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgcgggtggctggaaagggttcctgaccgctctgtgtattgtggtggcgtcctaccagggcgtggagctgattggcattactgccggtgaagcgaagaatccgcaggtgacgctgcgcagtgccgtaggcaaggtgctgtggcggatcctgattttctacgtaggcgcgattttcgttatcgtcaccatcttcccgtggaatgaaataggcagcaacggcagcccgttcgtactgacttttgccaaaatcggtattaccgcagcggcgggcattatcaactttgtggtgctgacggctgcgctctctggctgtaacagcggcatgtacagttgcggacgtatgctctacgcactggcgaaaaaccgtcagttaccggcggcaatggcgaaagtttcccgtcacggcgtaccggttgcgggtgtggcagtatctattgctattctgctaattgctcatgcctggaactacatcattcccaatccgcagcgtgtgtttgtctacgtctacagtgccagcgtgcttccggggatggtgccatggtttgtgatattgataagccagctgcgttttcggcgtgcacataaagcggcgattgccagccatccgttccgctcaatcctgttcccgtgggccaattacgtaacaatggcattcctgatttgcgttttgatcggcatgtactttaatgaagatacgcgtatgtcgctgtttgttggcatcatctttatgctggcggtgacggcgatttataaagtttttggccttaatcgccacgggaaagcgcataaactggaggaataa

SEQ ID NO: 9108 - protein, 461 aa, Escherichia coli
MADNKPELQRGLEARHIELIALGGTIGVGLFMGAASTLKWAGPSVLLAYIIAGLFVFFIMRSMGEMLSLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 9109 - DNA, 1389 bp, Bacillus subtilis
  CDS (1)..(1389)
atggcaaataaagaattaaagaggggcctgggcgcgcgccatattcagatgatcgccttgggcggtacaatcggtgttggcttgtttatgggttctgccagcacgatttcatggactggcccatctgtccttctggcttatgcaatatgcggaatttttatcttttttattatgcgtgcgatgggtgaaatgctgtatgtcgagccgagcacaggttcttttgcgacgttcggccatcaatatattcatccgatggcaggttatataacagcatggagcaactggttccagtggattatcgtcggcatgtcagaaattatcgctgtcggttcttatacgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggcaatggcggagatgcgatcggtttgtcgaacctgtggtctcacgggggcttctttgcaggaggtttctcaggtttcttctttgcactgtctcttgtcattgcagcctatcaaggagttgagctgatcgggattacagcgggtgaagcgaaggacccgcaaaacacgctaagaaatgcgattcaaagtattatctggcgtattttgattttctacattggcgctatttttgtgatcgtgacggtgtatccttgggatgagctcaactcactcggaagtccgtttgtgtctacgttctcgaaaattggaattacggcagcggccggcattattaactttgtcgtgattactgcggcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggcgttgtactgaactatatcgcgccgccgaagatctttgtctatgtatacagcgcaagcgtgctcccagggatgattccttggtttatcattttgatcagccatatcggattcagaaaagcgaagggtgctgcattagataaacatccattcaaaatgccgtttgctccttttacaaactatttgacgattgctttcttgctgatggttctggttggcatgtggtttaacgatgatactcgtatctccctgattgtaggcgtgattttcttagcgcttgtggtcattagttattatgtgtttgggattggcaaacgcacgcaggccaatttgacaaaaagcgaacaagcagctgaataa

SEQ ID NO: 9110 - protein, 462 aa, Bacillus subtilis
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 9111 - DNA, 1377 bp, Bacillus subtilis
  CDS (1)..(1377)
atgacagacgacatgacgaaagacaatataaatcagcaaacgttgcagagaggcttgaaaaacaggcatatccagctcatcgccatcggcggagccattgggacaggcttatttctcggctcgggcaaatcgattcattttgccggaccttcgattttatttgcttatatgatcacagggatcatttgctttttaattatgagatcgctgggtgaactgctgttatcaaacttgaactatcactcttttgtggattttgtacaagactacctaggcgatatggcagcttttatcaccggctggacatattggttctgctggatttccattgcgatggctgatctgacagcagtcgggctctacactcaatattggctcccgggtgtgccgcaatgggtgcctggcttaatcgctcttattattttactgattatgaatctggcgacagtcaagctttttggagaattagaattttggttcgctttgattaaagtcattgccattttggcgttaatcgtcattggccttgtgatgattttcaaaggcttttccacaagctcaggagtgtccagcttcacaaacctctggagccacggaggcctgttcccgaatggcatgcacgggtttatcctctcgttccagatggttgtgtttgcttttgtcggcattgagcttgtcgggcttacggccggtgaaacagaaaaccctgaaaaagtaatccctaaggcgatcaacaatattcctgtccgtgtgctgcttttttatatcggggctcttctcgtgattatgagcatctatccttgggatatcatcaatcccagcgaaagcccattcgtacaagtatttgtcgctgttggcatcgtcggggctgcaagtattatcaactttgttgtgttgacatccgctgcttcagcatgcaacagcgctgtattcagtacaagccgtatggtctattccctggcgaaagatcacaatgcgcctgagtcaatggcgaaactgactcagcgtaaagtgcctagaaatgctttattcttttcagctatcgtgattttaatcggtgttacgttaaactacatcatgccagaaggcgtattcaccctgatcacaagtatttcaaccgtatgctttatctacatttgggggattacggtcatctgccatatgaaataccgcaaaacaagacctgaattagcgaaaacaaacaagtttaagcttccgctttatccgtttacaaattacctgattcttgcgttcctggcgtttgttctggttgtgctggcactggcacaggatactcgtgtttccttatttgtcacaccggtttggtttattttgctgattgtgatttataaagtgagaaaagcgaagcatcaataa

SEQ ID NO: 9112 - protein, 458 aa, Bacillus subtilis
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 9113 - DNA, 1305 bp, Mycobacterium tuberculosis
  CDS (1)..(1305)
atgatcgctatcggcggcgtcatcggtgctggcttgttcgtcgggtctggtgtggttatccgtgcgaccggtccggcggcattcctgacctatgcgctgtgcggcgcactgatcgttctggtgatgcgcatgctgggcgagatggccgccgccaatccgtcgactggagcgttcgccgactacgcggcaaaagccctgggcggctgggcgggattctcggttggctggctgtactggtacttctgggtaatcgtcgtggggttcgaggcggttgccggcgggaaggttctaacctactggatcgatgcgccgctgtggttggcgtcgctgtgtctgatgatgatgatgaccgcgacgaacttggtctcggtgtcatccttcggtgagttcgagttctggttcgccggagtcaaggttgccaccatcgtcggcttcctggtccttggcaccgctttcgccttcgggctgctgccgggccatggcatggatttcagcaacctcagcgcgcacggtggcttctttcccgacggggtaggtgccgtcttcgctgccatcgtggtcgcgatcttctccatgactggcacggaagtagtcaccatcgccgcggctgaagcgccggaccctcaacgagcggtccaacgcgcgatgagcacggtggtggcacgcatcgtgatcttcttcgtcggctcggtcttcctgctcacggtgatcctgccgtggaactcgttggagcttggcgcctccccgtacgttgccgcgctgcggcacatgggtattgggggtgctgatcagatcatgaatgccgtcgtgcttaccgcggtgctgtcctgcttgaactcgggcctgtataccgcgtcgcggatgctgttcgtgctcgccgcccggcaggaggcgccggcccagctggtcaaagtcaaccggcgtggagtccccaccttcgcgatcatgggatcgtccgtggtgggattcctgtgcgtgatcatggcatgggtctcacccgcaacggtattcgttttcctgctcaactcgtcgggcgctgtgattttgttcgtctacctgcttatcgcgctgtcgcagatcgtgttgcgtcgccagacatctggccaaaatctgggggtacggatgtggcttttcccggggctgtcgatcgtcacggtgaccggaattgtcgccgtgctggcgcggatggcgttcgactacgccgcgcgcagccagctctggctcagcctgctgtcctgggcagtggtcgttgggtgttatttggtcaccacattggtgcgacgtccccttaatcggccttggtga

SEQ ID NO: 9114 - protein, 434 aa, Mycobacterium tuberculosis
MIAIGGVIGAGLFVGSGVVIRATGPAAFLTYALCGALIVLVMRMLGEMAAANPSTGAFADYAAKALGGWAGFSVGWLYWYFWVIVVGFEAVAGGKVLTYWIDAPLWLASLCLMMMMTATNLVSVSSFGEFEFWFAGVKVATIVGFLVLGTAFAFGLLPGHGMDFSNLSAHGGFFPDGVGAVFAAIVVAIFSMTGTEVVTIAAAEAPDPQRAVQRAMSTVVARIVIFFVGSVFLLTVILPWNSLELGASPYVAALRHMGIGGADQIMNAVVLTAVLSCLNSGLYTASRMLFVLAARQEAPAQLVKVNRRGVPTFAIMGSSVVGFLCVIMAWVSPATVFVFLLNSSGAVILFVYLLIALSQIVLRRQTSGQNLGVRMWLFPGLSIVTVTGIVAVLARMAFDYAARSQLWLSLLSWAVVVGCYLVTTLVRRPLNRPW

SEQ ID NO: 9115 - DNA, 1464 bp, Pseudomonas aeruginosa
  CDS (1)..(1464)
atgactgacctgaacaccagccagggccagcaattgcggcgggtgctcaagccgcgccacctgaacatgatcgccatcggcggctccatcggcaccgggctgttcgtcgcctccggggccacagtggccaccgccgggcccggcggtgcgctgctttcctacgcactgatcgggctgatggtgtacttcctcatgaccagtctcggcgagatggccgcctacatgcccgtttccggctcattctgtacctatggcagccggttcgtcgaagatggcttcggtttcgccctcggctggaactactggtacaactgggcggtgaccatcgccgcggagctggtggcggcgcaactggtgatgagtttctggttccccgaggtgccgggcatctactggagcgcgatcttcctgggcatcatgttcggcctcaacgtgatttccgcgcgcggcttcggcgagagcgaattctggttcgccctgatcaaggtagtcacggtggtgatcttcatcggcgtcggcctggcgaccatcttcggcatcatgcatggcgtggagtcgcccggcttcagcaacttcaccatgggcgacgcgcccttcgtcggcggcttccaggcgatggtcggggtggcgatgatcgccggcttctcgttccagggcaccgaactgatcggcatcgccgccggtgaatcggaaaatccgcggaagaacatcccgatcgccattcgccaggtgttctggcgcatcctgatgttctacatcctggcgatcttcgtgatcggcatgctgattccctacaccgacccgaacctgctgaagaacgatgccagcgacatcagcgtgtcgcccttcaccctgctcttcgagcgcgccggcttcgccgcggcggccggggtgatgaacgcagtgatcctctcggcgatcctctccgccggcaactccggcatgtacgcctcgacccggatgctctacaacctcgccctcgagggcaaggcaccgcgcctgttctcccgcgtctcgcgcagcggcgtgccacgcaacgcgctgtacgccactaccctggtcggcgccctgtgcttcctcacttcggccttcggcgacagcaccgtctacacatggctgctgaacacctcgggcatgtgcggcttcatcgcctggctgggcatcgccatctcccactatcgcttccgcaagggttacctggcccagggcggccgcctggaagacctgccctaccgggccaagctgttccccttcgggccgctgttcgccttcgccctgtgcatggtcatcaccctcgggcagaactaccaggcgctggtgggcgaacgcatcgactggatcggcctcctcgccacctatatcagcctgccgctgttcctggcgatctggctgggataccgctggaagaagcgcgcacgcttcgttcgctaccacgaaatggacgtcagcccgaccaatacctga

SEQ ID NO: 9116 - protein, 487 aa, Pseudomonas aeruginosa
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 9117 - DNA, 2381 bp, Saccharomyces cerevisiae
  CDS (319)..(2091)
ttgtctctatcaatgaaaatttcgaggaagacgataaggttaagataagtagataagagaatgatacgagataaagcacaaattagcagaaagaagagtggttgcgaacagagtaaaccgaatcagggaatccctttttgcaaaaacatcaattatccttttcttttttttacgtatatatctggaacagaaatatataagttactattatacttatagttggatccagtttttaatctgtcgtcaatcgaaagtttatttcagagttcttcagacttcttaactcctgtaaaaacaaaaaaaaaaaaaggcatagcaatgacaaattcaaaagaagacgccgacatagaggagaagcatatgtacaatgagccggtcacaaccctctttcacgacgttgaagcttcacaaacacaccacagacgtgggtcaataccattgaaagatgagaaaagtaaagaattgtatccattgcgctctttcccgacgagagtaaatggcgaggatacgttctctatggaggatggcataggtgatgaagatgaaggagaagtacagaacgctgaagtgaagagagagcttaagcaaagacatattggtatgattgcccttggtggtactattggtacaggtcttttcattggtttatccacacctctgaccaacgccggcccagtgggcgctcttatatcatatttatttatgggttctttggcatattctgtcacgcagtccttgggtgaaatggctacattcatccctgttacatcctctttcacagttttctcacaaagattcctttctccagcatttggtgcggccaatggttacatgtattggttttcttgggcaatcacttttgccctggaacttagtgtagttggccaagtcattcaattttggacgtacaaagttccactggcggcatggattagtattttttgggtaattatcacaataatgaacttgttccctgtcaaatattacggtgaattcgagttctgggtcgcttccatcaaagttttagccattatcgggtttctaatatactgtttttgtatggtttgtggtgctggggttaccggcccagttggattccgttattggagaaacccaggtgcctggggtccaggtataatatctaaggataaaaacgaagggaggttcttaggttgggtttcctctttgattaacgctgccttcacatttcaaggtactgaactagttggtatcactgctggtgaagctgcaaaccccagaaaatccgttccaagagccatcaaaaaagttgttttccgtatcttaaccttctacattggctctctattattcattggacttttagttccatacaatgaccctaaactaacacaatctacttcctacgtttctacttctccctttattattgctattgagaactctggtacaaaggttttgccacatatcttcaacgctgttatcttaacaaccattatttctgccgcaaattcaaatatttacgttggttcccgtattttatttggtctatcaaagaacaagttggctcctaaattcctgtcaaggaccaccaaaggtggtgttccatacattgcagttttcgttactgctgcatttggcgctttggcttacatggagacatctactggtggtgacaaagttttcgaatggctattaaatatcactggtgttgcaggcttttttgcatggttatttatctcaatctcgcacatcagatttatgcaagctttgaaataccgtggcatctctcgtgacgagttaccatttaaagctaaattaatgcccggcttggcttattatgcggccacatttatgacgatcattatcattattcaaggtttcacggcttttgcaccaaaattcaatggtgttagctttgctgccgcctatatctctattttcctgttcttagctgtttggatcttatttcaatgcatattcagatgcagatttatttggaagattggagatgtcgacatcgattccgatagaagagacattgaggcaattgtatgggaagatcatgaaccaaagactttttgggacaaattttggaatgttgtagcatagatatgacgttttattacctttgatcacatttccacgccatttcgcattctcaccctcataagtcatacaccgaaaagaaagtttaagggatcaatgagcttactataatctcagtatatttatttttatcgatgattcaccacaacaatcttgctcccgaaaagaaagcagacggagtagaagcatttgaaactccttcagaccttcaagtatatatatatatatatatatatgtatatgtgtacattttccacgcctaatactaatgtataattagaagataattttta

SEQ ID NO: 9118 - protein, 590 aa, Saccharomyces cerevisiae
MTNSKEDADIEEKHMYNEPVTTLFHDVEASQTHHRRGSIPLKDEKSKELYPLRSFPTRVNGEDTFSMEDGIGDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAITFALELSVVGQVIQFWTYKVPLAAWISIFWVIITIMNLFPVKYYGEFEFWVASIKVLAIIGFLIYCFCMVCGAGVTGPVGFRYWRNPGAWGPGIISKDKNEGRFLGWVSSLINAAFTFQGTELVGITAGEAANPRKSVPRAIKKVVFRILTFYIGSLLFIGLLVPYNDPKLTQSTSYVSTSPFIIAIENSGTKVLPHIFNAVILTTIISAANSNIYVGSRILFGLSKNKLAPKFLSRTTKGGVPYIAVFVTAAFGALAYMETSTGGDKVFEWLLNITGVAGFFAWLFISISHIRFMQALKYRGISRDELPFKAKLMPGLAYYAATFMTIIIIIQGFTAFAPKFNGVSFAAAYISIFLFLAVWILFQCIFRCRFIWKIGDVDIDSDRRDIEAIVWEDHEPKTFWDKFWNVVA

SEQ ID NO: 9119 - DNA, 1386 bp, Salmonella typhimurium
  CDS (1)..(1386)
atggcagagaaaaaaccggagctacagcgtgggctggaagctcgtcatattgaattgattgccctcgggggcaccatcggcgtcggactctttatgggcgccgccagtacgctgaaatgggcgggcccgtcagtgctgctggcgtatatcatcgccggattgttcgtctttttcatcatgcgttcgatgggggagatgctctttctggaacctgttaccggctcctttgccgtgtacgcccaccggtatatgagtcctttttttggctatcttaccgcctggtcatactggtttatgtggatggcggtcgggatctcggaaattaccgccattggggtctacgtccagttctggtttccggagatggcgcagtggataccggcgctgattgccgtcggactggtcgcgttggcgaatctggctgcggtgcgcctgtatggtgaaatcgagttctggtttgcgatgatcaaagtcaccacgattattgtgatgatcatcatcggtctgggggtgattttcttcggctttggtaacggcggccaggcgattggctttggtaatctgaccgagcatggcggcttttttgccggcggctgggaaggctttctgaccgcattgtgtatcgtggtggcctcttatcagggggttgagttgatcggtattaccgccggtgaagcgaagaatccgcaggtgacgttgcgtagcgcggtgggtaaagtgctgtggcgtatcctgattttttatgttggcgcgattttcgtgatcgtcaccattttcccgtggaatgagattggcagcaacggcagcccctttgtgctcaccttcgcgaaaatcggcatcaccgccgcggcaggcattatcaactttgtcgtgctgacggcggcgctctccggctgtaacagcggaatgtatagctgtgggcgtatgctttacgcgctggcgaaaaaccgtcaactgccggcggcagtcgcgaaagtctctcgccacggcgtgccggtcgcgggcgtggcgctctctattttgattttgctggtaggttcttgcctgaactacatcatccccaatccgcagcgcgtctttgtttacgtttatagcgccagcgtactgccggggatggtgccgtggtttgtcattctgattagccaactgcgctttcgtcgggcgcataaagaagcgattgcggatcatccttttcgttccattatgtttccgtgggcgaactatttgacgatggcgtttctggtttgcgttttaatcggcatgtactttaatgaagatacgcgcatgtcgctgtttgtcggcgtcatcttcctgctggccgtcacgctggtctacaaagttttcggtctgaatcgtcacggaaccgcccacaaggtgggggaataa

SEQ ID NO: 9120 - protein, 461 aa, Salmonella typhimurium
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWEGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 9121 - DNA, 2059 bp, Trichoderma harzianum
  CDS (37)..(1758)
ggccaacacaagaagagcaacaccaaggccttcatcatgtcgaaagaggagagtggccatgtcactcccgagaagggcgacaatgtcgtcgactatcaggccagcacgacagtcctccccagcgagggccctgagcgcgacgccaactggttcacgcgcaatggcctcaacgtcgactccttcaagaagaagcactatggcccgggcatggtcgagcttgagcgtcccatgaaggctcgccatcttcacatgattgccattggtggttccattggtgctggtttcttcgtcggctcgggcggtgctctggccaaaggtggccctggttctctctttgtcgacttcctcattatcggtatcatgatgttcaacgtcgtgtacgctctcggtgaactcgccatcatgtaccccgtctctggttctttctacacatactctgctcgtttcatcgaccctgcctggggtttcgccatgggctggaactatgttcttcagtgggctgccgttcttccgcttgaattgacagtttgtggtattacgatatcgtactggaactcggaaatcaccacagccgcttggatctctctcttcctcggcgtcatcatcatcatcaacctgtttggcgctctcggctatgctgaagaggagttttgggcatcgtgcttcaagctggctgccaccgtcatcttcatgatcatcgcttttgtccttgtcctcggtggtggtcccaaggatggccgataccacgagtactggggtgcccgctactggtacgacccgggcgcgttcaagaacggcttcaagggcttctgctccgtcttcgtcaccgctgccttctccttctccggtactgagctggtcggtcttgccgctgccgagtctactaaccccaccaagaacatgcccggtgctatcaagcaggtcttctggcgtatcaccatcttttacatcctcggtctcttctttgtcggcctgctgatcaacagcgatgatcccgctctgctctcctctgccgcctacgctgactccaaggcctctccctttgtgcttgtcggcaagtacgctggcttgaagggtttcgaccacttcatgaacctcgtcattctcgcctccgtcttgtccatcggtgtctctggtgtgtatggtggatctcgaaccctgaccgctctggctcagcagggctatgctcccaagctcttcacctacattgacaagtctggccgtcccctgccctctgtcatcttcctcatcctgttcggcttcatcgcctatgtcagcttggatgccaccggtcccgttgtctttgactggcttcttgccatttccggcttggccgctctcttcacctggggctctgtctgccttgcccacattcgattccgcaaggcctggaagtaccacggccacactctggatgagattccattcaaggctgctggcggtgtctacggctcatacctcggccttttcatttgcgtcattgtcctgatggctcagttctataccgctattgcagcccctcccggatcaccaggcgttggtaccgcagaggacttcttcaagcagtacctggctgctcccgtcgtcctcggtttctggatcgttggatggctgtggaagcgccagcctttcttgagaaccaagaacattgacgttgacactggtctccgtgagtttgactgggacgagatcaacgcagagcgcacaagaattgctcccctgcctgcctggagacgcatcatccaccacaccttctaagagcccaagctcgacgataatttctttatccatttctttttttttattcaacacatgtgttgttcctccgtcgatacagtatggcatcatgttggatgcagactggagttaatgaggcggagtgaattcggatgacgatgatgtaacgctgtatatgcaaccacgcctacgatgctgtgggcgacttcttcctgtaaacaattagctttatttctattatgcaacataataccacggcgggtgtaagcaagcctctaacggggatgggaatcaaatcaatatatacctgttcatacaacaa

SEQ ID NO: 9122 - protein, 573 aa, Trichoderma harzianum
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 9123 - DNA, 1809 bp, Saccharomyces cerevisiae
  CDS (1)..(1809)
atgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggtgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaa

SEQ ID NO: 9124 - protein, 602 aa, Saccharomyces cerevisiae
MSNTSSYEKNNPDNLKHNGITIDSEFLTQEPITIPSNGSAVSIDETGSGSKWQDFKDSFKRVKPIEVDPNLSEAEKVAIITAQTPLKHHLKNRHLQMIAIGGAIGTGLLVGSGTALRTGGPASLLIGWGSTGTMIYAMVMALGELAVIFPISGGFTTYATRFIDESFGYANNFNYMLQWLVVLPLEIVSASITVNFWGTDPKYRDGFVALFWLAIVIINMFGVKGYGEAEFVFSFIKVITVVGFIILGIILNCGGGPTGGYIGGKYWHDPGAFAGDTPGAKFKGVCSVFVTAAFSFAGSELVGLAASESVEPRKSVPKAAKQVFWRITLFYILSLLMIGLLVPYNDKSLIGASSVDAAASPFVIAIKTHGIKGLPSVVNVVILIAVLSVGNSAIYACSRTMVALAEQRFLPEIFSYVDRKGRPLVGIAVTSAFGLIAFVAASKKEGEVFNWLLALSGLSSLFTWGGICICHIRFRKALAAQGRGLDELSFKSPTGVWGSYWGLFMVIIMFIAQFYVAVFPVGDSPSAEGFFEAYLSFPLVMVMYIGHKIYKRNWKLFIPAEKMDIDTGRREVDLDLLKQEIAEEKAIMATKPRWYRIWNFWC

SEQ ID NO: 9125 - DNA, 1413 bp, Bacillus subtilis
  CDS (1)..(1413)
atgcagaatcataaaaatgaattgcagcgcagcatgaaaagcaggcatttgtttatgattgctttgggaggggtgattggcactgggctgtttctaggctctggctttaccattagccaggcgggaccgctcggcgccattgccgcgtatatcatcggcggatttttaatgtatctcgtcatgctttgtttaggagaattggctgttgccatgccggtggccggatcgtttcaggcctacgccactaaatttctgggacagtcgacaggctttatgattggctggctgtattggttcagctgggccaatacagtagggttagagctgacgtcagcaggcattttgatgcaaaggtggctgccctccgttccgatctggatatggtgcctcgtgttcggcatcgtcatctttttgattaatgcgctctctgtcagaagctttgcggaaatggaattttggttttcaagcatcaaagtggcggcgatcatattatttattgtgattggcggagccgctgtgtttggcttgattgactttaaaggcggacaggagacaccctttttgtctaactttatgactgatagagggcttttccctaatggggtgctggccgttatgtttacgctggtcatggtaaacttctcgttccagggaacggagcttgtcggcattgcggcaggggaaagtgaaagcccggaaaaaacactgccaaagtccattcgaaatgttatttggcgcacgctgtttttctttgtgctcgctatgttcgtcttggttgccatccttccgtacaaaacggcgggggtgattgaaagcccgtttgtagcagtactcgatcaaatcggcatcccattttcggcagatatcatgaactttgtcatcttaacggccattttatctgttgctaattcgggattgtatgcggcgtcgcgtatgatgtggtcactttcatcaaatcaaatgggtccctcctttctcaccagactgacaaaaaaaggcgtgccgatgaatgccctgctgattacgctaggcatttcaggctgttcgctgctgacaagtgtcatggctgcagaaacagtgtatttatggtgtatctcaatctcgggcatggtgacagttgtcgcgtggatgtccatttgtgcgtcgcaatttttctttcgcaggcgtttcctggcagaaggcggaaatgtgaatgatctggagttcagaacgccgctttatccgctagtcccgattctcggattttgtttatatggctgcgtgttgatcagccttattttcattccggatcaaagaattggcttatactgcggtgtgccgatcattattttctgttatgcatactatcatctaagcatcaaaaagcgtataaatcatgaaacgattgaaaaaaagcagacagaggcgcaatag

SEQ ID NO: 9126 - protein, 470 aa, Bacillus subtilis
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 9127 - DNA, 2186 bp, Saccharomyces cerevisiae
  CDS (149)..(2008)
gtggcatctatttcgtcttttctctgaccgtaaaaaaaaagcagaccataaaatagtctgaaattaatacatagaaccaagctgtattataaggtgcctttaccaccgtagctacctaatatagtttctcgataaaaagggcgtaaaaatggacgatagtgtcagtttcattgccaaagaggccagtccagcacaatattcgcacagtttgcatgaaagaacacacagtgaaaaacaaaagagagactttacaataacagaaaaacaagatgaggtatctggacaaacagcggagcctcgaaggacggacagcaaatccatattacagaggaaatgcaaagaattcttcgactcttttaaaaggcagctgccaccagaccgtaattccgaactagagtcccaagaaaaaaacaacctgacaaagtcgatcaaatctcgtcacttagtcatgatcagtctcggtaccggtataggtactggtttactggtcggtaatggtcaggtgctgggaacagctggtcctgccgggttagtccttggttacggaatagcatcgatcatgctttactgtatcatccaagcggcaggcgagttaggtctctgttatgcaggactaaccggcaattacaccagatatccttctattttagtcgacccttcgttgggttttgcagtttctgtggtttacaccattcaatggctaactgttctgcccttacaattggtcactgcggcaatgacagttaagtactggacgagtgtaaatgcagacatctttgttgccgtggttttcgtttttgtaattatcattaatctatttgggtccagaggctatgctgaagccgagttcattttcaattcctgtaagatattgatggtaatcggattcgtcattctggcgattatcatcaattgtggtggtgcaggtgacagaagatacatcggtgctgagtactggcacaatcctggtccatttgcccacggtttcaaaggtgtatgtacggttttctgttatgctgcattcagctacggtggaattgaagttctacttctatctgccgctgagcaggaaaacccaacaaaatctattcccaatgcctgcaaaaaagtggtataccgtattctgctgatttacatgctcaccaccattttggtttgctttcttgttccatacaacagtgacgaattattagggtctagtgactcctctggatcccatgcctccccatttgtcattgctgttgcatcacatggtgtcaaagttgtgcctcactttataaatgctgttattttgatttctgtcatttctgttgcaaactcttcgttatattctgggccaagattgttattatcattggcagaacaaggcgtcttacctaaatgcttagcatatgttgatagaaacggcaggcctttactttgtttttttgtttcccttgtctttggatgcattgggtttgtagccactagtgacgctgaagaacaggttttcacctggttattggcaatttctagtctttcgcaattatttatctggatgtcaatgtccttgtcacatataagatttagagatgccatggcaaagcaaggtcgttcgatgaacgaagttggatacaaagcacaaactggctattggggttcatggcttgcagttttaattgcaatcttcttccttgtgtgccagttctgggtagccatcgcacctgttaatgaacatggaaaacttaacgtcaaagtgtttttccaaaattatttggcaatgcccatcgttttgtttgcctattttggtcacaagatatacttcaaatcatggagcttttggattccagccgaaaaaattgatttggactcacatagaaacatatttgtgtctccatcgcttacagagatcgacaaagttgacgataacgatgatcttaaagagtatgaaaattcagaatcgtcggaaaatccaaacagctcgcgttcaagaaagttttttaagaggatgaccaatttctggtgctaacagcaattccattcattttccgcttggcttcatcgggctttcgttgccactcttcaggataacaaaatatataattgttttttagcattaatgcaagtcgagaaaggacaaatctgcataattaaattaaatttttaagtctgttaagagtagttttatttctactaaaaatctttca

SEQ ID NO: 9128 - protein, 619 aa, Saccharomyces cerevisiae
MDDSVSFIAKEASPAQYSHSLHERTHSEKQKRDFTITEKQDEVSGQTAEPRRTDSKSILQRKCKEFFDSFKRQLPPDRNSELESQEKNNLTKSIKSRHLVMISLGTGIGTGLLVGNGQVLGTAGPAGLVLGYGIASIMLYCIIQAAGELGLCYAGLTGNYTRYPSILVDPSLGFAVSVVYTIQWLTVLPLQLVTAAMTVKYWTSVNADIFVAVVFVFVIIINLFGSRGYAEAEFIFNSCKILMVIGFVILAIIINCGGAGDRRYIGAEYWHNPGPFAHGFKGVCTVFCYAAFSYGGIEVLLLSAAEQENPTKSIPNACKKVVYRILLIYMLTTILVCFLVPYNSDELLGSSDSSGSHASPFVIAVASHGVKVVPHFINAVILISVISVANSSLYSGPRLLLSLAEQGVLPKCLAYVDRNGRPLLCFFVSLVFGCIGFVATSDAEEQVFTWLLAISSLSQLFIWMSMSLSHIRFRDAMAKQGRSMNEVGYKAQTGYWGSWLAVLIAIFFLVCQFWVAIAPVNEHGKLNVKVFFQNYLAMPIVLFAYFGHKIYFKSWSFWIPAEKIDLDSHRNIFVSPSLTEIDKVDDNDDLKEYENSESSENPNSSRSRKFFKRMTNFWC

SEQ ID NO: 9129 - DNA, 2286 bp, Saccharomyces cerevisiae
  CDS (205)..(1983)
ctatttagaaaatatttgagatttcccaccattcactccagttcaaaaggatatattcatatttgtttgtatatacatctgagcattgcgatctaaatagtgtgaagtttttgaggtgactgactttctcaacacgtcgagcacgacatttcccaaaaatagctgaagaacataagctaagcaaattacgcaacacactctcatatgaccgaagactttatttcttctgtcaagcgttcaaatgaggagctgaaggagcgaaaatctaactttggatttgtagaatacaaatccaagcaattaacatcatcctcatcacacaattcaaactcatcgcatcacgatgatgacaaccaacacggcaagaggaatattttccagcgatgtgttgattctttcaagtctcctctggacggctcgttcgacacaagtaatttgaagaggactctgaaaccaaggcacttaatcatgattgccattgggggcagtataggtactggtttgtttgtcggtagtggtaaggcaatcgccgaaggtggtcctcttggtgtcgtcattggttgggctattgcaggctctcaaatcatcgggacgattcatgggctaggtgaaatcacggtgcggtttcccgttgtcggggcctttgccaattacggcacaaggtttttggatccaagtataagttttgttgtttcgaccatatacgtgctacagtggttttttgtattacccttagaaatcattgcggcggcaatgaccgtacagtactggaactcgtctattgaccccgtaatttgggtagccatcttttatgctgttattgtttccataaatttgtttggtgtacgaggttttggggaagcggaatttgcattttccaccataaaagcaataacagtttgcggattcattatattgtgcgttgtcctcatttgcggtggaggtcccgaccacgagttcattggcgccaaatactggcacgaccctggttgtttggccaatgggttcccgggcgttctatctgttcttgttgttgcttcgtattctctcggtggtatagaaatgacgtgcctggcatcaggtgaaacggaccccaaaggcttaccaagtgctatcaagcaagtgttttggaggatcttatttttctttttgatatcactgaccctggtaggattcctggttccatatacaaaccaaaacttactgggtggttcatctgtggacaactcaccttttgtcattgccataaaattgcatcacattaaagccttgccctccatcgtcaatgcggtcatccttatcagtgttttgagtgtaggtaactcctgcatcttcgcttcaagtagaacgttgtgttcgatggcccaccaaggccttattccatggtggtttggttatatcgaccgtgctggtaggccgctggttggcattatggcaaattcactatttggattactagcatttctggtcaaatctggctcgatgtctgaagttttcaattggttaatggccattgccggcctggccacgtgcattgtctggttgagcatcaacctgtcacatatcagatttagactggcgatgaaggctcaagggaagtctctggatgaattagaatttgttagtgctgtcgggatttggggatcagcgtattccgctttaatcaactgtctaatcttgatagctcaattctattgttcactatggcccattggtggctggaccagcggcaaagaaagggctaaaatattttttcaaaattatctgtgtgccttaatcatgttatttatattcatcgtccacaaaatttattacaagtgtcaaacaggcaaatggtggggggttaaggcgttaaaggacatagatttggaaaccgatcgtaaagatatcgacatcgaaatagtcaagcaagaaattgccgaaaagaaaatgtacctagattcccgtccatggtacgtgagacagttccatttctggtgttaataccgaagaaacaagttcaatttatttttgtagaatatttttttttctcttctctagtactcatccttcatatttaattattccagatcatttaatgcataacgacatgtcaataaaaaaaaacctgacattttgaaaaattatcatttgaatacgtggataaagacggcggcgagccaggccgcaataaaattaataatatatatagacattaattcttgacctacacaaaaatagcttctctcggtagccaagttggtttaaggcgcaagactgtaatttatcactacgaaatcttagatc

SEQ ID NO: 9130 - protein, 592 aa, Saccharomyces cerevisiae
MTEDFISSVKRSNEELKERKSNFGFVEYKSKQLTSSSSHNSNSSHHDDDNQHGKRNIFQRCVDSFKSPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVQYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 9131 - DNA, 1404 bp, Bacillus subtilis
  CDS (1)..(1404)
atgaatacaaaccaagataacggaaatcagctccagcggacaatgaaatcacgccatttgttcatgatttcattgggcggagtgatcggaaccggtttcttccttggaaccgggtttaccattaaccaagcgggaccgctcggcgcggttctgtcctatttagtgggcggctttatcatgtttttgaccatgctctgcttaggagagctggcagtcgcctttcctgtgtcggggtccttccagacctatgccacgaaatttatcagcccggccttcgggtttgcgttcggctggctgtactggctcggctgggcggttacatgcgccattgaatttttatcagcggggcagctgatgcaacgctggtttccgcatatagacgtgtggatctggtgtctggtctttgcggcactgatgtttattttaaatgcgatcaccacaaaagcctttgcggaatctgaattctggttctcaggcattaaaattttgattatccttttatttattattctcggcggagctgccatgtttggcctgattgatctgaagggcggagagcaggcgccgtttttgacacatttttatgaagacgggttatttccgaacggcataaaggcaatgctgattacgatgattactgtgaactttgcgtttcaggggactgagctgatcggggttgcagccggagaaagtgaagaccctgaaaaaacgattccgcggtccatcaaacagacagtatggagaacgcttgtgttctttgtgctttcaatcattgtcattgccggcatgattccgtggaaacaggcgggtgtcgtggaaagtccatttgttgccgtatttgagcaaatcggaatcccatatgcagctgatatcatgaactttgttattttaatcgcactgttatctgttgcgaactcaggtttatacgcatcaacacgtattctgtacgcgatggcgaatgaaggacaagccttcaaagcgcttggcaaaacaaatcagcgcggtgtaccgatgtactcgttaatcgtaacgatggctgtggcctgcctatcacttctgacaaagtttgcgcaggctgaaaccgtatatatggtactgttatctttggcgggcatgagcgcgcaggtcggctggattacgatctcgctttcccaaatcatgttcagacgcaaatatatccgtgagggcgggaagatagaagatttgaaatttaaaacaccgctgtacccggtgcttccgctgatcggcctaacgttaaatacggtcgtgctcatcagtcttgcatttgatccggagcagcgtatcgcgctgtattgcggcgtaccgtttatgatcatttgctacatcatttatcatgtcgtcattaaaaaacgccagcaggcaaatcgtcagctagagctttaa

SEQ ID NO: 9132 - protein, 467 aa, Bacillus subtilis
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 9133 - DNA, 2612 bp, Corynebacterium glutamicum
  CDS (1080)..(2471)
agatctaatcctggtttgagttcagagttcacaggtttaagcctacaaaccttagttaaaacatgatggaagcggtcgattaaaaaatgagtgaaaacattcgcggagcccaagcagttggaatcgcaaatatcgccatggacgggaccatcctggacacgtggtacccagaaccccaaattttcaacccggatcagtgggctgaacgctacccattggaagtgggcaccacacgcctcggagcaaacgaactcaccccacggatgctgcagttggtaaaactggaccaagatcgcctcgtcgaacaggtagcagtccgcaccgttatccccgatctgtctcaacctccagtagacgcgcacgatgtttacctgcgcctccacctgctttcccaccgcctggtccgcccccacgaaatgcacatgcaaaacaccttggagctgctgtccgacgtggtgtggacaaacaagggcccttgccttcctgaaaactttgagtgggtgcgtggtgctctgcggtcccgcggactcatccacgtctactgtgtggaccgtcttccccgcatggtcgactatgtggttccccctggagtccgcatctccgaagcagaacgcgtgcgcctaggtgcataccttgctccgggtacctctgtgctgcgtgaaggtttcgtgtctttcaactccggcaccttgggtgccgcaaaggtggaaggccgcctgagttccggtgtggtcatcggtgaaggttccgagattggactgtcttctactattcagtccccgagagatgaacagcgccgccgtttgccgttgagcatcggccaaaactgcaactttggtgtcagctccggaatcatcggagtcagtctgggagacaattgcgacatcggaaataacattgtcttggatggagatacccccatttggttcgcagccgatgaggagttacgcactatcgactccatcgaaggccaagcaaattggtcaatcaagcgtgaatccggcttccatgagccagttgcccgcctcaaagcttgacccattttcataaccagtgccatgtgggtttacggttgatacatggctaaatctaatgaagggctgggaaccggacttcggacccgccacctcacaatgatgggactcggctccgcaattggtgccggactgttcctcggcaccggcgttggtatccgcgcagccggccccgcagtgctcctggcgtacatcatcgccggagccatcgttgtgcttgttatgcaaatgctcggcgagatggctgctgcccgtcccgcctccggatcgttttcacgttacggcgaggatgctttcggccactgggctggtttctccctcggttggttgtactggttcatgctgattatggtgatgggcgccgaaatgactggcgctgctgccatcatgggtgcatggttcggcgtcgaaccgtggattccttcgcttgtctgcgtggtcttcttcgctgtggtgaacctcgtcgcggttcgcggtttcggtgaattcgagtactggttcgcattcattaaggtcgcggtgatcatcgctttcctcatcattggtattgctcttattttcggatggcttcccggatccacctttgttggaacctcaaacttcatcggtgatcacggattcatgcccaatggtatttctggtgttgctgctggtttgctcgcggtggcttttgcctttggtggcattgaaattgtcaccattgcagctgcagagtccgataagccacgtgaagctatttccctggcggtgcgtgccgtgatttggcgtatttcagtcttttacttgggctctgttttggtcatcactttcctcatgccttatgagtcgatcaatggtgccgacaccgctgcggaatcccccttcacccaaatcctggcgatggcaaacatccctggcacggttggtttcatggaagcgatcatcgttctagcactgctttccgctttcaacgcccaaatctatgccacttctcgtttggtattttccatggcgaatcgacaagacgctccgcgagttttcagtaagctcagcaccagccacgtccccaccaatgcggtgctgttgtccatgttcttcgccttcgtttcagttggtttgcagtactggaatccagccggtctgcttgatttcctcctcaacgctgttggcggttgtttgattgtggtgtgggcaatgatcactttgtcacagttgaaactccgcaaagaactgcaagcaaacgatgaaatctccacggttcgcatgtgggcgcacccatggttaggcatcctcaccttggttttgttggcaggactcgttgctctcatgctcggcgacgcagcctcccgcagccaggtttactcagtggcaattgtgtacggattcttggttcttttgtccttcgtcacagttaacagcccattgcgcggaggtcgcaccccttccgacttgaactgataggccgatagaaattattctggacgtcatgactactgcttccgcaaccggaattgcaacactgacctccaccggcgacgtcctggacgtgtggtatccagaaatcgggtccaccgaccagtccgcgctcacacctctaga

SEQ ID NO: 9134 - protein, 463 aa, Corynebacterium glutamicum
MAKSNEGLGTGLRTRHLTMMGLGSAIGAGLFLGTGVGIRAAGPAVLLAYIIAGAIVVLVMQMLGEMAAARPASGSFSRYGEDAFGHWAGFSLGWLYWFMLIMVMGAEMTGAAAIMGAWFGVEPWIPSLVCVVFFAVVNLVAVRGFGEFEYWFAFIKVAVIIAFLIIGIALIFGWLPGSTFVGTSNFIGDHGFMPNGISGVAAGLLAVAFAFGGIEIVTIAAAESDKPREAISLAVRAVIWRISVFYLGSVLVITFLMPYESINGADTAAESPFTQILAMANIPGTVGFMEAIIVLALLSAFNAQIYATSRLVFSMANRQDAPRVFSKLSTSHVPTNAVLLSMFFAFVSVGLQYWNPAGLLDFLLNAVGGCLIVVWAMITLSQLKLRKELQANDEISTVRMWAHPWLGILTLVLLAGLVALMLGDAASRSQVYSVAIVYGFLVLLSFVTVNSPLRGGRTPSDLN

SEQ ID NO: 9135 - DNA, 1677 bp, Saccharomyces cerevisiae
  CDS (1)..(1677)
atggcagtccttaacttgaaacgtgaaactgtcgacattgaagagacagcgaagaaagatatcaaaccttattttgcttcgaatgttgaagcggttgatattgatgaagatcccgatgtttcaagatacgatccccagacaggagtgaaaagggcgctcaaaaataggcatatctcattgctagctttgggtggtgttattggcccaggttgtcttgttggtgcaggaaacgcactcaacaaaggtgggccacttgctttacttttaggctttagtattattgggatcattgctttctcagtgatggaatctataggtgaaatgatcactttatatccctcgggcggtggatttaccactttggctcgaagatttcatagcgatgcactgcctgcagtttgcggttatgcttacgttgttgtgttcttcgcagttttggcaaatgagtacaacactctctcctccatactacagttttggggcccacaagtccctctatatggttacatcttgatattctggtttgcatttgaaatttttcaactagttggcgttggtctttttggtgaaacggagtactggcttgcttggttgaaaatagtaggattagtagcctattatattttctcgattgtttacatatctggggatattaggaatagaccagctttcggctttcattattggaatagtccaggtgcattatcacatgggtttaagggaattgcgatagtgtttgtgttttgttcgaccttctattctggaacggaatcagttgccttggctgcaacggaatcaaaaaaccctgggaaggctgtgccacttgctgttcgacaaactctgtggagaattttagttgtttatattggaattgctgttttctatggagcaactgttccgtttgacgacccaaacctctctgcttctaccaaagtcctaaaatctcccattgctatcgccatatctcgtgctggttgggccggcggagctcatctggttaatgccttcattttgataacttgcatctccgccattaatgggtcactttatatagggagcagaaccttgacgcatttagcacatgaaggcctagctccaaaaattctggcttggaccgatcgaagaggcgttcccatccccgccatcactgttttcaacgccttgggcctaatatcattgatgaatgtgagcgttggagctgcaaatgcgtactcttatatcgttaatctttctggtgttggcgtctttattgtctggggtgtaataagttatacgcacctgagaataaggaaggcgtgggttgctcaaggaagatccatagaagagctaccttatgaagcgctattttatccgtggacgccagtacttagtctggccgctaacatttttctagcactcatccaaggatggagctatttcgtaccttttgatgcgggcaattttgttgatgcttatatccttctgcctgttggaattttattgtatattggcatatgtgtttttaagagcaatcattttagaactgttgatttgcggtcaatcaacctagacgaaggacgaagaaaagacatggaggctgatctttctgatcaagagagtagcttagcatcttcggaaacgatgaaggattataaaagtgcaacttttttcagatacctcagcaacattttcacctga

SEQ ID NO: 9136 - protein, 558 aa, Saccharomyces cerevisiae
MAVLNLKRETVDIEETAKKDIKPYFASNVEAVDIDEDPDVSRYDPQTGVKRALKNRHISLLALGGVIGPGCLVGAGNALNKGGPLALLLGFSIIGIIAFSVMESIGEMITLYPSGGGFTTLARRFHSDALPAVCGYAYVVVFFAVLANEYNTLSSILQFWGPQVPLYGYILIFWFAFEIFQLVGVGLFGETEYWLAWLKIVGLVAYYIFSIVYISGDIRNRPAFGFHYWNSPGALSHGFKGIAIVFVFCSTFYSGTESVALAATESKNPGKAVPLAVRQTLWRILVVYIGIAVFYGATVPFDDPNLSASTKVLKSPIAIAISRAGWAGGAHLVNAFILITCISAINGSLYIGSRTLTHLAHEGLAPKILAWTDRRGVPIPAITVFNALGLISLMNVSVGAANAYSYIVNLSGVGVFIVWGVISYTHLRIRKAWVAQGRSIEELPYEALFYPWTPVLSLAANIFLALIQGWSYFVPFDAGNFVDAYILLPVGILLYIGICVFKSNHFRTVDLRSINLDEGRRKDMEADLSDQESSLASSETMKDYKSATFFRYLSNIFT

SEQ ID NO: 9137 - DNA, 1722 bp, Saccharomyces cerevisiae
  CDS (1)..(1722)
atggatgaaactgtgaacatacaaatgtccaaggaaggtcagtatgaaatcaattctagctctataataaaagaggaggagtttgtagatgaacaatattctggggagaacgttacgaaggccatcaccacagagagaaaagtcgaggatgatgctgctaaggaaacagagagctcaccacaagaaagaagagaggtgaagcggaagttaaagcagcggcatatagggatgattgctctcggcggcaccattgggacgggcctcataattggtattggtccgccattggcacacgccggccctgttggtgccttgatatcgtatttatttatggggacagtgatttactccgttacacaatcgttaggagagatggtcacttttatcccggttacatcttcattttctgtcttcgcccaaagatttctgtcgccagcgctgggagcgactaacggatatatgtactggctgtcgtggtgtttcaccttcgcactggaactatccgttttggggaaagttattcagtactggacagaagcagtgcctctagcggcttggatcgtgatcttttggtgcctgttaacttcaatgaacatgtttcccgtaaagtattacggagaatttgagttttgtattgcctccataaaggtcatcgcgttgctcggttttatcattttctcattctgtgttgtgtgtggtgcgggacaatctgatggacccatcggtttcaggtactggagaaatccaggagcctgggggcctggcattatctccagtgataaaaatgagggccgttttctcggatgggtttcctctttgattaatgctgcatttacgtaccaaggtactgaactggttgggataaccgctggtgaagcggctaacccaagaaaagctctcccgagggcaataaagaaagttgtagtgaggattctagtcttttacattctttcactatttttcattggccttttggtcccatataatgacccaaagttggatagtgacggtatatttgtctcttcatcgccctttatgataagcattgagaattcaggcacaaaagttctcccagatatatttaacgcggtcgtgctaatcaccattctttccgcaggtaactctaatgtgtacattggctcaagagtactgtatagtctgtctaaaaatagcttggcgccaaggttcttgtctaacgtgaccagaggtggtgttccatacttttctgttctatctacatccgtgttcggatttttggctttcttagaggtttctgcaggcagcggcaaggcctttaactggttattgaacataactggtgtggccggtttctttgcctggcttttgatttcattttctcatatccgtttcatgcaagccataaggaaacgtggtatatcgagggatgacttaccttataaagctcaaatgatgccttttttggcatattatgcatcttttttcatcgctctaattgttctgatccagggcttcaccgctttcgcacctacttttcagcctatagactttgtcgctgcatatatatcaatattcctatttttggccatatggttatcattccaagtttggtttaagtgccgcttactctggaagctgcaggatatcgatatcgattctgaccgccggcaaatagaggagttggtatggatagagccagaatgtaaaacaaggtggcaacgagtttgggatgtcctttcataa

SEQ ID NO: 9138 - protein, 573 aa, Saccharomyces cerevisiae
MDETVNIQMSKEGQYEINSSSIIKEEEFVDEQYSGENVTKAITTERKVEDDAAKETESSPQERREVKRKLKQRHIGMIALGGTIGTGLIIGIGPPLAHAGPVGALISYLFMGTVIYSVTQSLGEMVTFIPVTSSFSVFAQRFLSPALGATNGYMYWLSWCFTFALELSVLGKVIQYWTEAVPLAAWIVIFWCLLTSMNMFPVKYYGEFEFCIASIKVIALLGFIIFSFCVVCGAGQSDGPIGFRYWRNPGAWGPGIISSDKNEGRFLGWVSSLINAAFTYQGTELVGITAGEAANPRKALPRAIKKVVVRILVFYILSLFFIGLLVPYNDPKLDSDGIFVSSSPFMISIENSGTKVLPDIFNAVVLITILSAGNSNVYIGSRVLYSLSKNSLAPRFLSNVTRGGVPYFSVLSTSVFGFLAFLEVSAGSGKAFNWLLNITGVAGFFAWLLISFSHIRFMQAIRKRGISRDDLPYKAQMMPFLAYYASFFIALIVLIQGFTAFAPTFQPIDFVAAYISIFLFLAIWLSFQVWFKCRLLWKLQDIDIDSDRRQIEELVWIEPECKTRWQRVWDVLS

SEQ ID NO: 9139 - DNA, 2574 bp, Saccharomyces cerevisiae
  CDS (501)..(2327)
gctaggcggtgatgcatttccgcacagggaccagaggaagcttcccaggcggtgacagtaagtgaactcattatcatgtcttctccaaaacattcgtgacatctagtcatgctcctcgcaattcactccgattggtatagctttttcggtagttttagctactatgcttaggggaaagaggagaaaccgtaccgtcagtctcagtcaaaaaattttgatattcaatctgatagcaaagttggaacttggggttatctggcccttttttgttatcatattcgtatacccaacaacatatcggttccaccggtcctttttatatataaaagacgatgtgtagatgcactcgagtattcttggagaacgtaacttgtattgagctagagtgctggataaagtaccacatactaacgttcttttatagagccaaacataattcttttgcactttcaatataaggtacaagtgaaacacaggaaaaaaagaactaactctaagtaatgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcctgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctagatgcctttttaatcaaagccttagggcaacatgaaactatattcatccaatcaaaaaaatgagcacaagaatttctctttgatcatttttcttttacctttaataacaatcgttatcaacattttttatttccagtcctaccacagcattattgcataattaatttacaggaagattttcttgaaaaaatagaaagaaaaatacccattttttcaaggaaaataaaatttatatattacatacattt

SEQ ID NO: 9140 - protein, 608 aa, Saccharomyces cerevisiae
MKMPLKKMFTSTSPRNSSSLDSDHDAYYSKQNPDNFPVKEQEIYNIDLEENNVSSRSSTSTSPSARDDSFAVPDGKDENTRLRKDLKARHISMIAIGGSLGTGLLIGTGTALLTGGPVAMLIAYAFVGLLVFYTMACLGEMASYIPLDGFTSYASRYVDPALGFAIGYTYLFKYFILPPNQLTAAALVIQYWISRDRVNPGVWITIFLVVIVAINVVGVKFFGEFEFWLSSFKVMVMLGLILLLFIIMLGGGPNHDRLGFRYWRDPGAFKEYSTAITGGKGKFVSFVAVFVYSLFSYTGIELTGIVCSEAENPRKSVPKAIKLTVYRIIVFYLCTVFLLGMCVAYNDPRLLSTKGKSMSAAASPFVVAIQNSGIEVLPHIFNACVLVFVFSACNSDLYVSSRNLYALAIDGKAPKIFAKTSRWGVPYNALILSVLFCGLAYMNVSSGSAKIFNYFVNVVSMFGILSWITILIVYIYFDKACRAQGIDKSKFAYVAPGQRYGAYFALFFCILIALIKNFTVFLGHKFDYKTFITGYIGLPVYIISWAGYKLIYKTKVIKSTDVDLYTFKEIYDREEEEGRMKDQEKEERLKSNGKNMEWFYEKFLGNIF

SEQ ID NO: 9141 - DNA, 3326 bp, Saccharomyces cerevisiae
  CDS (1007)..(2890)
gattgaagggtgtaaagtgcgtgtggtggcgttctttccaaaaatattatcgtctttcctttttttttctttttttttttttcaatagtaatagtatttcctagtgatctcggcgattttccttgatttctccaaaagcgtttttacccggacgatatgaatccatctattaaacatcataacatcatattatttttttctgtgcttctaaaacggagatcaaataccgggcccgcgcgcgatggccggatgtccgtccatactgcaatgtgaattcccgcgcggttcaaatcttgtcacaagtttgtcaaaattgcttgtcatgtctgccaaatctccagggtcctaaatctgaggtagcacggcacggcacaagatggtacccatggtgcgtgacgacagccgctacttgcacggctttgttccggcagcccgggtacccgcgctgcgagttgaaacatcatcaaaccaaaagggaagcgacgttagtttttttcattgcgctagctatgacgtttgggtggcctagccggttcgcgtgtgcctgtcgcttttgtcgcttttcaacttctgcccgatatttcctatcaaaggaaaatgggacgttttcaacccctcgctatcatcgtgcctgcactctgcctatcgccaactacaccggggttttatctgcttcacccctccatccagtgctgataacaagaagaaccttgcagggtagggcaggacctacggccaaaatactaattatgtctgtttatgtacatgccccaatctgaatattccatgaatgtaggcacagcatatctccatccatgtactgatacagacgcataaacatatatgtatatacatacttatacactcgaatatttgtagactgatgtacttctatatatatatagggggtttgtgttcctcttcctttcctttttttttctctcttcccttccagtttcttttattctttgctgtttcgaagaatcacaccatcaatgaataaatcatggtaaatatactgcccttccacaagaacaatagacacagcgcgggagtcgtcacctgcgcggacgatgttagcggcgacggtagcggcggcgacaccaagaaggaggaggatgttgtccaggtaacggaatcaccatcgtccgggtcgcgcaataatcatcgcagcgacaatgaaaaagatgacgccatccgtatggagaaaatatctaagaaccagtccgcgtcgtccaacggcaccatccgcgaggatttgattatggacgtggacttggagaaatcgccctccgtcgatggcgatagcgagccgcacaaactaaaacaaggtttgcagtcgcgccatgtgcaactgatcgcgctgggcggcgccatcggtaccggtttgctggtggggacttcatccacgcttcatacgtgcggtcccgcggggctgttcatatcgtacattattatttccgcggtgatctacccgatcatgtgcgcgctgggcgaaatggtgtgctttttgcccggtgatggttctgacagtgccgggtcgacggccaatctggtcactaggtacgttgacccttcgttgggcttcgccactgggtggaattacttctactgctacgtcattttagtggccgccgagtgtacggcggcatccggtgtggtcgaatactggaccaccgcggttcccaagggcgtttggatcacgatctttctatgcgtggttgttatactaaacttttccgcggtcaaagtgtacggcgaatccgagttttggttcgcgtctatcaagatattatgcattgtgggactgatcattctgtcctttattttgttttggggtggtggccccaaccatgaccgtcttggcttcagatactggcaacatccgggcgcttttgcgcatcacctcacgggcggatcgctgggtaacttcacagatatctacactgggattatcaagggcgccttcgccttcattcttggtccggaactggtgtgcatgacttccgcggaatgcgcggaccagcgtagaaatatcgctaaggcttcgcgccgctttgtatggagactgatcttcttctacgttctggggacgctggccatctccgttattgttccatacaatgacccaacattggtaaatgcgctggcgcagggcaaaccgggagccggctcgtcaccctttgtgatcggaattcaaaacgccgggattaaggttcttccccacattatcaatgggtgtatcttgaccagcgcgtggtctgccgccaatgcgtttatgtttgcgagcacgagatcactgttgaccatggcgcaaacgggacaggcacccaaatgtttgggcagaatcaacaaatggggtgttccatacgtggctgtgggtgtttccttcttgtgttcttgtttggcatatctgaacgtgtcttcatccacggcagacgtgtttaattggttttccaatatcagcaccatttccgggtttctgggctggatgtgcggctgcatcgcgtacctgagattccgcaaggctattttctacaatggcctctacgacagattgcctttcaagacgtggggacagccttacaccgtgtggttctctctcattgttataggcatcatcaccattaccaacgggtatgccattttcatccctaagtactggagagtagcagatttcattgctgcctacatcaccctacccatcttcctggttttgtggttcggccataagctgtatactcggacgtggagacaatggtggctccctgtgtccgagatcgatgttactacagggttagtcgagatcgaggagaaatcaagagaaattgaggagatgagattaccccccaccggtttcaaagacaagttcttggacgccttgttgtaacgcttttatgaacatattccgatatctctcacgatactaatattcgaaaaatctttctccttcgccgcgatggatggaagtaaaaacacatatataaaagtataaaatgaatgctggcgtattcttacatacaagagatttgtaaaaagtcaatgaaaagttctccacacgtgtttttctcttttactttttttttcttccttttggtttccttttttctttctcgtcgcttttatttagcgacgcagcataggaaacaggggtaaagtgtcataactttttagagaaaatgatatatcattaatatgcacacgtttatataaatggagaaagaaaacaaagaacataaaacattttgaagcagagcggtgaaacgcaactatattttactttcatcctctacgtccattgtaagattacaacaaaagcactatcg

SEQ ID NO: 9142 - protein, 627 aa, Saccharomyces cerevisiae
MVNILPFHKNNRHSAGVVTCADDVSGDGSGGDTKKEEDVVQVTESPSSGSRNNHRSDNEKDDAIRMEKISKNQSASSNGTIREDLIMDVDLEKSPSVDGDSEPHKLKQGLQSRHVQLIALGGAIGTGLLVGTSSTLHTCGPAGLFISYIIISAVIYPIMCALGEMVCFLPGDGSDSAGSTANLVTRYVDPSLGFATGWNYFYCYVILVAAECTAASGVVEYWTTAVPKGVWITIFLCVVVILNFSAVKVYGESEFWFASIKILCIVGLIILSFILFWGGGPNHDRLGFRYWQHPGAFAHHLTGGSLGNFTDIYTGIIKGAFAFILGPELVCMTSAECADQRRNIAKASRRFVWRLIFFYVLGTLAISVIVPYNDPTLVNALAQGKPGAGSSPFVIGIQNAGIKVLPHIINGCILTSAWSAANAFMFASTRSLLTMAQTGQAPKCLGRINKWGVPYVAVGVSFLCSCLAYLNVSSSTADVFNWFSNISTISGFLGWMCGCIAYLRFRKAIFYNGLYDRLPFKTWGQPYTVWFSLIVIGIITITNGYAIFIPKYWRVADFIAAYITLPIFLVLWFGHKLYTRTWRQWWLPVSEIDVTTGLVEIEEKSREIEEMRLPPTGFKDKFLDALL

SEQ ID NO: 9143 - DNA, 1992 bp, Saccharomyces cerevisiae
  CDS (1)..(1992)
atgacgcttggtaatagacgccatgggcggaataatgagggaagctctaatatgaatatgaatcgtaacgaccttgacgatgtttcccattacgagatgaaggaaatacaaccaaaggaaaaacaaattggctctatagaaccggaaaatgaagtagaatattttgaaaaaacagtggaaaaaaccattgaaaatatggaatatgaaggtgaacatcatgcatcttacttacggaggttcattgactcgtttagaagagcggaaggctcgcatgcaaattccccagactcgagcaactctaatgggactactcctatatccacaaaagattccagctctcaattggacaatgagttgaatcggaagagctcatacatcactgttgatggtattaaacagtcaccacaagaacaagaacagaaacaagaaaatttgaaaaagagtataaagccccgtcatacggtgatgatgtccctagggactggtattggtactggtttgctggtcggtaactccaaagttttgaacaatgcaggtccgggtggtttgatcattggttatgctattatgggtagttgtgtttactgtattattcaagcttgtggtgaattagcggttatatacagtgatttgattggtggatttaatacatatcctttgtttttggtcgaccctgcacttggcttttctgttgcttggcttttttgcttacaatggctatgtgtttgtcctctagaattggtcactgcatccatgactatcaaatattggacgacatctgtgaacccggatgttttcgttgttatcttctacgtactaatcgttgttatcaacgtttttggagctaagggttatgcagaggcagatttcttcttcaattgttgtaaaattctgatgatagttggatttttcattctcgccattattattgattgtggtggtgcaggtaccgatggttacataggtagcaaatattggcgtgatcccggagccttccgtggtgatacacccatccagaggttcaaaggtgtcgttgccacatttgtcacagcagcgttcgcctttggtatgagtgaacagctggctatgactgccagtgaacaatccaatccaagaaaggctattccatcggcggcaaagaaaatgatttatagaattctgtttgtgttcttggcgtctttaacgttagttggtttccttgtaccttacacctcagatcaattgctaggggccgcaggttcagccactaaagcgtcgccctacgtcatcgctgtctcctctcatggtgttcgtgtggttcctcatttcataaacgctgtcatcctgttgtctgttctttccgttgctaacggtgccttctataccagttctcgtattttgatgtcgttggccaaacaaggtaatgcacccaaatgtttcgattacatcgatagggaaggtagacctgctgctgctatgcttgtcagtgcattatttggtgtcattgcattctgtgcctcatctaaaaaggaagaggacgttttcacctggttgttagcaatctccggtttgtctcaattattcacgtggattaccatttgtttgtctcacattaggtttagaagagctatgaaagtgcaaggaaggtccttaggagaggttggttataaatctcaagtcggtgtctgggggtcggcttacgctgtccttatgatggtgttagctttaatcgcccaattttgggttgccattgccccaattggtggaggaggtaagttaagtgcccaatcattttttgagaattatttggctatgccaatctggattgctttatacatcttttacaaagtttggaaaaaagattggagtttattcattcccgctgataaagtagacttagtttctcatagaaacatctttgatgaagaattattaaaacaagaagatgaagaatataaagagagattaagaaacggaccatactggaaaagagttcttgatttctggtgttaa

SEQ ID NO: 9144 - protein, 663 aa, Saccharomyces cerevisiae
MTLGNRRHGRNNEGSSNMNMNRNDLDDVSHYEMKEIQPKEKQIGSIEPENEVEYFEKTVEKTIENMEYEGEHHASYLRRFIDSFRRAEGSHANSPDSSNSNGTTPISTKDSSSQLDNELNRKSSYITVDGIKQSPQEQEQKQENLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIVGFFILAIIIDCGGAGTDGYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAAAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPIWIALYIFYKVWKKDWSLFIPADKVDLVSHRNIFDEELLKQEDEEYKERLRNGPYWKRVLDFWC

SEQ ID NO: 9145 - DNA, 1497 bp, Mycobacterium leprae
  CDS (1)..(1497)
atggccacactggctgagagccccgaaccaaaatccggcgcgtcgagagctggtgtcctcggcgaggaggctggttaccacaaggggctcaaacctcgacaactgcagatgatcgggatcggcggcgcgatcggtaccgggttgttcctcggcgccggcggccggctggccaaggccgggcccggattgttcctggtgtatgccgtctgcggggtgttcgtcttcctgatactgcgcgcactgggcgagctggtgctgcatcgtccttcatcgggatccttcgtgtcttacgcacgtgagttcttcggcgagaaagccgcctacgtcgtcggctggttgtacttcctggactgggcgatgacagcgatcgtggacaccactgccatcgccacctacctgcatcgctggacaatcttcacggcgttgccacaatggactcttgcgctgctcgccctggcggtggtgttggtaatgaacctgatctccgtggaatggttcggcgagctcgaattttgggccgcgctgatcaaggtttgcgcgctgatggcatttttggtcgtaggaactatcttcctcggcgggcgttacccggtcgacgggcacaacactgggttaagcctctggactagtcacggcggattgttccccaccggcgtagcgcagctaatagttgtcagctccggagtgatgttcgcctacgctgccgtcgaactggtcggcaccgcagcaggtgaaaccgtcgagccgaaaaaaatcatgccgcgagcgatcaactcggtaatcgctcgcatcgcgatcttctacgtcggatcggtgattctgctggcattgttgctgccctacagcgcattcaaggccagcgaaagcccgttcgtcacgttcttctccaaggttgggttctacggcgccggcgatctgatgaacatcgtagtgctcaccgccgcgctgtccagcctcaacgccggactgtacgcaaccggccgtgtcatgcactcgatcgcgataaatggtagcggaccgaagttcaccgcgcgaatgtcgaaaaatggtgtgccatatggcggaattcttttagccgccgtcatctgcctgtgcggtgtcgcactaaacgccttcaaccccggtcaagccttcgagatcgtgctcagcgtcgccgcactgggcatcatcgccgggtggggaacaatcgtactgtgccagcttcgactacacaagatggccaaagccgggatcatgcgccgaccccgctttcgcatgccgctggccccatacagtggctacctcactttggccttcttgttcgcggtactggttgtgatggcgttcgacaaaccgatcggcacctggacagtagcgtcactgatcgttatcgtcccagccttgattgcaggctggtactcaatacgcaagcgcgtgatgaccatcgcccgtgaaagaatgggctataccggacctttcccggcgatcgccaacccaccggtgaaatcctcagactga

SEQ ID NO: 9146 - protein, 498 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVKSSD

SEQ ID NO: 9147 - DNA, 1566 bp, Schizosaccharomyces pombe
  CDS (1)..(1566)
atgagtagcattaaaagtaaaacgatcatcgaaccctctgaaaatgacatagagaaaggagaggtcgacttcgtaagctcttcaatctctaactttgaagaagcatacgaggaaggcccttctctaaaacgagagtttaagtcgcgacatgtaaacatgatttctgtagctggtgccatcggcactggcttggttattggctcaggctcggcattgctgaaaggcggaccaggaagccttttcattgcatatttaatgaccggaataaatttgtatgtcgtacttatttctttaggagaaatggctgccttttcttcagatgacaaaggtttcagtggcttttcaagccgttatgtggacaaagctttaggatttgcaacaggatggaattatttcttcaaatacgctatcgtctacccgacaaatttaacggcagttggtattgtgatacattactggcgaccagatcttaacgtaggtatttgggtagccgtttttctagtggtgattttagcaataaacttattgcatgttaaatattttggcgaagttgaattttggctgtcagcagtgaaaattttagttttggtgactttaattattacttgtattgtgattacctctggaggaacacctgtgcatcacaaaattggattccattactggcgagatccaggtgctttcgcaccttacttagtagaggggtctactggaaggtttttggggttttgggcttgtctagttcagtcatgtttcgcttatgttggatctgaggttgtaggcattgcatttggggaggcaccgaatccagaaaaaactatccgaaaatcttcatttcaatctttgtttcgtattgcaaccttctatgttattggtgtgtttgtattaggactctgtgtcccatacgatagcgatattttgtcaagcaatgcttcaaaaggtaatgccgctgcatccccctttgtagtagctatcaaactggctcaaataaaagttatgcctgatgttatcaatgcctgtcttcttgtgtttattattagttccgccaattctgatatttatattggatccaggactttgtatgctttagcaaaagaaggatatgcccccaaaattctgatgcttcaaacaaagcagggaataccatgggttggatgcttagtaacgtcttcctttggccttcttgcgtttatgaacactaaaagctcttctgcaacgatctttggatatttcagtagcgcagttactgtattcggtaccatcaactggataaacatccttttatcttacatatgctatcacagagcaaccattgttcaacaaattcccacagaacgtattccttttcgtagctggggtcaaccatatatagcttatgcttcattaatattcactggtttgattacgttttttaacggatacaatgctttcattcacggatttaagtatagatcatttattacttcttatataggcattgctgcctatgtgattatgattttaggatggaagttcacattcaaggcgaagcgcgtaacatcatctactgttgattttagaaagtga

SEQ ID NO: 9148 - protein, 521 aa, Schizosaccharomyces pombe
MSSIKSKTIIEPSENDIEKGEVDFVSSSISNFEEAYEEGPSLKREFKSRHVNMISVAGAIGTGLVIGSGSALLKGGPGSLFIAYLMTGINLYVVLISLGEMAAFSSDDKGFSGFSSRYVDKALGFATGWNYFFKYAIVYPTNLTAVGIVIHYWRPDLNVGIWVAVFLVVILAINLLHVKYFGEVEFWLSAVKILVLVTLIITCIVITSGGTPVHHKIGFHYWRDPGAFAPYLVEGSTGRFLGFWACLVQSCFAYVGSEVVGIAFGEAPNPEKTIRKSSFQSLFRIATFYVIGVFVLGLCVPYDSDILSSNASKGNAAASPFVVAIKLAQIKVMPDVINACLLVFIISSANSDIYIGSRTLYALAKEGYAPKILMLQTKQGIPWVGCLVTSSFGLLAFMNTKSSSATIFGYFSSAVTVFGTINWINILLSYICYHRATIVQQIPTERIPFRSWGQPYIAYASLIFTGLITFFNGYNAFIHGFKYRSFITSYIGIAAYVIMILGWKFTFKAKRVTSSTVDFRK

SEQ ID NO: 9149 - DNA, 1470 bp, Streptomyces coelicolor
  CDS (1)..(1470)
atgagcaaggacgccgtcgacacggcacaggtcgccgcccatccccaggcgaccgggaccatccccgcggacgcgggcgacgccggttacagcaaggacctcaaggcccgtcacgtcaacatgatcgccatcggcggcgcgatcggcaccggcctcttcctcggcgccggcgggcggctgcgcgacgccggaccggcgctcgccatcgcctacctcgtcgccggcgtcttcgccttcttcgtcgtcaaggcactgggcgagctggtgctgtaccggccctcctccggatccttcgtgtcgtacgcgcgcgagttcctcggtgagaagggcgcctacgtcgccggctggatgtacttcctgaactggtccacgaccggtatcgccgacatcaccgcgatcgcgctgtacacgcactactggagcatgttcacgagcatcccccaatgggtgctcgccctcgtcgccctcgcggtggtcctggccgtgaacctgatctcggtgaagatcttcggcgagatggagttctggttcgcgatcgtcaaggtcgccaccctcgtcggcttcatgctgatcggaatcttcctgctcgccacccagcacgaggtgagcgggcagaccccgggcatgggcatgatcaccgaccacggcggcatcctcccgcacggtgtgatgcccgtggtcctcgtcatgcagggcgtgatcttctcctacgcggccctcgaactggtcggcgtcgccgccggcgagaccgccgagccgcacaagatcgttcctcgtgcggtgaactcgatcatgtggcgggtggccctgttctacgtcggctcggtcgtgctcctggccctgctgctgccgagttcgctctactcgggcgacgagagccccttcgtcacggtgctgtcggggatcggtgtgccggccgccggtgacgtgatgaacctcgtcgtcctcaccgccgcgatgtcgtcgctgaactccggcctgtactccaccggccgcatcctgcgttccatggcgatggccggctccgcgcccaggttcaccggcgtgatgagccgcagtcaggtcccctacggcggcatcctgctgacctgcgcggtctgcgtcctcggtgtcggactgaactacctggtgccgagcaaggccttcgagatcgtgctgaacgtcgcctcgctgggcatcatcagcacgtgggtgatcatcatgatctgccacctggtgttcgtccgccgggcgcgtgcgggcctggtcgaacggccgggcttccggctgcccggcagccccgtcacggagatcgtcaccatcgccttcctgctggcggtcgtcggcctgatgtggaacgacgaggaggtcggccgcaagaccgtgctgctggtgcccgtgatcgcggtgatgctggtggccggctggttcggcgtccggcgccgggtcgcgcaccaggccgggcaggaacggccggcgccgagggagtag

SEQ ID NO: 9150 - protein, 489 aa, Streptomyces coelicolor
MSKDAVDTAQVAAHPQATGTIPADAGDAGYSKDLKARHVNMIAIGGAIGTGLFLGAGGRLRDAGPALAIAYLVAGVFAFFVVKALGELVLYRPSSGSFVSYAREFLGEKGAYVAGWMYFLNWSTTGIADITAIALYTHYWSMFTSIPQWVLALVALAVVLAVNLISVKIFGEMEFWFAIVKVATLVGFMLIGIFLLATQHEVSGQTPGMGMITDHGGILPHGVMPVVLVMQGVIFSYAALELVGVAAGETAEPHKIVPRAVNSIMWRVALFYVGSVVLLALLLPSSLYSGDESPFVTVLSGIGVPAAGDVMNLVVLTAAMSSLNSGLYSTGRILRSMAMAGSAPRFTGVMSRSQVPYGGILLTCAVCVLGVGLNYLVPSKAFEIVLNVASLGIISTWVIIMICHLVFVRRARAGLVERPGFRLPGSPVTEIVTIAFLLAVVGLMWNDEEVGRKTVLLVPVIAVMLVAGWFGVRRRVAHQAGQERPAPRE

SEQ ID NO: 9151 - DNA, 1428 bp, Streptomyces coelicolor
  CDS (1)..(1428)
atgacctctgcgcaggtcgacacggacaaggcccccgaagagggctacgagcgcggtctcaacagccgccaggtccagatgatcgcgatcggcggcgccatcggcgtcggtctcttcctgggcgccggggccaacatcgccaaggccggccccagcatcatcctcatgtacgccctcgcgggtgtgatcatcttcttcatcatgcgggcgctcggcgagctgctcctctaccgacccgtctccggttccttcgccgagtactcgcgcgagttcctcggccccttcttcggttacttcaccggctggacgtactggctgatgtgggtggtcaccggcatggcggaactcaccgccgccgccatctacatccactactggttcccggacatcccgcaatgggtctcggccctggtcttcctggtcctgctgttcgtggccaacctgatctcggtgaagctgttcggcgagatcgagttctggttctcgatggtcaaggtcaccgccatcatcggcatgatcgtgatcggcgtcggggtgctcaccctcggcttcagccaggccggcgacaccgccgccgtctccaacctgtgggagttcgacggcttcttccccaagggcatcggctcgtccctgatgaccctccagggcgtcatgttcgcctacctcgccgtagagctggtcggcgtcaccgccggtgagtccgagaacccggagaagaccctccccaaggcgatcaacaccctgccctggcgcatcgccctcttctacgtcggcgccctcaccgtcatcctggcggtggtcaagtggaccgagttcgccgagggcgtcagccccttcgtggaggccttcgcggtcatcggcatcccggccggcgcgggcatcgtcaacttcgtggtgctcaccgccgccctgtcctcctgcaactccggcatgtactccacgggccggatgctgcgcaccctcgcggacaacggcgaggcgcccaggatcttcaacaagctgtcctcgacgaagaccccggccatcggcatcgccgtctcggtggtcttcatggccatcggcgtggtcctgaactacctcgtcccggagaaggccttcggctacgtcacctccgtcgccaccgccgccggcatctggacctggctgatgatcctgatcagccacgtgcgctaccgccgcaaggtcgtcgcgggccgcctgcccgcctcctccttcccggcgcccggcggctcggtgtgctcctacatcgccatcgccttcctcctcttcgtcacctgcctcatcgcctacgacgccgacgcccgcgtctgcctgtacgtgatggccggctgggccgccgccctcggtatcggctgggcggtgctcaagagccgcaacccgcagatcaccgagcggcccggcgagccggagttcgagaagatcggctga

SEQ ID NO: 9152 - protein, 475 aa, Streptomyces coelicolor
MTSAQVDTDKAPEEGYERGLNSRQVQMIAIGGAIGVGLFLGAGANIAKAGPSIILMYALAGVIIFFIMRALGELLLYRPVSGSFAEYSREFLGPFFGYFTGWTYWLMWVVTGMAELTAAAIYIHYWFPDIPQWVSALVFLVLLFVANLISVKLFGEIEFWFSMVKVTAIIGMIVIGVGVLTLGFSQAGDTAAVSNLWEFDGFFPKGIGSSLMTLQGVMFAYLAVELVGVTAGESENPEKTLPKAINTLPWRIALFYVGALTVILAVVKWTEFAEGVSPFVEAFAVIGIPAGAGIVNFVVLTAALSSCNSGMYSTGRMLRTLADNGEAPRIFNKLSSTKTPAIGIAVSVVFMAIGVVLNYLVPEKAFGYVTSVATAAGIWTWLMILISHVRYRRKVVAGRLPASSFPAPGGSVCSYIAIAFLLFVTCLIAYDADARVCLYVMAGWAAALGIGWAVLKSRNPQITERPGEPEFEKIG

SEQ ID NO: 9153 - DNA, 1659 bp, Schizosaccharomyces pombe
  CDS (1)..(1659)
atggatgaaaaaaaggcgttgcagtatgaagaaagtaagagggccgaagagattactgatattgaattggtctctgttggtggcatcgacgttgaaaagaagtacggagaaactaaacgtgctttgaaatctcggcacgtacagttaattgccatcggaggatgtattggtactggtcttttcgttggatctggttctgcgctttcagaatctggccctgcttcattatttttatcatatgtgattatgtcttttgtgatttggacagttatgaatgccttgggagaaatgtgtacttatctaccattaagtggtgcgtctcctatcacttatattgaaagatatgtcgatgcttcattagcttttgcagccggatggaattattggtatgcgtacgtcttccttgtagctagcgaagtaacggctgctagtattgttattgaatattggacttatgccgttcccaccgcaggttggattgccatattgcttttccttgttgctgttcttaactcctttttcgtaaaatggtttggtgaaactgagttttggtttgccattattaaagttattgcaattgtgggattaattattttgggagttgtcatcttttttggtggtacgccaaaacatgatcgcttgggttttcgctattggaagcatggcctcgcctttcgagaatatattgtcaaaggcgcttccggtcgatttgtaggattttggagtgccgtgattaaaagtgggtttgcttttattttagctcccgagcttgtcatcttttcagccggtgaaaccgaagccccaaggcgtaacatccctaaagccactagcagattcatttacaggttaatcttcttctacatttttggctctttaactattggtgtgataacctcttcaaaagatcctcgtcttttgaacgctatttctagtggagctagtggagctgctgcctccccttttgttattggaattcaaaatgctgaaattcctgtgttgaatcacattattaacgccgtaattttgacttcagcttgttcatctggaaattctttcctttttgctggatcaagatctatctattctttagcaaaagaacatcaggctccgaaaatatttaagtactgtaaccgatggggtgttcctgttatatctgttgcagtaaccgtcctttttgcatgtctagcctttttaaatgcttccgcatcggcagctgttgtatttaattggttttgtaatctctctaccatttcaggatttttagcttggatctgtgttttggtagcctatcttcaattccgaaaggctatgattttgaacaatttgtgggaaactcgtccttataaaaccccttttcaaccatatgctacttaccttactttgttcttgcttgcattgattactcttactaatggatttactgtcttcgttggtcataccttcaccgccggtaacttcattgctgcctacatcactttgccaattttccttgttttgtatgttgctcataaactttggtcaaggaattggagctttggtaaaagaatcgaagaaattgatgttactacgggagttgcggaagctgaagctctcgaacaaatgtatcccgcacctgtacccagaaacatcattgagaaaatttggttttggattgcttaa

SEQ ID NO: 9154 - protein, 552 aa, Schizosaccharomyces pombe
MDEKKALQYEESKRAEEITDIELVSVGGIDVEKKYGETKRALKSRHVQLIAIGGCIGTGLFVGSGSALSESGPASLFLSYVIMSFVIWTVMNALGEMCTYLPLSGASPITYIERYVDASLAFAAGWNYWYAYVFLVASEVTAASIVIEYWTYAVPTAGWIAILLFLVAVLNSFFVKWFGETEFWFAIIKVIAIVGLIILGVVIFFGGTPKHDRLGFRYWKHGLAFREYIVKGASGRFVGFWSAVIKSGFAFILAPELVIFSAGETEAPRRNIPKATSRFIYRLIFFYIFGSLTIGVITSSKDPRLLNAISSGASGAAASPFVIGIQNAEIPVLNHIINAVILTSACSSGNSFLFAGSRSIYSLAKEHQAPKIFKYCNRWGVPVISVAVTVLFACLAFLNASASAAVVFNWFCNLSTISGFLAWICVLVAYLQFRKAMILNNLWETRPYKTPFQPYATYLTLFLLALITLTNGFTVFVGHTFTAGNFIAAYITLPIFLVLYVAHKLWSRNWSFGKRIEEIDVTTGVAEAEALEQMYPAPVPRNIIEKIWFWIA

SEQ ID NO: 9155 - DNA, 1725 bp, Schizosaccharomyces pombe
  CDS (1)..(1725)
atgctctccaaattttacgaagacatagattccaaattggaaaatgcaatgttatctcaaatagaaagcagtacaataacttgtgatggtaaatccctaaacacattgcctacccctaaacaagaggatgtcgagtttggcgttcctctgcagccagaagacactcaagatctccaaagaaagctgaagccccggcatatgcaaatgattgccataggaggatgcgttggcactggtctgtttgttggttcgggtaatgcactggccgatggtggtcctgctagtattcttatagccttcgcagtgataggaacttatgttttatttacaaccagcgcgttggcagaactctccgcaatttatcccgtttccggttcattttatacatacttttcgaaattcatcgacccggcatgggggtttgctgttggtatacagtattggttatcttttgccgtgaccgttccattagaacttacagttgccccgttgattattaatttttggaatgcatctggtccggtttcgatttggatttcagttttttacgtaattattatcgcgattaacatttggggaaccgaggggtatggtgaggtggaattttttttgagtatcatgaaagtcatttcagtcatcggttttgtaattctaagcataataattgcagcaggtggagtaccaactgatgatcgaggagtaatcggagtgtcatattggaaacaaccgttggtttttaacaatggattcaaagggttatgcgctgtttctgttatagctattttctccctgtcaggaaccgaactagttggtcttgccgcatcagaagcaaagaatcctcaaaaaacagttcccgcagcagtcaaacaaatattttggcgtattttcttgttctatattgttgctcttttcatgcttactttggtggttccgtctgacctacctgggctacgcacgagcgataactcaaatgtgctaatttcaccattcgttattgccattcaactggcaaatataagggcacttccgagcatcatgaacgtagtaattctgctttccacattatccgtaggaaattcagcttcctatgcggcgtcacgtgccttgtttgctttagcaaagaacggctatgcacctaagatttttaataaaactaacaaacgaggtcatccaatttatgcaattgccgtaacgcttttatttggttctatagcatacttcactgaagctggagttggcggcgcactctttggttggttgttatcaatatgtggtttgtcaacaacatttatatggggaagtatttgcctcgcccatattcaatttagaagagcgtggaaaatacaaaataggaaactagaagatcttccttaccgtagcatttttggagtatatggatctatttatggtgtggccatgacaatattggctttaattgcccaattttatgtcgcggtattcccaattggaaaaaaaccaaatccagtggatttttttcaggcatatatggctgcacccatattaattatcagctttgtggcatggaagttttttagacgtacatcatttgttcgtatcgaaaaaattgatctttcagagggtgcgcatggcgaacagaaacaaaatctcgaacccgtcatcaatatacccgttgaagagatagacttcccaatgaaagtagccaccaaggagagcatgaaaaatgtagagaaaaatgcgttatga

SEQ ID NO: 9156 - protein, 574 aa, Schizosaccharomyces pombe
MLSKFYEDIDSKLENAMLSQIESSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLSVGNSASYAASRALFALAKNGYAPKIFNKTNKRGHPIYAIAVTLLFGSIAYFTEAGVGGALFGWLLSICGLSTTFIWGSICLAHIQFRRAWKIQNRKLEDLPYRSIFGVYGSIYGVAMTILALIAQFYVAVFPIGKKPNPVDFFQAYMAAPILIISFVAWKFFRRTSFVRIEKIDLSEGAHGEQKQNLEPVINIPVEEIDFPMKVATKESMKNVEKNAL

SEQ ID NO: 9157 - DNA, 1614 bp, Schizosaccharomyces pombe
  CDS (1)..(1614)
atggaggcagcgccttctgagaaagttcctgccaagaagctatcctcctcagaaaacctcgacattggagtttccgaagttgtaacagttgacgcagcggaaaataattcaaatggaatcaaacgtggattgaagactcgtcatgtatcgatgatggcccttgctggtatcatcggtccaggtgtcttcattggtatgggcagtgccctgcatattggtggtccggtgggtctaattgtcggctttgccatcgttagtattgttgtttttggggttatgctgagtatcggcgagtttaattcgctatttgatttcaacttcaatactcatgctgctcgatgggttgacccagcatttggagccgctatcggatggaactatgttatcgtatggcttaccaacatcgcagcagaatatacatctttaacatctattcttcaatattggggcccccatgtgccatcttatggcttttttctaattttttggggtttttttacgtgttaccaaatgctaggtgtgtcagtgtttggagaatctgaatacattttggctttcattaaacttctatttattactggattctacatatttgcaataatttacgcagctggaggaattcctcatcataagccgcccaacttgtttaaagaaatgccattggcacacggatttgggggtatagtttcagcatttgtatatgccggtgtcttttttagtggtgtagaatctgtatctatgactgcagctgaaagcaaaaatccaaaaaaagctatcccgcttgctgtgagacaaacgttctggagaatcttgtatgtctattttggtatctcaatctcttacggtatcaccgtagcatggaatgacccaaatctttcgtcaggctccaaaactctcaagtctccaatgacaattgctataatgaatgccggttggaatcacgcaggtgattttgtcaatgcagtcattttaattacttgcctttcttccatcaacagtggtatatatataggaagtcgatctttgtataatttagccaaggatggcatggctccaaaaatttttaaaagggttgataaaagaggtgtaccatgggttgcggtccactcagtccaccttttcgggtttctttccattatgaattacagcacaggtgctgtcaaggcatatggctatattatcaatttagctggtgtgtctgcattcattgtgtggacagcaatcatattcgttcactttcgtttcagacgaggctgggtaaagcaaggctatgccttgtctgatttaccgtttaaatcacctctttatccctttccccagcttataggattcgttataggaatcattctcacactagtacaaggatggacggtttttaaaccatttgctgctggcgattttgtcgatgcctatatacttctacccctgtttttcgtcatttggctatcttataaatttattaaaaagacaaagtgggtatcttatgaagacatggacttcataaacggcagacgagttattgaaccaacctattcaaatgaacagtcttcagataaagaaaccgaagacggcaaaaaaacaagtttctggaacagagtttggaaagaagtataa

SEQ ID NO: 9158 - protein, 537 aa, Schizosaccharomyces pombe
MEAAPSEKVPAKKLSSSENLDIGVSEVVTVDAAENNSNGIKRGLKTRHVSMMALAGIIGPGVFIGMGSALHIGGPVGLIVGFAIVSIVVFGVMLSIGEFNSLFDFNFNTHAARWVDPAFGAAIGWNYVIVWLTNIAAEYTSLTSILQYWGPHVPSYGFFLIFWGFFTCYQMLGVSVFGESEYILAFIKLLFITGFYIFAIIYAAGGIPHHKPPNLFKEMPLAHGFGGIVSAFVYAGVFFSGVESVSMTAAESKNPKKAIPLAVRQTFWRILYVYFGISISYGITVAWNDPNLSSGSKTLKSPMTIAIMNAGWNHAGDFVNAVILITCLSSINSGIYIGSRSLYNLAKDGMAPKIFKRVDKRGVPWVAVHSVHLFGFLSIMNYSTGAVKAYGYIINLAGVSAFIVWTAIIFVHFRFRRGWVKQGYALSDLPFKSPLYPFPQLIGFVIGIILTLVQGWTVFKPFAAGDFVDAYILLPLFFVIWLSYKFIKKTKWVSYEDMDFINGRRVIEPTYSNEQSSDKETEDGKKTSFWNRVWKEV

SEQ ID NO: 9159 - DNA, 1401 bp, Arthrobacter sp
  CDS (1)..(1401)
atgaatcaagaaggaaaattgcaaaaaggcctaaaaattaggcatttaaccatgattgcatttggcggctctatcggcgcgggtttatttgtagggagcggggctatcatacaaatgaccggacccgcagctgtttttacagcattgatggcaggaatcttagttattctgatcatgaggatgcttggagaaatggttgtcgccaagccatcattagggtcgttttcagattatgcacgggaggcactcggaaactgggcagggtttacggtaagctggctttattggtatttttgggtaattgttattgcagttgaagcaatcgccggagctgcaatattaaaagattggttgtttcccaatgtatctctatgggtattgaatctaatattgcttatagcattaacgataacaaatattttttccgttaaagcttatggcgaatttgagtattggttttcattgattaaaattgttgccattacattgtttcttaccctcggcggggcatacattttcggtttatttcccggtatcccaatgcacttgtctaatttaacagcacatggagggtttatacctaatggagcgggtatcgtgtttattgccgttgccaccattattttttccttcgtcgggtcagaaattgtaacgattgccgcagcagagtcagcggaatctgaaaaagcagtcgtaagagctgtaaactctgttattgtccggattatgacgttctatgtgggctctgtttttatcattgtagctgttgttccttggaatgatgcgaaggcgcttacaaacccgtatgttagtgcacttaaactaatgggtatgcccggagcggatatgattatgaacctggtagttgttacagctgtcctatcatgtttaaattcaggcatttacactgcctccaggatgttatttgccttaggtgataagggagatgcccctaaatggatgatgcatgttacgaaaaccggggttcccttaaaggcgattctgacgtgtacgatatttggtttcatatccgtcattatggcctttgtgtcgcctgagactgtgtttcaatttctattgaattcttcaggagctatcgcgttatttgtctacttactaattgctgtatcgcagctgaaactgcgcaaaaccattgagcgtgaaacacctgagcgccttaaattgcgaatgtgggcatatccatatctgaccattgcaacaatcatagcaatgctcatgattattacgacgatggcttttaacgcaagcacaagatcccagtttatcttaagtctgctaagttcagctattgttgtcgcgatttatttcattaaaacaaacctttccaaaaagcagtcattagatacaagcattgttaatcctgaaaatatcaaaagttga

SEQ ID NO: 9160 - protein, 466 aa, Arthrobacter sp
MNQEGKLQKGLKIRHLTMIAFGGSIGAGLFVGSGAIIQMTGPAAVFTALMAGILVILIMRMLGEMVVAKPSLGSFSDYAREALGNWAGFTVSWLYWYFWVIVIAVEAIAGAAILKDWLFPNVSLWVLNLILLIALTITNIFSVKAYGEFEYWFSLIKIVAITLFLTLGGAYIFGLFPGIPMHLSNLTAHGGFIPNGAGIVFIAVATIIFSFVGSEIVTIAAAESAESEKAVVRAVNSVIVRIMTFYVGSVFIIVAVVPWNDAKALTNPYVSALKLMGMPGADMIMNLVVVTAVLSCLNSGIYTASRMLFALGDKGDAPKWMMHVTKTGVPLKAILTCTIFGFISVIMAFVSPETVFQFLLNSSGAIALFVYLLIAVSQLKLRKTIERETPERLKLRMWAYPYLTIATIIAMLMIITTMAFNASTRSQFILSLLSSAIVVAIYFIKTNLSKKQSLDTSIVNPENIKS

SEQ ID NO: 9161 - DNA, 1686 bp, Uromyces fabae
  CDS (1)..(1686)
atgattcttattcaaaaaaaagatcaaaaaaatgattcatttcgcatagaggacgaattagaaaagcacgcaaaccaagcttactatgagtccacagaagtcaacgcatcttcttctcctactggagatggtgcggttggcgaaaatacagttcatcgagctctcgaacaaagacacataagcatgattgcaatcggtggtacaattggaaccggtctattcttgggaatgggagaagcacttaacaaaggtggacctttaggtttgatactaggttacatggtgatgggacttgttgtctacgccatgacgattgcgctgggcgagatggtcacaatgtttccagtctctggttcatttactcattatccatgtcgctttgttgatccagcccttggatttgctgtcggatggaattattggtattcattgaccatcgcagttccaagtgaggttattgccgccaccattgtcgtagaatattggaaggccccagtgaacaaggtcgtttggatcatcacgtttattgttcttagttgtggaatcaatttcttcggagtgagatggtacggagagactgaattcgcattcgctgcggtcaaagtcgtagccatcattgtacttattcttgtgggcatcgtaattgatatcggcggagggcccactcatgagagaattggatttcgccatttcattgaccctggaccattcaaccaattgcacggaatacctggagctcttgggagatttttggccttctggtctgtatttactcaggcaagtttttcgtacatgggtacagaaatggtagctattacggccggtgaagctgccaatcctcgcaaaactgtgcctaaggctatcgagagagttttctacagaatactagtattttacttgggtagcacactcgttgtcggccttctagttccttattcatccccacaacttttaggaagcaccggcgatgctagttcatcaccattcgtgattgcaatcaatcgagccggtatcaccgtactccctgacatgatcaatgtggtgatattactatctgctatttccacggcgagctccaaactttatggtggtagtcgagtgttgtatggactgtcgaaagatgggatggcgcctagatttttctcaaagtgtaacgcttctggattgcctatgtggtctctacttgctaccagtagcaccgcggctctctcttttatgtgtctaaatagtaaagcaggtgttgctttccaatggttccaaaacctttcagccatgactgggatactaacctggtggacagtcttagtgtcatatgtattgttctatcaaggtctcaaggttcagggtcttagccgcgacaaattgcattacaaagccccatttcaaccgtatgcttcttggattgcattggctatgcttactctgatcatgtttatgagtggatttgagacattcctgaaaggaggatggtcgatttcggattttctagccaattatttaacattaccgattttcctaggattttacttgtactggaaaatatctacacgatccaaatttgtgagctcgaaacatgtggactttgttactggaacacgtgaattgaatgaaatggacgcgcaggagagagaaaaggagatcattccaaccacgaaatggggaaaatttattgacaagttgctctga

SEQ ID NO: 9162 - protein, 561 aa, Uromyces fabae
MILIQKKDQKNDSFRIEDELEKHANQAYYESTEVNASSSPTGDGAVGENTVHRALEQRHISMIAIGGTIGTGLFLGMGEALNKGGPLGLILGYMVMGLVVYAMTIALGEMVTMFPVSGSFTHYPCRFVDPALGFAVGWNYWYSLTIAVPSEVIAATIVVEYWKAPVNKVVWIITFIVLSCGINFFGVRWYGETEFAFAAVKVVAIIVLILVGIVIDIGGGPTHERIGFRHFIDPGPFNQLHGIPGALGRFLAFWSVFTQASFSYMGTEMVAITAGEAANPRKTVPKAIERVFYRILVFYLGSTLVVGLLVPYSSPQLLGSTGDASSSPFVIAINRAGITVLPDMINVVILLSAISTASSKLYGGSRVLYGLSKDGMAPRFFSKCNASGLPMWSLLATSSTAALSFMCLNSKAGVAFQWFQNLSAMTGILTWWTVLVSYVLFYQGLKVQGLSRDKLHYKAPFQPYASWIALAMLTLIMFMSGFETFLKGGWSISDFLANYLTLPIFLGFYLYWKISTRSKFVSSKHVDFVTGTRELNEMDAQEREKEIIPTTKWGKFIDKLL

SEQ ID NO: 9163 - DNA, 1404 bp, Pseudomonas putida
  CDS (1)..(1404)
atgcaacaagctcaaggtctcaagcgcgggctaaatgcccgccacatccgtttcatggccctcggttctgccatcggaaccgggctgttctacggctccgcctcagccatccagatggccggcccggccgtgctgctggcttacctgatcggcggtgccgctgtgttcatggtcatgcgcgccctcggcgaaatggccgtgcacaacccggtggccggctccttcggccactacgccagtacctacctcggccccatggccggcttcatcctcggctggacctacgccttcgagatggtaattgtcgccatcgccgacgtcaccgccttcggtatctacatgggcttctggttcccggaagtggcccgctggatctgggtgctgggcatcgtcttcctgatcggcggcctcaacctgtgcaacgtcaaggtgttcggcgagatggaattctggctgtcgctgctcaaggttggcgccatcgtcgcgatgatcctggccggcctcggcatcatggccttcggtttcagccaggtgggtaccgggcatgccgtcggtgtgagcaacctgttcgaccatggcggcttcatgcccaatggcgtgggcgggctgatcgcctcctttgccgtggtgatgttcgccttcggcggtatcgagatcattggcgtgactgccggtgaagccaaggacccgcagcgggtcatccccaaggcaatcaacgccgtgcccctgcgcattctgctgttctatgtgctcaccctgttcgtgctgatgtgcctgtacccgtggccgcagatcggcagcgaaggtagcccgttcgtgcagattttcagcaacctggggattggctctgccgccgcagtgctgaacgtggtggtaatttccgctgcgatctcggccatcaacagtgacatcttcggtgctggccgcatgatgtatggtctggcccatcaaggccatgcgccacgcagtttcggcaagctgtcgaaacacggtgtgccatggatgaccgtggtggtgatgggcgccgcgctgctgatcggcgtgctgctcaactacctgatccctgagaacgtgttcctgctgatcgcttcgatcgccaccttcgccaccgtgtgggtgtggttgatgatcctgctcacccaagtggccatgcgccgcagcatgagccgtgaagaagtggcccagctcaagttcccggtaccgttctggccatacggcccggccatggccattgcgttcatggtcttcatctttggcgtgctcggctacttcccggatacccaggcggcattgatcgtcggcgtgatatgggtggtgttcctggtggcgtcctacctgctgtggtgcaagccgcgcgcagggcagggccagcccgtagcagagcctgtcgagctgcaccgctag

SEQ ID NO: 9164 - protein, 467 aa, Pseudomonas putida
MQQAQGLKRGLNARHIRFMALGSAIGTGLFYGSASAIQMAGPAVLLAYLIGGAAVFMVMRALGEMAVHNPVAGSFGHYASTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGVSNLFDHGGFMPNGVGGLIASFAVVMFAFGGIEIIGVTAGEAKDPQRVIPKAINAVPLRILLFYVLTLFVLMCLYPWPQIGSEGSPFVQIFSNLGIGSAAAVLNVVVISAAISAINSDIFGAGRMMYGLAHQGHAPRSFGKLSKHGVPWMTVVVMGAALLIGVLLNYLIPENVFLLIASIATFATVWVWLMILLTQVAMRRSMSREEVAQLKFPVPFWPYGPAMAIAFMVFIFGVLGYFPDTQAALIVGVIWVVFLVASYLLWCKPRAGQGQPVAEPVELHR

SEQ ID NO: 9165 - DNA, 1755 bp, Amanita muscaria
  CDS (33)..(1649)
ccccctgattccgttttctttctgccgacatcatggccagtgaagaacttgagaagcaatcaccagtgtatgataagcctggtccagaagcagaatctttgcaaggcgttgccaacgatggactctcgcgacagctgaaaaatcgccacatcgctatgattagtattggcggtgttatcggtaccggtcttttcctcggaactgccactgccttaagaaatggaggaccagttggaatgctattggggtacgccctaatgggattaatatgcttctgtgtgatgatatcactcggcgagatggttgcattcctaccaattccaggcggtcatattaaacttgccgagcgttttgtggacccggcattttcgtttacgatgggttggaattactggtataactggtctatcgttctacccgcagaattgagtgcctcttctgtaattgttggcttctggaatcacaacatcaacccggctgtatgggttatcatttgcttggtggtcgttgttaccatcaatatgttaggcgctggtgtatacggcgaagcagaattttggtttgcttctatcaaagttattactatcacaggccttattatcttgggtatcgtccttgaccttggtggcggaccaaaccacgacaggttgggcttccggtactggaagaatccaggcccattcgtccaattcggtggaatatcaggcactacagggcaattcctcggcttttgggccgtcctgactcaggccgctttctcttacatcgggacggagattgttgctatcgctgctggggagacgaagaaccccagacgcaaccttcctcgggctattaaaagggtttatatccgtattcttttgtcctatatctgtggtaccttaatcattggactacttgttccctccaatgacagcggtcttaatctgggggatggaactgcggcttcatccccattcgtcatcgctatcgaacgcgcaggaattaactcattgccacacatcatcaacgcttgtctccttacgtctgcgtggtcggcagcatccagtgatctctacacgagttctcgggctctgttcggtttggctgtgtccggaaacgcgcccaaaatcttcctcacaacgacatcatctggcttgccctatgtttcaatcgcgttcgagtgcatgctcttgcgcctcctggcattcatggccactagtagtggggcgggtaaggtgtttggatggttcgcaaacatgacagccattgctggtttgatgacgtggttcggaatttgcgtctcttatatccgtttctacaacgccttgaaagtccagggctatgaccgcaagaccttgcccttttcatcaaggctgcaaccttttgccgcttactttgctgcaggattcattctagtcgcgtgcttcttcagcggatttgccgttttcctcaagggcaaatgggctacagataccttcgtgacaaattatttgccatttgtgctgttccctatcatgtatggccttgcgcgactctactacaaacaaggcccaaaaccgtacgatgaaattgatctggtgactggattgaaggaaatcgaacaacaaacatacgatgaaccacccccaaataacttccttgaacgggtctggcagtgggtgatgtgagcgtgatccttaatgtagattaccgcattaggtagtgtactaagtacttcgagcgatttcaagaacatgagattactcgaaaaagccaaaaaaaaaaaaaaaaaaa

SEQ ID NO: 9166 - protein, 538 aa, Amanita muscaria
MASEELEKQSPVYDKPGPEAESLQGVANDGLSRQLKNRHIAMISIGGVIGTGLFLGTATALRNGGPVGMLLGYALMGLICFCVMISLGEMVAFLPIPGGHIKLAERFVDPAFSFTMGWNYWYNWSIVLPAELSASSVIVGFWNHNINPAVWVIICLVVVVTINMLGAGVYGEAEFWFASIKVITITGLIILGIVLDLGGGPNHDRLGFRYWKNPGPFVQFGGISGTTGQFLGFWAVLTQAAFSYIGTEIVAIAAGETKNPRRNLPRAIKRVYIRILLSYICGTLIIGLLVPSNDSGLNLGDGTAASSPFVIAIERAGINSLPHIINACLLTSAWSAASSDLYTSSRALFGLAVSGNAPKIFLTTTSSGLPYVSIAFECMLLRLLAFMATSSGAGKVFGWFANMTAIAGLMTWFGICVSYIRFYNALKVQGYDRKTLPFSSRLQPFAAYFAAGFILVACFFSGFAVFLKGKWATDTFVTNYLPFVLFPIMYGLARLYYKQGPKPYDEIDLVTGLKEIEQQTYDEPPPNNFLERVWQWVM

SEQ ID NO: 9167 - DNA, 1392 bp, Photorhabdus luminescens
  CDS (1)..(1392)
atggacagggaatttatggcagatcaacaacatagcttgcaacggggtttagaagcccgtcatatagagctgatcgcactaggcggcacaattggtgtcggtctgtttatgggctcggccagcacactgaaatgggctggtccttccgttttgctggcttacattattgccggaatttttgtttttttcattatgcgatcgatgggagaaatgctgtttcttgaacctgtcacgggttctttcgcctcttttggacataaatatctcagcccatactggggatgcctcaccgcttggggctattggtttatgtgggtggcggtagggatatcagaaataacggctattggtgtttatgctgagttctggttccctgaacttcctcagtgggtatcagcattaattgcggtggcgttggtcgctttggcgaaccttgcggcggtacgtctttatggtgagctggaattttggtttgccatgattaaggtgaccacaattattgtcatgatcctgattggcttgggattgatatttttcggtattggtaatcaatggcagcctattggattggataatctgactgtgcatggtggtttctttgcgggtgattggcaagggtttctgtttgcgctctgtattgtggttgcatcttatcagggggtggagctggttggtatcactgcgggggaagcgaagaaccctcaggtgacattgaaaaaagcgattaacaatattctctggcgtatcctgattttctacgtgggtgcgattttcattgtagtgacattatttccatggacagaagtgggtgcacagggcagcccgtttgtcatgacatttaccaaagtggggatcacctcagcggcagccgtgattaactttgtggtattgacggccgcgctttccggctgtaacagcggtatgtacagtggtgggcggatgctttatgcgctggcgcaaaaccgtcagctaccttcatcattgactaaattgtcaaagaatggggtaccggtaattggtattgctatcactatcttgtgtttgattgtgggctctagtttgaattatttgatcccaaatccgcaggcggtttttgtttatgtttacagtgccagtgtgctaccaggaatggtaccgtggtttgttattctgatgagccaattgcgttttcgtcagtatcatcaacaagcactgaaacaacatagttttaaatctatcctgttcccctatgtaaattacctgacattggcatttttatgttgtgtgttggtagggatggcaattaacccggatacccgtttttcattgctggtaggtgggggatttttgttgatagtgtcgctgatttattggttggtgaagctttttaacggtaaaaaaccaaaagcctga

SEQ ID NO: 9168 - protein, 463 aa, Photorhabdus luminescens
MDREFMADQQHSLQRGLEARHIELIALGGTIGVGLFMGSASTLKWAGPSVLLAYIIAGIFVFFIMRSMGEMLFLEPVTGSFASFGHKYLSPYWGCLTAWGYWFMWVAVGISEITAIGVYAEFWFPELPQWVSALIAVALVALANLAAVRLYGELEFWFAMIKVTTIIVMILIGLGLIFFGIGNQWQPIGLDNLTVHGGFFAGDWQGFLFALCIVVASYQGVELVGITAGEAKNPQVTLKKAINNILWRILIFYVGAIFIVVTLFPWTEVGAQGSPFVMTFTKVGITSAAAVINFVVLTAALSGCNSGMYSGGRMLYALAQNRQLPSSLTKLSKNGVPVIGIAITILCLIVGSSLNYLIPNPQAVFVYVYSASVLPGMVPWFVILMSQLRFRQYHQQALKQHSFKSILFPYVNYLTLAFLCCVLVGMAINPDTRFSLLVGGGFLLIVSLIYWLVKLFNGKKPKA

SEQ ID NO: 9169 - DNA, 1395 bp, Photorhabdus luminescens
  CDS (1)..(1395)
atgcaagcttcattacaactagagcgaggactcaacgcacgccatatccggtttatggcgttgggctctgcgattggtacgggtcttttttatggttctgctgaagcaataaacatggccggtccggcggtattattagcttatttagtgggcggtgctgctgtctttatggtgatgcgtgctttaggggaaatggcagtccacagaccggatgccggctctttcgccagttatgctcatcaatatttaggcccgttacccggatttattactggctggacctatactttcgaaatgatcatcgtttgtctggcggatgtgactgcttttggcatttatatggggctatggtacccggaagtgccgcgttggatatgggtactgagcattattttcattattggcgcgctcaatctttgtaaagtcaaagtatttggcgaaatggaattctggttatcgattctgaaagttgctgcaatcagcgccatgattattgccggaaccggtattattctgtttggttttagcggtcattttcaggcaacgggagttcagaatctgtggcaacacggcgggtttatgccgaatgggctggggggcattattgagtctctggctgttgtgatgtttgcttttggtggcattgaaatcattggtattacatccagcgaagctaaaaatccggcgaaagtgatcccgcaagcgattaactctattccgtttcgcattcttctgttttatgtactcactatttttgtattaatggcgatttacccttggaatagtatcggccaagaaggtagcccatttgtcgcaatatttcaggggctaggcattggttcggcggcgaatattctgaatattgtcgtcattacggcggcaatttcggccattaacagcgatatctttggtgcgggtcgtatgatgtacggtatggccgagaaaggattagcccataaaaaatttatgcatttaagccgtaatggcgtgccttgggtgacgattatggttatgaccttggcgttattgtgtgctgtggttctcaattatttgctccctaaacaggtatttgtcattgttgcttcaattgcgacttttgccaccgtgtgggtctggttaatgattttgctatctcaatttgctatgcgcagaaaaatgtcaccgggagaagcacaaaaattacaattcccagtaccgatgtggcctgttgcgccgattttaaccatcgtgtttatgatatttattattgctgttctcagttacttccctgcgacacgaattgcattctatgtgggaggcgcatggatcgcgctgttaacatccgcctattatttatggatacgaaaaaatgtcattattgtgagcgctcaatcagccaaagaaacacggtgttaa

SEQ ID NO: 9170 - protein, 464 aa, Photorhabdus luminescens
MQASLQLERGLNARHIRFMALGSAIGTGLFYGSAEAINMAGPAVLLAYLVGGAAVFMVMRALGEMAVHRPDAGSFASYAHQYLGPLPGFITGWTYTFEMIIVCLADVTAFGIYMGLWYPEVPRWIWVLSIIFIIGALNLCKVKVFGEMEFWLSILKVAAISAMIIAGTGIILFGFSGHFQATGVQNLWQHGGFMPNGLGGIIESLAVVMFAFGGIEIIGITSSEAKNPAKVIPQAINSIPFRILLFYVLTIFVLMAIYPWNSIGQEGSPFVAIFQGLGIGSAANILNIVVITAAISAINSDIFGAGRMMYGMAEKGLAHKKFMHLSRNGVPWVTIMVMTLALLCAVVLNYLLPKQVFVIVASIATFATVWVWLMILLSQFAMRRKMSPGEAQKLQFPVPMWPVAPILTIVFMIFIIAVLSYFPATRIAFYVGGAWIALLTSAYYLWIRKNVIIVSAQSAKETRC

SEQ ID NO: 9171 - DNA, 1455 bp, Photorhabdus luminescens
  CDS (1)..(1455)
atgataaaaaataataaaactcaacaaaacctttcggcagagaaatttgctgatacacaaacgcttcatcgagggctgagtgcacgtcatattcaattgatttccattggtggtgctattggcacaggtttatttatggggtcaggaaaaactattgccgtatcgggtacatcgatcattattacctatgcgattgttggtttttttgtctatatggtgatgcgggcaatgggagaattgctgctgactaaactgaattatcgctcttttgctgatttcgtatcggattatttaggtaccaaagccagtttttttctcggctggacttattggatgagttggattgtctcttgtattgctgatgttgttgtatgtggcggctacattcaatattggtttcccggcgtctctctttgggtgcccgcatttataacgctaggtttactggggacttgtaatcttctttctgtccgcttatttggcgaagctgaattctggttcgccatgattaaggtcattgcgattttagcgttgattattattggcgttggtatggtgatggtaggttggcaatcaccggatggtacgatcgcctctgtgaataatttgactgatccatcggtatttctgccaaatggtatttttggtttttttgctggttttcaaatcgcgattttttcttttactggtgttgaattagttggcacgatgacggcagaaacaaaagatccggaaaagatattgccgaaagcaattaattatatcccgatgagaattatgattttctatattttctccatgttgagcatcattgctgtcacttcttggggacggatctcagctgaaaccagcccttttgtgacactatttgccctggcgggtctgcctgctgctgccgcagtggttaattttgttgcattaacgtcggcaatgtcctctgctaatagtggattatatgcttgtacacgtatgctttatggcttatcaacggaaaagaatgcacatcggaaatttaaaattctttcccgcaatacggcgattcctgtacatagtctgatattttcttgtttctgtatggtggtgggtacgtcacttttatttatcgtaccgaatgtcatgcagttatttactattgtatcaaccgttgcttcggttatggtgatttatagctggtgtgtgattttgattgcctatttggtttatcgtaagaattatcctgatgtgcataaacgttcaatatttaagatgcctttaggggtgttaatgacttggctgaccctgatttttttcatctttaccatagtggtaatggtttttgatccggataccctgatcgcactctgtggcacgcctttatggtttattatgttaagtattttatggcgcgtaaaaaagaaaaatgaggcacagaaagaacagcgttatcagatagcgaaagagagttttcgttcatag

SEQ ID NO: 9172 - protein, 484 aa, Photorhabdus luminescens
MIKNNKTQQNLSAEKFADTQTLHRGLSARHIQLISIGGAIGTGLFMGSGKTIAVSGTSIIITYAIVGFFVYMVMRAMGELLLTKLNYRSFADFVSDYLGTKASFFLGWTYWMSWIVSCIADVVVCGGYIQYWFPGVSLWVPAFITLGLLGTCNLLSVRLFGEAEFWFAMIKVIAILALIIIGVGMVMVGWQSPDGTIASVNNLTDPSVFLPNGIFGFFAGFQIAIFSFTGVELVGTMTAETKDPEKILPKAINYIPMRIMIFYIFSMLSIIAVTSWGRISAETSPFVTLFALAGLPAAAAVVNFVALTSAMSSANSGLYACTRMLYGLSTEKNAHRKFKILSRNTAIPVHSLIFSCFCMVVGTSLLFIVPNVMQLFTIVSTVASVMVIYSWCVILIAYLVYRKNYPDVHKRSIFKMPLGVLMTWLTLIFFIFTIVVMVFDPDTLIALCGTPLWFIMLSILWRVKKKNEAQKEQRYQIAKESFRS

SEQ ID NO: 9173 - DNA, 1482 bp, Photorhabdus luminescens
  CDS (1)..(1482)
atgtctcaacaacaaaaaagtgtttcccggaaacccgcaacgcaacatttgcgacgtgaattgaaagctcggcatctagcgatgattgccattggcggatcaataggcaccgggttattcgtggcttcaggtgcgacagtttcacaagcagggcctggcggagcattactttcctatgcattaattggcttgatggtttatttcctgatgaccagtttgggtgaactggccgcttatatgccggtttccggttctttctcaacttatggttccaaatatgttgaagaagggtttggttttgccttgggttggaactattggtacaactgggcggtgactatcgcggtggatttggttgcagcccaattggttatgggttattggctgccggatatgccgggttggatctggagtgcgttattcctcgcgttgattttcctactgaattttatttcagtgaaaggatttggtgaagctgaatactggttctccttgattaaagtcagcacggttattgtttttattgtggtcggattactgatgatagccggcatcatgaaaggggcagaaggtgctggatggcataactggactgttggtgatgcaccttttgccggtggtttctctgccatgattggcgtggcaatgatagttgggttttcttttcagggaactgagctaattggcattgcggcgggtgagtcaaaagatccggcaaaaaatgttcccagtgctgtacgtaaggtattctggcgtattctgctattctatatttttgcgatcctgattatcagcctgattattccttatactgatccaagcctactgcgtaatgaggtcggtgatatcagtgttagtccgtttacgttggtatttgaaaacgctggtttgttatccgccgcagctatgatgaatgcggttattttgacggctgtgttgtctgcgggtaattcaggtatgtatgcatcgactcgtatgttgttcacattggcaaaagagggtaaagcaccgaggatttttggcaaattatccaaaggtggtgtaccgcgtaatgccttgtatgcaacaacggtggttgctgcgttgtgtttcctcagttcaatgtacggtaaccagaccgtctatctgtggttgttgaatacttctgggatgaccggttttattgcctggttggggattgctattagtcattatcgtttccgccgtggttatgtcgctcaggggttggatttaagtaaattaccttatcgttcaggatttttccccgttggcccaatttttgcgtttgttttgtgtctaaccatcacattaggacagaattatcaggcatttctacaagataaaattgactggtatggtgtcactgcaacttatgttggtattccactcttcctgttgatttggtttggttacaaattagctaggaaaactcactttatcaaatatagcgagatgaaatttcctgatatcgagaatcagtga

SEQ ID NO: 9174 - protein, 493 aa, Photorhabdus luminescens
MSQQQKSVSRKPATQHLRRELKARHLAMIAIGGSIGTGLFVASGATVSQAGPGGALLSYALIGLMVYFLMTSLGELAAYMPVSGSFSTYGSKYVEEGFGFALGWNYWYNWAVTIAVDLVAAQLVMGYWLPDMPGWIWSALFLALIFLLNFISVKGFGEAEYWFSLIKVSTVIVFIVVGLLMIAGIMKGAEGAGWHNWTVGDAPFAGGFSAMIGVAMIVGFSFQGTELIGIAAGESKDPAKNVPSAVRKVFWRILLFYIFAILIISLIIPYTDPSLLRNEVGDISVSPFTLVFENAGLLSAAAMMNAVILTAVLSAGNSGMYASTRMLFTLAKEGKAPRIFGKLSKGGVPRNALYATTVVAALCFLSSMYGNQTVYLWLLNTSGMTGFIAWLGIAISHYRFRRGYVAQGLDLSKLPYRSGFFPVGPIFAFVLCLTITLGQNYQAFLQDKIDWYGVTATYVGIPLFLLIWFGYKLARKTHFIKYSEMKFPDIENQ

SEQ ID NO: 9175 - DNA, 1380 bp, Photorhabdus luminescens
  CDS (1)..(1380)
atggcaggacaatcgcagcgctcaacacttaaacgcggtttaaaaaaccggcatattcaacttattgctttgggggggtcggtcgggactgggttgtttctcggtattgcacaaactataaaaatggcaggtccctccgtaattttaggctacgctatcgcaggctttattgcatttctgattatgcgtcagctaggtgagatggtagtcgaggagcctgtagcggggtcgtttagccattttgcatataaatattggggcgattttcccgggtttttatcaggctggaattattgggcgatgtttactctggtcggaatggctgaactaacggctgtgggcatgtatatccactattggtggcctgatattccaacctgggtttctgcaaccatcttctttgttttaatcaatacggtaaatttaattaatgtccggttatatggtgaaacagaattttggttttccatcattaaagtgaccgcaattatctgtatgattgtttttggctcttacctgttagtcagcggaaatggcgggcctcaggccagcattactaacctttggcagcatggtggctttatgcctaatgggatctccagccttattatggcaatggctgtcatcatgttctcttttggtggattggaactggtgggtattaccgcagcagaagcggaaaatccacgtatcagcattcctaaggccaccaatcaggtggtatacagaatattgattttctatattggttctctgacggtgttattgtcgctttatccgtggggcaatgtcgttgaaggtgaaagcccatttgtgatgatttttcataacctggatagtttctgggtggctaacattctgaatattgttgtcctaacagcggcattgtccgtttataacagcggtgtgtattgcaacagtcggatgctgtacggtttagcaaaacaaggtaatgctcctgaaatgctgacaaaagttaatgaaagtggtgtgcctatcagagccattgtcatgtctgctttagcaacgtccattggcgtattgattaattatgtgatgccgggcaaagcatttgagttattaatggcgttggtggtaacaacgttggtgattaattgggtcatgatctgtatggcgcatttaaaattccgggcagaaaaagttaaacaggggatagcgccgtcatttaaggcattttggtatccgttcggtaattatctgtgtctggttttccttgcttttatacttgtcattattttaatgatggatagcatccgtatttcagtcatcctgatgccattctgggtgggggtgttatggctcgggtttttaatgtcccattctcgccgtgataaaatgaaaacagaggagctgggataa

SEQ ID NO: 9176 - protein, 459 aa, Photorhabdus luminescens
MAGQSQRSTLKRGLKNRHIQLIALGGSVGTGLFLGIAQTIKMAGPSVILGYAIAGFIAFLIMRQLGEMVVEEPVAGSFSHFAYKYWGDFPGFLSGWNYWAMFTLVGMAELTAVGMYIHYWWPDIPTWVSATIFFVLINTVNLINVRLYGETEFWFSIIKVTAIICMIVFGSYLLVSGNGGPQASITNLWQHGGFMPNGISSLIMAMAVIMFSFGGLELVGITAAEAENPRISIPKATNQVVYRILIFYIGSLTVLLSLYPWGNVVEGESPFVMIFHNLDSFWVANILNIVVLTAALSVYNSGVYCNSRMLYGLAKQGNAPEMLTKVNESGVPIRAIVMSALATSIGVLINYVMPGKAFELLMALVVTTLVINWVMICMAHLKFRAEKVKQGIAPSFKAFWYPFGNYLCLVFLAFILVIILMMDSIRISVILMPFWVGVLWLGFLMSHSRRDKMKTEELG

SEQ ID NO: 9177 - DNA, 1407 bp, Photorhabdus luminescens
  CDS (1)..(1407)
atggcagaaaatatacacacttcgctttccactaaaaccggggaaacgcagttgcaacgcaatctaagcaaccggcatatacaacttattgctattggcggtgccattggcacgggtctgtttatgggatcagggaaaacaatctctctcgccggaccatcgatcatattcgtttatatgattatcggtttcatgctgttcttcgtgatgcgcgcaatgggagaactactgctttcgaacctgaattataaatcattcagtgatttctccgccgatttgctcggtccttgggcaggttttttcgtcggctggacttactggttctgttgggtcattaccggtatcgccgatgtagtcgcaatcacttcctatatcagctattggcaaccagactttccacaatggattacttccctactctgtgtttcactactgctctcccttaatttggctacagtgaaattattcggggaaatggaattctggttcgccatgataaagatcgttgccattatcgctttaatcgcaacaggtgctgttctaattggcatgcattttcaatctccagccggtcataccgcttcactggcaaatatatggaatgatggtggattctttcccaaagggttaagcggattttttgccggatttcagatagctatatttgcctttgtgggcattgaattagtcggcacggcagccgcagaaactaaagatccaatgaaatcgcttcccagagctattaatgccatcccgattcgtattatcaccttctacgtgctggcgctgataattattatgtcagtcacaccgtggcgttcaatcattgcagacaaaagcccttttgttgagctgtttgttctaatcggtttacccgccgccgccagtatcgtgaactttgtggtattaacctctgccgcctcttcagccaacagcggagttttctccaccagccgcatgctatttgggttagcaaaagaaggtgatgcaccacagcaattcagccgcctttcacgccgttctgtacctgcatcggggttaatcttcacctgtttatgtttatcctgtggtgtggtgctgatttatttaattcctgatgttatgcatgtatttaccctagtaactaccgtttcagccattctgtttatgtttatttggagcatgatcctatgctcatatttggtttaccgaaaacgtcgcccggcattacataaggcttcaacctataaaatgccattgggtattatcatgtcatgggtctgtctgacattttttgcatttgttctgatcttactcactttacgggatgatacccgccaggcattaatcatcacgcctgtttggtttctgatcttaattatcggttttcaaattgtaaaaaaacgtagaacacgtttgtacagctaa

SEQ ID NO: 9178 - protein, 468 aa, Photorhabdus luminescens
MAENIHTSLSTKTGETQLQRNLSNRHIQLIAIGGAIGTGLFMGSGKTISLAGPSIIFVYMIIGFMLFFVMRAMGELLLSNLNYKSFSDFSADLLGPWAGFFVGWTYWFCWVITGIADVVAITSYISYWQPDFPQWITSLLCVSLLLSLNLATVKLFGEMEFWFAMIKIVAIIALIATGAVLIGMHFQSPAGHTASLANIWNDGGFFPKGLSGFFAGFQIAIFAFVGIELVGTAAAETKDPMKSLPRAINAIPIRIITFYVLALIIIMSVTPWRSIIADKSPFVELFVLIGLPAAASIVNFVVLTSAASSANSGVFSTSRMLFGLAKEGDAPQQFSRLSRRSVPASGLIFTCLCLSCGVVLIYLIPDVMHVFTLVTTVSAILFMFIWSMILCSYLVYRKRRPALHKASTYKMPLGIIMSWVCLTFFAFVLILLTLRDDTRQALIITPVWFLILIIGFQIVKKRRTRLYS

SEQ ID NO: 9179 - DNA, 1386 bp, Photorhabdus luminescens
  CDS (1)..(1386)
atgcagaataatgaaactcagctgaaacggggtctaaccgggcggcacatccgctttatggcattaggctccgcaataggcacagggctgttctatggctccgcagctgctattcagcaagctggacccgccgtattactcgcctatttaatcggcggtgctgccgtatttatggtgatgcgtgcattaggtgaaatggctgttcaccatccagtagccggttctttttcacactatgccagccattacctcggacctttagccggatttctaaccggatggaattatatattcgaaatgctgatcgtctgcctggctgacgttactgcatttggtttttatatgaagctctggttcccccatgtggagcaatggatctgggtactaagcattgtctgctttattggcgcaattaatctttgtcatgtgaagattttcggtgaaatggaattctggctttcgattgtgaaagtcaccgcaattatcgctatgattatcggtggcatgattatcatgatctatggattcggccaagaaacagatcatgcaaccggcattgccagtttgtgggaatatggcggttttatgcctaatggcatcagtggtgtgatagcgtcactcgctattgtgatgtttgcttttggtggtattgaagtcattggtattactgccagtgagaccaaaaaccccgagaaaacaattccaaaagcaatcaacgctgtccctttccgtattctgctgttctatgtactgactctgtttattttaatgtgtatttatccgtggaatcagatcggtcaagaaggtagcccattcgtacagattttttctagcttgggtatcaattctgctgccaacattctcaatattgtagtgattactgccgcaatttcagcaatcaatagcgatatttttggtgctggtcgtatgatgtacggcatggcccaagaaggacaagcgcctaaatcattcaccaagctgagccgtaatggcgtaccctggatgactgtaatcgttatgtcagcagttctcttaattggcgttatactcaactatatgattccggaagaaattttcgttatcattgcctctatcgcgacatttgctactgtatgggtatggttaatgatcctactttctcaggttgctatgcgccgcaaaatgagcaaagaagaagttaagaccttgaaattccccgtacctatgtggccaatagcgccagcattaaccattatctttatggtatttgttattgtattactgggctatttcgagaaaacccgcattgcattaattgtgggaatcacatgggtaatcttattatcaatcacctacttctttagcaaaaagaaaaatatttctcaaatccatcagataaataaataa

SEQ ID NO: 9180 - protein, 461 aa, Photorhabdus luminescens
MQNNETQLKRGLTGRHIRFMALGSAIGTGLFYGSAAAIQQAGPAVLLAYLIGGAAVFMVMRALGEMAVHHPVAGSFSHYASHYLGPLAGFLTGWNYIFEMLIVCLADVTAFGFYMKLWFPHVEQWIWVLSIVCFIGAINLCHVKIFGEMEFWLSIVKVTAIIAMIIGGMIIMIYGFGQETDHATGIASLWEYGGFMPNGISGVIASLAIVMFAFGGIEVIGITASETKNPEKTIPKAINAVPFRILLFYVLTLFILMCIYPWNQIGQEGSPFVQIFSSLGINSAANILNIVVITAAISAINSDIFGAGRMMYGMAQEGQAPKSFTKLSRNGVPWMTVIVMSAVLLIGVILNYMIPEEIFVIIASIATFATVWVWLMILLSQVAMRRKMSKEEVKTLKFPVPMWPIAPALTIIFMVFVIVLLGYFEKTRIALIVGITWVILLSITYFFSKKKNISQIHQINK

SEQ ID NO: 9181 - DNA, 1371 bp, Chromobacterium violaceum
  CDS (1)..(1371)
atgagcgaagcccacaccggtttgcagcgcgagctgaaaaaccgccacatccagctgatcgcgctgggcggcgccgtcggcaccggcctgttcctcggctcggccagcgtcctgaagtcggccggcccctcgatgatcctcggctacgccatcgccggcttcatcgccttcatgatcatgcgccaactgggcgagatggtggccgaggagccggtcgccggttcgttcagccacttcgcctaccgctactggggccgcttccccggctttctgtccggctggaactactgggtgctgtacgtgctggtgagcatggccgagctgaccgcggtcggcgcctacgtccagtactggtggccgcacgtgccggcctggctgaccgcgctggtgtgcttcgtctgcatcaacggcatcaatctcgccaacgtcaaatcctacggcgagaccgaattctggttcgcgctgatcaaggtggcggcggtgatcggcatgatcctgttcggcggctacctgctgctgtccggcagcggcggcccgcaggcctcggtcagcaatctgtggaacgacggcggcttcttcccgcacggtgtcaaaggcctgttcatgatgatggcggtgatcatgttctccttcggcggcttggaactgatcggcatgaccgcggccgaggcgaacgacccgcagaaaaccatccccaaggccgtcaaccaggtgatctaccgcatcctgatcttctacatcggctcgctggtggtgctgctgtcgctgtacccgtggaacaaggtggccgccggcggcagccccttcgtgatgatcttcgagcagatcggcgccggcttcaccgcgcacgcgctgaacttcgtggtgctgaccgccgcgctgtcggtgtacaacagctgcgtgtacgccaccagccgcatgctgttcggcctggcccgacaaggcaacgcgccgcgggcgctgggcaagctggacacgcgcggcgtgccggtgtacgccacgctgttctccgcggcggccactttcgcctgcgtgatcctgaactacctgctgccgggcgaggcgctgggcctgctgatgtcgctggtggtggccgcgctggtcaccaactgggcgatgatcagcctgacccatctgaagttccgccgcgccaagggcggccagaagctggtgttcccgtcgttctggttcccgctgtccaactggatctgcctggccttcatggtgatgatactgggcatcctgctgttcacgccgggcatggcggtgtcggtctacgtgctgccggtgtggctgggcctgctgtggctgggcttccgcttgaagaaaccctcgccggccgaggccaggctggccggagagaacgcctga

SEQ ID NO: 9182 - protein, 456 aa, Chromobacterium violaceum
MSEAHTGLQRELKNRHIQLIALGGAVGTGLFLGSASVLKSAGPSMILGYAIAGFIAFMIMRQLGEMVAEEPVAGSFSHFAYRYWGRFPGFLSGWNYWVLYVLVSMAELTAVGAYVQYWWPHVPAWLTALVCFVCINGINLANVKSYGETEFWFALIKVAAVIGMILFGGYLLLSGSGGPQASVSNLWNDGGFFPHGVKGLFMMMAVIMFSFGGLELIGMTAAEANDPQKTIPKAVNQVIYRILIFYIGSLVVLLSLYPWNKVAAGGSPFVMIFEQIGAGFTAHALNFVVLTAALSVYNSCVYATSRMLFGLARQGNAPRALGKLDTRGVPVYATLFSAAATFACVILNYLLPGEALGLLMSLVVAALVTNWAMISLTHLKFRRAKGGQKLVFPSFWFPLSNWICLAFMVMILGILLFTPGMAVSVYVLPVWLGLLWLGFRLKKPSPAEARLAGENA

SEQ ID NO: 9183 - DNA, 1527 bp, Chromobacterium violaceum
  CDS (1)..(1527)
atgagcaagaaacaagacgcgccggagctgcggcgctcgctgcaggctcgacacctgtcgatgatcgccatcggcggctcgatcggcaccggcctgttcctggcgtccggcgccaccatctcgggcgcgggcgccggcggcgcgctgctggcctacgcgctggtcggcctgatggtgtacttcctgatgaccagcctgggcgaaatggccgccttcatgccggtgtccggctccttccaggcctacggctcgcgtttcgtcgatccggccttcggcttcgcgcagggctggaactactggtacaactgggcgatcaccgtcgcggtggaactggccgcggccgccatcatcatgaactactggtatcccgggataccgggcgtggtgtggagcgggggcttcctggccatcatcttcgcgctcaactatttctcggtgaagggcttcggcgaggccgagttctggtgctcgatgctgaaggtggccaccatcatcgccttcatcgtcatcggcttcctgatgattctgggcatcatgaccgagccgaacccgagccgcatcgcgccgggtctgcaagtgatgatgcagggcgaggggcccttcgtcggcggcctggcggccttcgtcggcgtggccatggtggtgggcttctccttccagggcaccgagctgatcggcgtcgccgcgggcgagtcggccaaccccggccgcaccattccgcgcgccgtgcgccagatcttctggcgcatcctgatgttctacatgctgtccatcctgatcatcggtctgatcctgccgcacaacgatccgtcgctgctgaagaacgacatgaaggatgtcggcgccagcccgttcacgctggtgttcaaccgcgccggcctcgctttcgccgccagtctgatgaacgcggtgatcctgtccgccatcctgtcggccggcaactccggcatgtacgcgtccacccgcatgctgtacgcgatggccaagaacggcatggcgcccaaggttttcggcaagctgaccgacaacggcgtgccgcgcaacgcgctgtacgccaccacgctggtggcctgcctgtgcttcctgacgtcgttgttccagagcaacgctgtctacatgtggctgttgaactcgtccggcatgaccggcttcatcgcctggctgggcgtggcgatcagccattaccgcttccgccgcgcctacgtgaagcagggctacagcctggacgacctgccgtacaaggccaaatggttcccgctgggcccgctgttcgccttcgcgctgtgcctgctgatcatgctgggccagaactacaccgccttcaccgccgccaaggtggattggaacggcgtcatcgccacctatctgggcattccgctgttcctggcgctgtggtggggctaccgcgtcaagcacaatacccgcatggtgcccttggaaaaggtggaactggcggaggcgcatcgcaacgccttgatgcagcgagaggaaaatcgcggcggcaagcccgccgccgcccaggcctga

SEQ ID NO: 9184 - protein, 508 aa, Chromobacterium violaceum
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 9185 - DNA, 1392 bp, Chromobacterium violaceum
  CDS (1)..(1392)
atgccaggagaacaacagaccctgcaccgcgggctggaggagaggcatatcaacctgatggcgctgggcgccaccataggcgtcggcctgttcctggggtccgccaccgcgatcaagatggccggtccggccatcatgctggcctacggcctcggcggcctcgccattttcatgatcatgcgcgcgctgggcgagatggccatccacaacccggtggccggctccttcagccgctacgcgcaggactacctcggccccttggccggctacctgaccggctggaactactggttcctgtggctggtgacctgcatggcggaaatcaccgccgtcggcgtctacatgggcatctggtttccggacgtgccgtcctggtactgggcgctggcggcgatgctggcgatgggcggcgtcaacttcatcgcggtcaaggcctacggcgagttcgagttctggttcgcgttgatcaagattgtcaccatcgtgctgatgatagccggcggcttcgcgatgatagccttcggcttcggcaaccacggcgtcgccaccggcatctccaatctgtgggcgcacggcggtttcatgcccaacggcttttccggcgtgctgatgtcgctgcagatggtgatgttcgcctacctgggggtggaaatgctgggcctgaccgccggcgaggcgaagaatccgaagaaggcgctggcgcgcgcggtggattcggtgttctggcgcatcctgatcttctacgtcggcgcgctgttcgtgatcctgtccatctacccgtggaacgagctgggcacccgcggcagccccttcgtgctcaccttcgaaagcatgggcattcccgccgccgccggcatcatcaacttcgtggtgctgaccgccgcgctgtcgtcctgcaacagcggcatcttcagcaccggccgcatgctgttcaacctggcggagcagaagcaggccttgcccatcttcgcccatgtctccaagcggggcgtgccggtgccggcgctgctgatgtcggtcgccgcgctgctgctgggcgtgctgctgaattacctggcgcccaaggaagtgttcacctggctgaccgcgatctccaccttcggcgcggtatggacctggctgatcattctgctggcgcagctgcgcttccgccgctcgctgtcggccgatgagctggcgtccatcagccaccgcatgccgctgtggccgtacggctcctacctgacgctgggtttcctggcgctggtgatcggcctgatggcgtatttcccggacacccgtgtcgcgctgatcgtcggccccggctggctggtgttcctggtggcggcctattatctgctgggctaccacaagcaggacgccgcctggcggctggcgcagcagtcgcgctga

SEQ ID NO: 9186 - protein, 463 aa, Chromobacterium violaceum
MPGEQQTLHRGLEERHINLMALGATIGVGLFLGSATAIKMAGPAIMLAYGLGGLAIFMIMRALGEMAIHNPVAGSFSRYAQDYLGPLAGYLTGWNYWFLWLVTCMAEITAVGVYMGIWFPDVPSWYWALAAMLAMGGVNFIAVKAYGEFEFWFALIKIVTIVLMIAGGFAMIAFGFGNHGVATGISNLWAHGGFMPNGFSGVLMSLQMVMFAYLGVEMLGLTAGEAKNPKKALARAVDSVFWRILIFYVGALFVILSIYPWNELGTRGSPFVLTFESMGIPAAAGIINFVVLTAALSSCNSGIFSTGRMLFNLAEQKQALPIFAHVSKRGVPVPALLMSVAALLLGVLLNYLAPKEVFTWLTAISTFGAVWTWLIILLAQLRFRRSLSADELASISHRMPLWPYGSYLTLGFLALVIGLMAYFPDTRVALIVGPGWLVFLVAAYYLLGYHKQDAAWRLAQQSR

SEQ ID NO: 9187 - DNA, 1611 bp, Neurospora crassa
  CDS (1)..(1611)
atgtcgctctcccaaaaagggagcgccaccattctcgacgaccatgaaaccgccatcccctccaaagacgacggcggcgacttccgcgccatcgaccctcactcgggcgtcaagcgcggcctcaagactcgacacttatccatgatggccctggccggcatcatcggccccggtcttcttgtcggatccggcggtgctctacattccggcggccctgcgtcgctgcttattggttttggagtcattggcctcattgccttttccatcatgcagagtctgggcgagctgacgacgctgtaccccagcggaggcgcgttcacggatctcggggacaggtttattgataaggcgtttggtgtggcggtcgggtggaattatcttatcatttgggtttgtgtcctggcgaatgagtataatgtgatttcgagcgtcatggtggattggagcgataaagtcccgctttgggggtactttttgatattttggttcgcatttttgggcttccaactcctcggtgtcgagacattcggtgaagccgagttctggctggcgcttatcaagcttatgggactggtggcctacttcatctttagcattgtttacgtctccggaggcgtcaaaggcgccgacgccatcggcttcaagtactggcgtgaccccggccccttcgccgatggcttccgtggcgtcgcctccgtcttcgtcttttgctccaccttctacgctggcgtcgaatctgtcgccgtagccgccaccgagaccaaaaacccgggtgtcgccgtcccgcactccatccgccaagtcttcatccgcatcgtcgtcgtctacatgggctgcgccttcttcttcggtttgacctgcccgtcgaacgcccccgatctctccggcggtgccagccatgccctcaagtcgcccatgaccatcgctcttcacaacgccggctgggcaaacggcacccacctgatcaacgccttcatcttcgtcacctgcttgagcgccgtcaacagctccatttacatcggcagccgcaccctcttgtacatggcgcaggacggaaaggcaccccggttcctcggctggacggatcgtcgtggcgttcctgtttacgccatcatcttcaccaatgcgtgcggagccctctcgatgatgaacgtcagcacgggcgcaagcaaggcgtatgggtacattatcaacctaagtggtgtctcgacctttttggtctggggcgccatcagtctgattcacatccgcttccgcgccgcttggaaggcgcagggacacagcccggaggaactgccgtacaagtccttgtggtacccatggaatgcctactttggcctgatttccaatgtctttttggcttttgtgcagggctggtcgacgttggctccgtttgacgcgggcaatttcgtggatgcttacatcctgttgccgttgtttcctgtgatttactttgtgtacaagttcacgttcaagacgcggctatggcggccgcatgaggttgatcttcaggcgggcaggcgtcgggatcttgatgaggctaaggaggtggagaggggggcggatgggaggccattgccatggtggagaaagattttttccagtctataa

SEQ ID NO: 9188 - protein, 536 aa, Neurospora crassa
MSLSQKGSATILDDHETAIPSKDDGGDFRAIDPHSGVKRGLKTRHLSMMALAGIIGPGLLVGSGGALHSGGPASLLIGFGVIGLIAFSIMQSLGELTTLYPSGGAFTDLGDRFIDKAFGVAVGWNYLIIWVCVLANEYNVISSVMVDWSDKVPLWGYFLIFWFAFLGFQLLGVETFGEAEFWLALIKLMGLVAYFIFSIVYVSGGVKGADAIGFKYWRDPGPFADGFRGVASVFVFCSTFYAGVESVAVAATETKNPGVAVPHSIRQVFIRIVVVYMGCAFFFGLTCPSNAPDLSGGASHALKSPMTIALHNAGWANGTHLINAFIFVTCLSAVNSSIYIGSRTLLYMAQDGKAPRFLGWTDRRGVPVYAIIFTNACGALSMMNVSTGASKAYGYIINLSGVSTFLVWGAISLIHIRFRAAWKAQGHSPEELPYKSLWYPWNAYFGLISNVFLAFVQGWSTLAPFDAGNFVDAYILLPLFPVIYFVYKFTFKTRLWRPHEVDLQAGRRRDLDEAKEVERGADGRPLPWWRKIFSSL

SEQ ID NO: 9189 - DNA, 1980 bp, Neurospora crassa
  CDS (1)..(1980)
atggctggattcgatcaggatatcgagctcagtgcttactcacactctcacggacttggaatcagtggtaatggtcgcagtggtcgacagcgcagcatagccgaggcaagcagcttcaccctcggcggcgcctccccttctccccggaccaagtcctttgccgatgtctcacctggcggcagccatggccgctcgaaatccattgctgctgctagtgacggcgccggtggaggcttccacggtaccatgagtcgcttcgtggactccttccgccgcggcgacggcaccatcaacaaaaatctcgacttggacgacgacaacaataccagctcacatgggtactcttcccacagcatctcgcgcggccatggcggcacgagatactatgacttgcgcccgggaactggcaaaataaacacgcccagctcgctgctggctagagagctaaagggccggcatctgcagatgattgccattggagggtccatcgggacgggtttgttcgttgcctctggcaagacattgagcgacggcggaccggcgagtgtgttgattgcctatctcatcattggcgtcatgctgttttgcacgatacaggccttgggcgagctggctgtcattttccccgtagccggatccttctcggccttctcgacgagattcttggatccaagttggggatttgctatggggtggaactacgctctgcaatggatcggggtactaccacttgaagtattagccggcgccatgacaataggatactggaataaagaaatcaacaaagccatattcgtcaccattttcctggtcatcatcttcgtcatcaatctttttggcgcaaaaggatacggcgaggcagagttcatctttgccatcatcaaagttaccgcggtggtaggattcatccttttaggtatcgtcatcaacataggcggcacccctaccgaaggctacatcggcggcaaatactgggaggaccccggtgccttccacaacggcttcaaaggtctctgctccgtcttcgtcaccgccgccttcgccttcgccggcactgaactcgttggcctggcagccgccgagaccgccaacccgcgcaaatcgctccccaccgccatcaagcaggttttctggcgtatttcgctcttctatatcgttagtatgacgctcgtcggtctgctcgtcccctacaacgagcctcgtctcctcaacgcccaaaacattgccgacgcttccgcctcgccttttgtcatcgccatcgaatccgccggcgctacggtcctcccctccgtcatgaacggcgttattctcatctcggtcatctccgtcggtaactccgccgtctacggctcctcgcgcactttggctgccctggccgaactaggccaagcccccgccatcctcgcctacgtcgaccgccgcggccgtcccatcgtcgccatcctcgtcaccatggccgtcggcctgctcgcgtacctgggcgacgtcccctcgcagaaaaacatatttgactggctcctggccatctcaggcctgtcctccatcttgacctgggcatccacctgtctcgcgcacatccgtctgcgcaaagcgtgggcgtacaaccaccgctcggtgcaagacattgcctttaaagcacagggcggcgtgattggttcgtggatcgggtttgttcttaatgttctggtgttggtgacacagatatgggtgtcgatcgacccgctccaccagggcgacacaccgttgacgaccaaagagcgggtgcgcagtttctttgtgagctgcttggcgattccggtggtgttgatttgtacgattgtgcataagtggtactataagacgaagtgggtaaggatcgaggatatggatgtggacacgggaaggcgagattttggacggttgggcattatcaaggcccaggagaaggaggagaggatggggtggccgaggtggaagcgggtttaccggtttatgtgctga

SEQ ID NO: 9190 - protein, 659 aa, Neurospora crassa
MAGFDQDIELSAYSHSHGLGISGNGRSGRQRSIAEASSFTLGGASPSPRTKSFADVSPGGSHGRSKSIAAASDGAGGGFHGTMSRFVDSFRRGDGTINKNLDLDDDNNTSSHGYSSHSISRGHGGTRYYDLRPGTGKINTPSSLLARELKGRHLQMIAIGGSIGTGLFVASGKTLSDGGPASVLIAYLIIGVMLFCTIQALGELAVIFPVAGSFSAFSTRFLDPSWGFAMGWNYALQWIGVLPLEVLAGAMTIGYWNKEINKAIFVTIFLVIIFVINLFGAKGYGEAEFIFAIIKVTAVVGFILLGIVINIGGTPTEGYIGGKYWEDPGAFHNGFKGLCSVFVTAAFAFAGTELVGLAAAETANPRKSLPTAIKQVFWRISLFYIVSMTLVGLLVPYNEPRLLNAQNIADASASPFVIAIESAGATVLPSVMNGVILISVISVGNSAVYGSSRTLAALAELGQAPAILAYVDRRGRPIVAILVTMAVGLLAYLGDVPSQKNIFDWLLAISGLSSILTWASTCLAHIRLRKAWAYNHRSVQDIAFKAQGGVIGSWIGFVLNVLVLVTQIWVSIDPLHQGDTPLTTKERVRSFFVSCLAIPVVLICTIVHKWYYKTKWVRIEDMDVDTGRRDFGRLGIIKAQEKEERMGWPRWKRVYRFMC

SEQ ID NO: 9191 - DNA, 1686 bp, Neurospora crassa
  CDS (1)..(1686)
atggcggaaaaacacctacactcttccgacccggaattggccggcgtcccttcacgacacagctcgtccgagaggaaaaacgatgcctacatggagggtgccgctgtccttgggggtgaggacgaagcggccagtctcaagtcgcgtcacattcagttcattgctctgggcggaactattggtaccggtctcttcctcggcatcggaaatgccttcacccacgctggccctctctccatcctgctcggttataccttcaccggtctcgctgttttcggtatgatgcagtgtctcggtgagatggccacatggcttcctcttcccggtgctatccctcagttctgcgctcgatacgtcgacgatgctctcggttttgctgtcggttggaataactggtactccgccgccatcactctatgcgccgaaatctcggccgcctctcttgtcatcggcttctgggaaggtgctcaaagcgtcaacgtcgccgtgtggatcagcatcatctgggttgttattatttttctcaacatctttgccgtttctctctacggcgaggccgaattctggtttgcatctatgaagcttatcaccattgtcggcctgctcatcatggccttcattgtcgaccttggcggaaacccgcgccacgaacgtcttggttttcgctactggaagaacccgggcgccatgaaagagtatccaccccaggtgcacggcgaccttggtcgttttttgggtctcttttctaccctcgtcaacgctgccttctcctacggcggtgtggaaatggtcgccgttgccgctggtgaggccgaaaacccacgcaagaacatccccaaggccgttcgtcgtgtcttctggcgtattctctttttctacgtcttgggttctctcgccattggtgtccttgtgtcttccaacgacaagggcctccttgatgctcaggccgaaggccgctccgacgctgctgcctccccatgggttattggcatcaagaacgctggcatctccgtcttgccctccatcatcaacgctgtcatcttgacttccgcgacttcctctggcaatgccttcctttacaccggctctcgctacctctacgctttggcgcagaaccgtcaggccccacgtatcttcctcacttgcagcaagaagggtgtcccctattacgccgttgccgccacggctatcatcggcggtctcacttacctctctgtcgatcccaacggtggtgccgcaaaggcgttcagctggttccagaacttaacgaccatcgctagtctcttcacctggtgctccatctgcgttgcttaccttcgcttctacaaggcgctaaaggctcagggcattagccgcgataccttggtcttcaagagcaggtttcaaccatacacggcatggttcgcgcttatctactttgctgtcattatcattttcagcgggtttgctgtcttcatcaaaggcaattgggatgtcgctgatttcatcgctgcctacattggcatccccatcttcttccttctgtacggtggctggaagattatcaagcgaccaaaggtcataaaaccatcggaggccgatctcacgactggaaaggcggcgcttgatgcagaggatgagcattggcagagagagtataagcctcctgtcaccataattgaaaagatttgggattggttggcgtaa

SEQ ID NO: 9192 - protein, 561 aa, Neurospora crassa
MAEKHLHSSDPELAGVPSRHSSSERKNDAYMEGAAVLGGEDEAASLKSRHIQFIALGGTIGTGLFLGIGNAFTHAGPLSILLGYTFTGLAVFGMMQCLGEMATWLPLPGAIPQFCARYVDDALGFAVGWNNWYSAAITLCAEISAASLVIGFWEGAQSVNVAVWISIIWVVIIFLNIFAVSLYGEAEFWFASMKLITIVGLLIMAFIVDLGGNPRHERLGFRYWKNPGAMKEYPPQVHGDLGRFLGLFSTLVNAAFSYGGVEMVAVAAGEAENPRKNIPKAVRRVFWRILFFYVLGSLAIGVLVSSNDKGLLDAQAEGRSDAAASPWVIGIKNAGISVLPSIINAVILTSATSSGNAFLYTGSRYLYALAQNRQAPRIFLTCSKKGVPYYAVAATAIIGGLTYLSVDPNGGAAKAFSWFQNLTTIASLFTWCSICVAYLRFYKALKAQGISRDTLVFKSRFQPYTAWFALIYFAVIIIFSGFAVFIKGNWDVADFIAAYIGIPIFFLLYGGWKIIKRPKVIKPSEADLTTGKAALDAEDEHWQREYKPPVTIIEKIWDWLA

SEQ ID NO: 9193 - DNA, 1713 bp, Neurospora crassa
  CDS (1)..(1713)
atggcggtgcgagaaagtacgccgccggcgccagcgagtcccggctcctccgctgccggatcgccacccggaagcgcaaccaaaaaggactttgtcaaggaacagtcggccgctgatgacgatgcggcctccttcgccgagcacaacgccggccccgagctgaagcgcaggctcaagtctcgccatttgcaaatgattgccattggtatcataggtggtactattggtactggtctcttcatcggttccggcagcgccctcgccaagtcgggccctgctggcgtcctcatcggctactgctttatcgcctccattgtttacagcatcatgatgtccctcggtgaaatggccacctacgtccccgtcaccggcggtttcaccacgtacgcggctcgctttgtcgacagctctctcggtttctccatgtcgtggatctactggttttcgtgggccattacctttgcgctcgagctggtcgctactggtctgatcattcagtattgggacgactctctgtccatcggtattttcatcgccatcttctgggtcgtcattttcgtcatcaacctgttccccgtgtcctggtacggcgaggcggaattctggatgtcctctgtcaaggtcatcaccgtcctcggcttcctcatcttcggcatctgcatcaacgccggcgccggtcagcagggctacattggcttcaagtactggcacgagccgggtgcttttgctccctacattgttgaccctagccgccctgtcgccaagtgggttggcttctggtccgtcatgatccaggccggcttctccttccagggcaccgagcttgtcggtatcgctgctggcgagaccgaagacccgcgccgcaacgtcccccgtgcgatccgcatgaccttttaccgtatcttcctcttcttcatcatgaccgtcttcttcatcggcatcctcatcccctacgacaacaaggacctgaacaatggcggctacaccgcggctgcctctccctttgtcattgcggcccagctcgccggcgtcaaggtcctacccgacatcatcaacgctgtcttgcttactgtcgtcctctctgccgccaactccaacgtctactcgggctctcgtgtcctcgtctccctcgccaacgacggcatggcccccaagtggttcaagatgaccaccaagtccggcgtcccctatattgccgtcatgtttacctcggcgttcggtttcctcggcttcctcaacctctctcccaacggcagccaggccttcgactggcttctcaacatttcgggcgtcgcgggtttcattgcctggtccggcatcctcatcgcccacctccgcttcatgaagggtcttgaggcgcacggcatcccccgctccaagctgccctatcgcgccacctgggccccttactacgtctactacgccctgttcttctgcatcttgatcaccctgacccaaggcttcaccgcgttcatgccctggagcgtcgaagaattctttgtggcgtacgtttcgctcatcatttttgctgtcatgtacctgggccacaagctctataccctcattgtctacggcgccgcggcgtgtaagccggtctctgccaaggacatggatgttactactgggtctttggatctggatgccgagatccccgacgaggtcgaggagcctacgagtatctggaagaagattggaacgggtatcatgggttaa

SEQ ID NO: 9194 - protein, 570 aa, Neurospora crassa
MAVRESTPPAPASPGSSAAGSPPGSATKKDFVKEQSAADDDAASFAEHNAGPELKRRLKSRHLQMIAIGIIGGTIGTGLFIGSGSALAKSGPAGVLIGYCFIASIVYSIMMSLGEMATYVPVTGGFTTYAARFVDSSLGFSMSWIYWFSWAITFALELVATGLIIQYWDDSLSIGIFIAIFWVVIFVINLFPVSWYGEAEFWMSSVKVITVLGFLIFGICINAGAGQQGYIGFKYWHEPGAFAPYIVDPSRPVAKWVGFWSVMIQAGFSFQGTELVGIAAGETEDPRRNVPRAIRMTFYRIFLFFIMTVFFIGILIPYDNKDLNNGGYTAAASPFVIAAQLAGVKVLPDIINAVLLTVVLSAANSNVYSGSRVLVSLANDGMAPKWFKMTTKSGVPYIAVMFTSAFGFLGFLNLSPNGSQAFDWLLNISGVAGFIAWSGILIAHLRFMKGLEAHGIPRSKLPYRATWAPYYVYYALFFCILITLTQGFTAFMPWSVEEFFVAYVSLIIFAVMYLGHKLYTLIVYGAAACKPVSAKDMDVTTGSLDLDAEIPDEVEEPTSIWKKIGTGIMG

SEQ ID NO: 9195 - DNA, 1506 bp, Neurospora crassa
  CDS (1)..(1506)
atgttgtcaaccggagtggacatcgagggacgacccccaaacctcgaacccgtcaaggcagcggacgccgaaaaggtcgctggttctagagccgatatcgctcataatgaggtcgcttccttgtctagtggcaccctcggcgacaatacccatcggaagctcaagtcgcgccatatccagctgatcggcatcggaggcaccatcggtacggccttttacgtccagatcggcaaaggtctcctcaacggagggcctgccagcttgtttctggccttcaccatctggtgtacctttatcctggccatcgccatgtgcatggccgaaatggtcacctatctgcccatctcttcgcccttcattcgctttgcgggccggtacgtggacgaggcctttggattcgctgcaggctggaactttttcatcttcgaagcggccatggtgccctttgaactcactgcttgtaacctgatcatccactactggagcgacgccgtacctgtaggcggcatcattgccattacgctggtcatctacggcttggtcaacctgctggctgtggagtggtatggtgaaaccgagttctgggctgcgctgggcaagtttctgctcattgtgggattgctcatcttcacctttgtcgtcatggtgggcggaaatcccctgggagatcgatttgggttcagatactggaaggaccccggcgctttcaccgagttgtattacactggttcccttggccgctggctgggcttccttcagtgcttgattcaggcaagctttaccattgctggaccggattacgttgccatggccgccggcgaagcagaaaacccccgtgtcgtcatgccccgcgccttcaacgccgtcttctaccgtctcaccgctttcttcgtcctcggctctctcgccgtcggtattctcgtcccttacaacgacgccgagatggccctcgccttttcctccggtgctcccggcgccgccgcctctccctacgttgtcgccatgaaccggctccgcatccgcgtcctccccgacattgtcaacgccatggtcctcaccgccgccttctccgccggcaacagctacgtttactgcgcctcgcgctccctctacggtctggcgctcgagggcaaggcccccaaggcgctgctcaagtgcacccggtccggagtgcccatttactgtgtcatgatcgtgctgtgctttggcttgttggcgtttctgcaggtcagcaacagcgcggccgtggtgctctcgtggttcattagcttgatgacggctagccagctgatcaactatagcgtcacttgcacttcgtatctgaggtggtacgcggcgctcaaggcgcaggggattgtgaagaagacgaaattccacaaggccgaggaaattgacttgcacaagaatctggacgaagtggaggagtatcaggcaaattatgtgccaaccccgtctaggggaacgctggttgacccgcgcctcgagtccgcatctgtcacattgtga

SEQ ID NO: 9196 - protein, 501 aa, Neurospora crassa
MLSTGVDIEGRPPNLEPVKAADAEKVAGSRADIAHNEVASLSSGTLGDNTHRKLKSRHIQLIGIGGTIGTAFYVQIGKGLLNGGPASLFLAFTIWCTFILAIAMCMAEMVTYLPISSPFIRFAGRYVDEAFGFAAGWNFFIFEAAMVPFELTACNLIIHYWSDAVPVGGIIAITLVIYGLVNLLAVEWYGETEFWAALGKFLLIVGLLIFTFVVMVGGNPLGDRFGFRYWKDPGAFTELYYTGSLGRWLGFLQCLIQASFTIAGPDYVAMAAGEAENPRVVMPRAFNAVFYRLTAFFVLGSLAVGILVPYNDAEMALAFSSGAPGAAASPYVVAMNRLRIRVLPDIVNAMVLTAAFSAGNSYVYCASRSLYGLALEGKAPKALLKCTRSGVPIYCVMIVLCFGLLAFLQVSNSAAVVLSWFISLMTASQLINYSVTCTSYLRWYAALKAQGIVKKTKFHKAEEIDLHKNLDEVEEYQANYVPTPSRGTLVDPRLESASVTL

SEQ ID NO: 9197 - DNA, 1791 bp, Neurospora crassa
  CDS (1)..(1791)
atggccgcttacggcagcagaggtggagattccttcggccagggaagttcatggagtttccgggaacccttcgcagtcggccgcgtcccgacatgggcacgcgctcgccatcgccaagaaccgaggttgcgaacattcctcgactcgttcaaacgggaccccgtccgccggatatcaacccatggcatctatgcccagagtcatcctgatcaataccaagcagccgactcctcggatgaacctccgaccgaacagaatcatggaagccactactttgacctgcacgccgccaacgtcaggacggcaaacacgggtctggcccgagagctcaaggggagacacttgcagatgattgccattgggggttcagttgctcttggagaactggccgttgctttccccgttgccggttccttctcgtcatactctacaagattccttgatccagcatgggggtttgccatggggtggaattatgccctccagtggttgacagtcctgccactcgaactcatagcagcttccatcaccatcggctactggaacgaccaactcaacaaagccatcttcatcaccatcttcctagcaaccgtcatcatcatcaacctcttcggcgtcaaaggctacggtgaagccgaattcgtcttttccattgtcaaaatcgccgccgtcaccggtttcatcatcctcgccgcagtcatcaacatcggcggcttcgacgacccccaaggcaacaccggctacattggcgggcggtactggaccaaccccggcgcttttcaccacggtttcaaaggtctctgctccgtctttgtctctgccgccttcgcctttacaggtaccgagctggtcgggctcgccgccgctgagaccgccaacccgcgtaaatccctgccgacagccatcaaacaagtcttttggcgcatcaccctcttctacattgtctctctcaccctcgtcggcctcatcgtcccttacaaccacgagcgcctcctgggaaacatccagcactactccgtctccgacgcctcgtactcgcccttcgttatagccatcgagtcggcctccatccaagtgctgccgggaattatgaacgccgtcatcctcatcgccgtactcagcgtaggcaactccgccgtcttcggtagttcccgcaccttagcagccctggccgaccagcgtcaagcgccccaaatcctcgcctacgtcgaccgcaagggtcgacccctcttcgccatcctttttgctgccctcgtcggcctgatcggctacctagccgacctgaaatttcaatccgacgtgctaaactggctgctcgccgtctcgggcctttcgtccatcttcacctggggctccatctgcctctgccacatccgctttcgccgcgcctgggcccgtcgcggccggtccctcacccaattatcctttacagcacaggcaggcatcacggggtcgtacgtcggcctttttctcaatgtctttgtgctgattgcccaattctggattgcggcgttcccgattgtcacgtttacagataaccagtcggcggctaccgcgtcgccgagtaaagtggcgcagagtttctttttgcagtatctgtgtgtgccgattgtggtggcgttttacttggtgtataagttgtggtttaggaccaagattgtgaggagtgatgagatggatttggacacgggacggaggagggatgtgaatttgcctgtgttggtgatgagggagaaggaggaggtagaagggtggccggggtggaagagggtttatcggtttttttgttga

SEQ ID NO: 9198 - protein, 596 aa, Neurospora crassa
MAAYGSRGGDSFGQGSSWSFREPFAVGRVPTWARARHRQEPRLRTFLDSFKRDPVRRISTHGIYAQSHPDQYQAADSSDEPPTEQNHGSHYFDLHAANVRTANTGLARELKGRHLQMIAIGGSVALGELAVAFPVAGSFSSYSTRFLDPAWGFAMGWNYALQWLTVLPLELIAASITIGYWNDQLNKAIFITIFLATVIIINLFGVKGYGEAEFVFSIVKIAAVTGFIILAAVINIGGFDDPQGNTGYIGGRYWTNPGAFHHGFKGLCSVFVSAAFAFTGTELVGLAAAETANPRKSLPTAIKQVFWRITLFYIVSLTLVGLIVPYNHERLLGNIQHYSVSDASYSPFVIAIESASIQVLPGIMNAVILIAVLSVGNSAVFGSSRTLAALADQRQAPQILAYVDRKGRPLFAILFAALVGLIGYLADLKFQSDVLNWLLAVSGLSSIFTWGSICLCHIRFRRAWARRGRSLTQLSFTAQAGITGSYVGLFLNVFVLIAQFWIAAFPIVTFTDNQSAATASPSKVAQSFFLQYLCVPIVVAFYLVYKLWFRTKIVRSDEMDLDTGRRRDVNLPVLVMREKEEVEGWPGWKRVYRFFC

SEQ ID NO: 9199 - DNA, 1653 bp, Neurospora crassa
  CDS (1)..(1653)
atgtccaagtacggcgatggaaacttcgccgaaaagcagggcggcggcgaggccctggatgtggcttcctctcacaaccaaggccaggtgattgacggtaccatttctctggacgccagccatcaattgcaaagaggtctcaagagtcggcacattcaatttctggctttgggaggagctatcggaacgggtctcttcgtcggttcgggtggtatcttggccaccgtcggcccagcgccgctatggctggcctacctatccatgatgcttcttgtctggatcgtcatgaactgtatcggcgaaatgtgcacataccttcctctcagaggaatcacactgccctactttaccgaacgtttcgtcgatgctagcctggggtttgccgctggctggaattattggtatgcgtacgccatcctcgtcgccgccgaagcgtccgcaggcgccatcctcctcaactactgggaaacaccagtgcctacctgggcctggatcaccatcatccttgttgttaatctggtcttgaacatcatcgcggtcgaggtctttggtgaggccgagttctggtttgccagcatcaagttcatcaccatcatggggctcatcattgttggcctcgtcatcatgctgggaggcgggccaaaccacaagcggttagggttccactattggaacgatccgggagcgttcaaggagtacctcgcacctggtgccactggcaggtttgctgcgtattggacggcattcgtccgcgccggattcagcttcatcacctcccccgaactcatcggtctcgctgctggtgagactgtcgcaccgagacgcaacatccccaaggccgcccgccgtttcttgggtcgtctggctgtcttttatggtatcagctccttgatcgtaggctgcattgttccctcggataacaagaacctgctttccggcacctcggacgccagcgccagtccttgggttataggtattcagctcgccggtatcggcggcctgaaccatgttatcaacgctgccatcttgacctctgcttggtccgccggtaacgcgttcttgtactcaggatcccgtatcctgtattctctggcccaaaacggccaagcacccgctattttcacgagaactaccaggcgtggtgttccatataccgccgtcttgatgacctgggcattttctctgcttgcgtacctgaacgtatccaacaacggcgctcaggtgtttacctggttctccaacctttccaccatctccgggtacattggctggatcgttctgctcatcacttacctgcgattccgtcaggcgctcaaggtccagggactgttggcgacactgcccttcaaaactccgggccagccatatgcggcatggtttgccctggtcatgatcagcatcttgacactcacaaacggattccaggtgtttgtcaagtggaattacaaggatttccttgcagcgtacattaccttgcctgctttccttgttctatacttcggccataagatctggcacaggacgccgttccacaagcccgccgttgagatcgatgtattgacaggcaagaaggagatggacgatatgtgcgcgaatgacgtggacccggttccgaggaattggttggagaagatctggttttggatcgcatga

SEQ ID NO: 9200 - protein, 550 aa, Neurospora crassa
MSKYGDGNFAEKQGGGEALDVASSHNQGQVIDGTISLDASHQLQRGLKSRHIQFLALGGAIGTGLFVGSGGILATVGPAPLWLAYLSMMLLVWIVMNCIGEMCTYLPLRGITLPYFTERFVDASLGFAAGWNYWYAYAILVAAEASAGAILLNYWETPVPTWAWITIILVVNLVLNIIAVEVFGEAEFWFASIKFITIMGLIIVGLVIMLGGGPNHKRLGFHYWNDPGAFKEYLAPGATGRFAAYWTAFVRAGFSFITSPELIGLAAGETVAPRRNIPKAARRFLGRLAVFYGISSLIVGCIVPSDNKNLLSGTSDASASPWVIGIQLAGIGGLNHVINAAILTSAWSAGNAFLYSGSRILYSLAQNGQAPAIFTRTTRRGVPYTAVLMTWAFSLLAYLNVSNNGAQVFTWFSNLSTISGYIGWIVLLITYLRFRQALKVQGLLATLPFKTPGQPYAAWFALVMISILTLTNGFQVFVKWNYKDFLAAYITLPAFLVLYFGHKIWHRTPFHKPAVEIDVLTGKKEMDDMCANDVDPVPRNWLEKIWFWIA

SEQ ID NO: 9201 - DNA, 1671 bp, Mycobacterium bovis
  CDS (1)..(1671)
atgccggacgatatcgcggctgccgacccgacagacacccagccgcacctgcgtcgggaccttgccaaccgccatattcagttgatcgcgattggaggcgcgatcggcaccggcctattcatgggatctgggcgaacgatctcgctcgccggtccggcggtcatggtggtctacgggatcattgggttttttgtgttttttgtgttgcgcgcgatgggcgagctgctgctgtcgaacctgaactacaagtcgttcgttgacttcgccgccgacctcctgggcccggcggcgggctttttcgtggggtggtcgtactggttcgcatgggtggtcaccgggatcgcagacctcgtcgcgatcaccggctatgccaggttttggtggcccggcttgccaatctgggtcccggccctggtcacggtcgccctgattctcgctgtcaatttgttcagcgtccgccacttcggggagctggagttttggttcgcattgatcaaggtcgctgccatcgtgtgcctcatcgccgtcggcgcgatcctggtggcaaccaacttcgtctcccctcatggtgtgcacgcgaccatcgagaacctgtggaacgacaacgggttcttcccaacgggtttcctgggcgtggtcagtggctttcagatcgcgtttttcgcatacatcggtgtggagctcgttggcaccgccgcggctgagacagcggacccgcgccgcacccttccccgcgcgatcaatgccgtgccgttgcgggtcgcggtgttctacatcggtgccctgctggcgatcctggccgtcgtgccgtggcggcagttcgccagtggcgagtccccgtttgtgacgatgttctccctagccggacttgccgctgcggcgtcggtcgtcaacttcgtcgtggtcaccgcagcggcctcgtcagcgaactccggcttcttctccaccgggcgaatgcttttcggcctcgccgacgaaggccacgctccggccgctttccaccaactcaatcgcggcggcgtgcccgcacccgccctgctgctgacggctccgctactgctgacctccatcccgctgctctatgccggtcggtcggtgattggggcgttcacactcgtcacgacggtctcatccctgctgttcatgtttgtgtgggcaatgatcatcatcagctacctcgtctaccgtcgccgacacccacagcgtcacaccgactcggtgtacaagatgcccggtggcgtggtgatgtgctgggccgtgctggtgtttttcgcgttcgtgatctggacacttaccaccgaaaccgaaaccgcaaccgcgttggcgtggttcccgctatggttcgtgctgctcgccgtgggttggctcgtcacccagcgccggcagagccgccgcagctttggttttcactgccaggtcgtcggggttcgtcagcagctcggccgcggtatggccaggcttgcaatgaaaatccacgcgcggcccaaactccgaagtgcggtcgtcgtcgagccagtgtcagcaggtgaaccaggtgcccgcaggtccgcgaaatctgtgcgtaagctagcgagcgatgattcgcaaagcgcgcattgccccgttgcggtggtcggtctggcggatggcggccgggatccgcaatatcaccacgacgggccagatcggtga

SEQ ID NO: 9202 - protein, 556 aa, Mycobacterium bovis
MPDDIAAADPTDTQPHLRRDLANRHIQLIAIGGAIGTGLFMGSGRTISLAGPAVMVVYGIIGFFVFFVLRAMGELLLSNLNYKSFVDFAADLLGPAAGFFVGWSYWFAWVVTGIADLVAITGYARFWWPGLPIWVPALVTVALILAVNLFSVRHFGELEFWFALIKVAAIVCLIAVGAILVATNFVSPHGVHATIENLWNDNGFFPTGFLGVVSGFQIAFFAYIGVELVGTAAAETADPRRTLPRAINAVPLRVAVFYIGALLAILAVVPWRQFASGESPFVTMFSLAGLAAAASVVNFVVVTAAASSANSGFFSTGRMLFGLADEGHAPAAFHQLNRGGVPAPALLLTAPLLLTSIPLLYAGRSVIGAFTLVTTVSSLLFMFVWAMIIISYLVYRRRHPQRHTDSVYKMPGGVVMCWAVLVFFAFVIWTLTTETETATALAWFPLWFVLLAVGWLVTQRRQSRRSFGFHCQVVGVRQQLGRGMARLAMKIHARPKLRSAVVVEPVSAGEPGARRSAKSVRKLASDDSQSAHCPVAVVGLADGGRDPQYHHDGPDR

SEQ ID NO: 9203 - DNA, 1401 bp, Shigella flexneri
  CDS (1)..(1401)
atggggcaatcatcgcaaccacacgagttaggcggcgggctgaaatcacgccacgtcaccatgttgtctattgccggtgttatcggcgcaagtctgtttgtcggttccagcgtcgccatcgccgaagcggacccggcggtattactggcctatctgttcgccggattactggtggttatgattatgcggatgctggcggaaatggcagttgccacgcccgataccggttcgttttccacctatgccgataaagccattggccgctgggcgggctataccatcggctggttgtactggtggttttgggtactggttatcccactggaagccaacatcgccgccatgatcctgcactcgtgggttccaggcattcccatctggttattttccctcgtcattaccctcgccttaactggcagtaatttattaagcgttaaaaactacggcgaatttgagttctggctggcgctgtgcaaagtcatcgctatcctggcctttattttccttggtgcagtcgcaattagcggtttttacccttatgccgaagtgagcgggatctcaagattgtgggatagcggcggctttatgcccaacggtttcggtgcggtattaagcgcgatgttgatcaccatgttctcgtttatgggcgcagaaattgtcaccattgccgccgcggaatccgacatgccggaaaaacatattgtccgcgccaccaactcggttatctggcgtatttctatcttctatttgtgctctatttttgtcgtcgtggcattaataccgtggaatatgccggggctgaaagccgttggatcttatcgctcggttctggaattgctcaatattccccatgcgaaattaatcatggactgtgtgatattactttccgtaaccagttgcctgaactcggccctgtataccgcctcaaggatgctctactccttaagccgtcgcggtgatgctcccgcggtaatgggtaaaatcaaccgcagtaaaaccccgtacgtggcggtgttactctccaccggcgcagcattcttaacggtggtggtgaactattacgcgcctgcgaaggtatttaaatttctgatcgacagctccggcgctatcgccctgctggtttatttagtcatcgccgtttcacagttgcggatgcgcaaaattctgcgagcagaaggaagcgaaattcgcttgcgaatgtggcttgatccctggctcacctggctggtcatcggctttattacctttgtgttggtagtgatgctattccgtccggcgcaacagttagaagtgatctccaccggcttattagcgatagggattatctgtaccgtgccaattatggctcgctggaaaaagctggtattgtggcaaaaaacacccgttcataatacgcgctga

SEQ ID NO: 9204 - protein, 466 aa, Shigella flexneri
MGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDPWLTWLVIGFITFVLVVMLFRPAQQLEVISTGLLAIGIICTVPIMARWKKLVLWQKTPVHNTR

SEQ ID NO: 9205 - DNA, 1374 bp, Shigella flexneri
  CDS (1)..(1374)
atggaaagtaagaataagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaaccttggcccgctggcaggttacattaccggatggacctactgttttgaaatccttattgtcgccatcgccgatgtgaccgcttttggtatctatatgggtgtcttgttcccgacggtgccgcactggatttgggtactgagcgtggtgctgatcatttgcgccgtaaacctgatgagcgtgaaggtcttcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgattccgcgtgcgattaactccgtgccgatgcgtattctggtgttctacgtcggtacgctgttcgtcattatgtctatctacccgtggaatcaggttggcactgccggtagcccgttcgtactgacgttccagcatatgggcattacctttgccgccagcattcttaactttgttgtgctgaccgcttcgctgtcggcaattaacagtgacgtatttggcgtaggccgtatgctccacggtatggcagagcagggcagcgcaccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtatgggtgtggattatgatcctgctgtcgcaaatcgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccaataa

SEQ ID NO: 9206 - protein, 457 aa, Shigella flexneri
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 9207 - DNA, 1470 bp, Mycobacterium bovis
  CDS (1)..(1470)
atgagcgcggcctcacagcgtgtcgacgccttcggcgaagaggccggctatcacaaaggcctcaagccccgacaactgcagatgatcgggatcggcggcgcgattgggaccggcctgttcctcggcgccagcggccggcttgccaaggccggacctgggttgttcttggtgtacggcgtgtgcggggtttttgtcttcctgatcctgcgggcgctgggtgagctggtgctgcaccgtccgtcgtcaggctcgtttgtgtcgtatgcacgtgaatttttcggcgagaaggccgcttacgcggtgggctggatgtacttcctgcactgggcgatgacgtcgatcgtggacaccaccgcgatcgccacctacttgcagcgttggacgatcttcacggtggtcccgcaatggattcttgccctgatcgccttgacggtggtgttgtcgatgaacctgatttcggtcgaatggttcggcgagctggagttttgggccgcgctgatcaaggttctcgcgctgatggcgttcctagtggtgggaaccgtttttttggccgggcgataccccgtcgacggccacagcaccggattgagcttgtggaacaaccatggcgggctgttcccgacaagctggctgccgctgctgatcgttacctcgggagtggtgttcgcgtactcagcagtcgaattggtagggacggcggccggggagaccgccgagccggagaagatcatgccgcgggcgatcaattcggtggtcgctcgcatcgcgatcttttatgtcgggtcggtggccctgctagcgctgttgctgccgtataccgcctacaaggccggcgagagcccgttcgtcacgttcttttccaaaatcggtttccacggtgccggtgacttgatgaacatcgttgtgcttaccgccgcgctgtcgagcctgaacgcggggctgtattcgaccggccgcgtcatgcattcgatcgcgatgagcggcagcgccccaaggttcaccgcgcgaatgtcgaaaagcggtgtgccctacggcgggatcgtgttgaccgcggtcatcaccctgttcggtgtcgcgctgaacgccttcaagcccggtgaagccttcgagattgtgctcaacatgtccgcgctgggcatcatcgcgggttgggccaccatcgtgctgtgtcagcttcgacttcacaagctggccaacgccgggatcatgcagcggccgcggttccgcatgcccttctccccctacagcggctacctcaccttgctcttcttgcttgtcgtgctggttacgatggcgtccgacaaaccgatcggcacctggacggtggcgacactgattattgtcattccggccctgaccgcaggctggtacctggtacgcaagcgtgtcatggccgtcgcccgcgaaaggctgggtcataccgggccatttccggcggtcgccaacccgcccgtgaggtcaagagactga

SEQ ID NO: 9208 - protein, 489 aa, Mycobacterium bovis
MSAASQRVDAFGEEAGYHKGLKPRQLQMIGIGGAIGTGLFLGASGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 9209 - DNA, 1575 bp, Bordetella bronchiseptica
  CDS (1)..(1575)
atggctccaccggaccacgtcgtccccagcccggcgaacggccaccgccatgacgcccggcccgccacgcgcctgcccgaaccgacgagcctgcgccgcaccctgtcggcgcgccacctgaccatgatcgcggtcggcggctcgatcggcaccggcctgttcgtcgcctcgggcgccaccatcgcccaggccggcccgggcggcgccctgctggcctacttgctggtcggcatcatggtgtacttcctgatgaccagcctgggcgaactggcggccagcatgccggtggcgggctcgttctccacctacggcgccaagtatgtcgacgaaggcttcggcttcgcgctgggctggaactattggtacaactgggccgtgaccgtcgcggtggacctggttgccgcgcagctggtcatggcctattggtttcccgaaatgcccggcgtgctctggagcgccgccttcctggcgctgatcgtcgggctgaacgccctgtcggcgcgcggcttcggcgaggccgagttctggttcgcgctgatcaaggtgatcgcggtgctggcgttcattgccatgggcgtgctgatgctgctgggcatcatccgcggcggcgagcacggcggcctggcctactggaccctggacgacgcgccattcgccggcggattcgccgcgctgatcggcgtggccatggtagtgggcttttcgttccagggcaccgagctgatcggcatcgccgccggcgaatccaaggacccggcccgcaacctgccgcgcgccgtgcgccaggtgttctggcgcatcctgctcttctacgtgctggccatcgccgtcatcggcctgctgattccctataccgatccgcaattgctgcgcaacgaggtgtccgacgtcagcgtcagcccgtttgcgctgatcttcgagcgcgccggcctgctggcggccgcctccatcatgaatgcggtggtgctgacgtcggtgctgtcggcaggcaattccggcatgtacgccgccacccgcatgctgtacagcctggcccgcgacggcaaggcgccggcgcgcttcggccgcctgtcgcgcagcggcgtgcccctgtgggcgctgctggccaccaccgcggtcgccgcgctgtgttttctgtcgttcctgttcagccccaaggcggtgtacatctggctgctgaacacctcgggcatgaccggattcatcgcctggctgggcatcgccatcagccactaccggtttcgccgcggctatgtcgcccagggcaacaacctggccgacctgccgtatgtctcgcccttcttcccgttcggcccgctgttcgcgttcgtcctgtgcctggtcatcacgctgggccagaactaccacgccttcctgcaggaccgcatcgactggaccggcgcggccgccacctatgtcggcattccgctgttcctggcgatctgggcgggctatcgcctggtgcgcggctcgcgcttcgtgcgctaccgcgacatgcagttccccgacctgcgcatgcgcaaccgcgagttgaacgccatgctcagcggcgactgcgccgagccccgccgctag

SEQ ID NO: 9210 - protein, 524 aa, Bordetella bronchiseptica
MAPPDHVVPSPANGHRHDARPATRLPEPTSLRRTLSARHLTMIAVGGSIGTGLFVASGATIAQAGPGGALLAYLLVGIMVYFLMTSLGELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 9211 - DNA, 1494 bp, Staphylococcus aureus
  CDS (1)..(1494)
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggtgaaatggctacgtatttaccagtatcaggttcatttagtacatatgctacaagatttgttgatccatctttagggtttgcgcttggttggaactattggtttaactgggtagtaactgtagcagcagatattacgattgcagcacaagtcattcaatattggacaccattgcaaggcatacccgcttgggcatggagtgcgttgtttttagttataatttttagtctgaattcgttatcagttcgcgtctatggtgaaagtgaatactggttggcattgataaaagtgattacagttattgttttcattgcaattggtttattaacgattgtaggaatcatgggtggtcatgttgtaggatttgaaatatttaataaaggtgaaggtcctattcttggtggcaacttaggaggaagtttgttatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatgggtggtagtgataatgtagcaacgtctccattcacattagtgtttaaaaatgcaggatttgcttttgcagcatcatttatgaatgctgtcatcttaacatcagttttatcagcaggtaactctggaatgtatgcctcaacgcgaatgctttattcaatgagtaaagataaattagcgtttgaagcatttgggaaaacaaataaaaatggcgtgccatatatgtctttattagttactgcaattattgtagtcattatattggtattacaaagtcttacaaaaggtgcttacgaatacatcgttgctgcaagtgggttaactggctttattgcctgggtaggtatcgcagtgagtcattaccgatttagaagagcatttgataaacaaaattatgataaatctaaattgaaatatacagctaaattattcccgttcggacctttatttgcaggctttttatgtattgtagtaatcatcgggcaagatgttgactttattaaaacaggagattttaattttagtcgcttcttaattacgtatatgggaatcccagtatttttagcattctttatttatcataagcttcgatataaaacgaagaaaattccattagaacaagtagatttacgtcaagacgtgtcaatggatgaaataaaaggttaa

SEQ ID NO: 9212 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 9213 - DNA, 1395 bp, Bacillus cereus
  CDS (1)..(1395)
atggataaaaatctaaagaaagacctcaaaatacgccacattacaatgatttcaattggcggcgtaataggggctggtttgtttgttggaagtggtgcagttgtacattcggcaggaccaggttctatcgtttcatatgcattagcaggacttctagtcattttcgtcatgagaatgctaggagaaatggcagctgttaatccgacaagtggttcatttgcaacgtatgcaagagaagcgattggtccttgggcgggttatacaataggctggttatattggtttttttgggtaattgttattgcaatagaagccacagcaggtgctggtattatccaatattggattccacaaataccgctttggttattaagtttaatattaacaattttattaacgctgacgaacgttttttcggtgaaatcatttggagagtttgaatattggttttcttttattaaagtaataagtattgttttgttcctttgtctaggtcttgctgttattttaggatttgttccaggaacagaagcacccggcacttcgaatttaattggacaaggtggatttatgccaaacggtataagttcggtcctgcttggaattactgttgttatattttcatttatgggatcagagattgtagcagtagcggctggtgaatctgcagaacctgtaaaagcagtaaaaacagcaacaaacagtgtgatttggcgtattcttgtattttttattgggtctatagcggtagttgttacgctactgccatggaattcagcaaacatattaaaaagtccatttgtagctgtacttgaacatataggaataccagcggcagcacaaattatgaattttatcgttttaacagctgtactttcttgcttaaattcaggcttatatacaaattcaagaatgcttttttcaatggcagaaagaggagatgctccaaagtcatttttaaaattgaacagtagtggtgttcccgttcgagcggttttatttggaactttcttcgcttatattggagttgtgtttagttacatttctccagataaagtctttttgtttttagtgaatgcatctggcgggattgcgttactagtttatctcgttattgcagtttcgcatttaaagatgcgtaaaaaaatggggaaagtagaacaacaaaatttgaaagtgaaaatgtggctttttccgtatgtaacgtatgttacaattgctgctattatagcagttttagttgcgatgttcgcaattgatactttacgttcacaagcacttttaacaatgtttgttacagttcttatcatactttcttattttatttttaatagaaataaaaatagcacagttttgaatcctaaaagtaagaatgaggaatctgttcgattctaa

SEQ ID NO: 9214 - protein, 464 aa, Bacillus cereus
MDKNLKKDLKIRHITMISIGGVIGAGLFVGSGAVVHSAGPGSIVSYALAGLLVIFVMRMLGEMAAVNPTSGSFATYAREAIGPWAGYTIGWLYWFFWVIVIAIEATAGAGIIQYWIPQIPLWLLSLILTILLTLTNVFSVKSFGEFEYWFSFIKVISIVLFLCLGLAVILGFVPGTEAPGTSNLIGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKSFLKLNSSGVPVRAVLFGTFFAYIGVVFSYISPDKVFLFLVNASGGIALLVYLVIAVSHLKMRKKMGKVEQQNLKVKMWLFPYVTYVTIAAIIAVLVAMFAIDTLRSQALLTMFVTVLIILSYFIFNRNKNSTVLNPKSKNEESVRF

SEQ ID NO: 9215 - DNA, 1377 bp, Bacillus cereus
  CDS (1)..(1377)
atgaaaagaggtttagaagcacgtcatattcaaatgattgctttaggcggaacgattggtgttggtttgtttatggggtcagccagcacaattaaatggacaggtccgtcagtaatgcttgcttatgccattgcaggtatttttatcttcttcatcatgcgtgccatgggagaaatgttgtatatggagccaagtacaggctcatttgcgacgttcggtcataagtatattcacccgttagctggttatatgacagcgtggagtaactggttccagtgggttatcgttgggatgtcagaaattatcgcggttggagcatatatgcaatattggttcccggatttaccagcttggataccaggtataatcgcaatggttattcttggtgcagctaacttaatttcagttaagtcatttggtgaatttgaattttggtttgcgatgattaaaatcgttacgattctattaatgattattgcgggatttggccttattttctttggaattggtaacggcggagaagcgattggcatatctaatctttggtcaaatggcggtttctttacaggtggtttttcaggattcttctttgcattatcacttgtagttggagcgtatcaaggtgtggaattaatcggtattactgctggtgaagcgaaggatccaaagaagacacttacaagagcgattcaaagtacaatttggcgtattttaattttctacatcggtgctattttcgttattgtaactgtgtatccgtgggatcaattaagtacaattggtagcccgttcgtagcgacttttgcgaaagttggtattacggcagcagctggacttattaactttgttgttattacagcagcaatgtctggttgtaatagtggtatttatagtgctggtcgtatgctttatacgttaggtgtaaatggacaagcaccgaaatattttacgaaactttctggaaatggtgtacctttatttggtacagttggcgtaattatcggtctggcggttggtgttgttttaagttacatcgcaccgaaaaacttattcgtatatgtatatagtgcgagtgtacttcctggtatggtaccatggtttgtcattttaattagtcaaattaattttagaaaagaaaagggagcagagatgaaagatcatccattcaaaatgccatttgctcctgtaacaaactatttaacgattgcctttttaattatggtattaatcggaatgtggtttaacgatgatactcgtatttcattagttgtaggtattattttcttagctatcgttacaattagtttctatgctttcggaataggaaagcgagctccgttagacgttcaaaataataaagagatttcaagtaaataa

SEQ ID NO: 9216 - protein, 458 aa, Bacillus cereus
MKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGIIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIIFLAIVTISFYAFGIGKRAPLDVQNNKEISSK

SEQ ID NO: 9217 - DNA, 1425 bp, Bacillus cereus
  CDS (1)..(1425)
atggcgcaagtaagcaatacaaacaatgaattaaaacgtacgatgaaaagtagacacttattcatgattgcactcggtggtgtgattggaaccgggttatttaacggatctggctttattataagtcaggctggacctggtggatccgtacttgcctttattgctggtggattattaatgtatttcgttatgctatgtcttggtgaacttgctgtagccatgcctgtttcaggttcctttcaggaatatgctactaaatttatcaatcctgcaactggctttacaatcggatggttgtattggttaagctgggcgaatacgaccggtcttgaatttacaactgccggtattacaatgcagcgctggtttcctgatattcctgtttgggtttggtgtttaatatttggcgttaccatcttcactattaacgcattatctgctcgtagttatgcagaaacagaattttggttttcaagtataaaagtatctgccattatagcttttatacttcttggtggcgccgctatgttcggttttattgatttaaaaggcgatgaaccagctccacttctttcaaatttcgtaaatcatggtggtttatttccgaatggacttgcagctattctattaacaatggttacagtcaattattccttccaaggtacagagcttgtcggaatcgcagcaggtgaaagtgaagatccagcaaaaactttacctcgttctattagaaatattatatggcgcacaatgtttttcttcgtcttagcaatctttgttcttgttgctttaattccttgggaagaagctggattaacaaagagtccattcgttgctgtttttgataatatcggtattccatatgcagctgatattatgaactttgttattcttactgctgttctttctgtcgcaaactcaggactatacgctgctactcgaatgctttggtctttatcaaaaaacgaaatggctccagcatttttaaagaaattatcatcacgtgggattcctctcaacgctttaatcatgacaatagctatttctgctttttctcttttgacaagtgtagtagctgctgaaactgtttacttgtggctcatttcaatttccggagtcattaccattattgtttggatgtcaatttgtgtttctcaattctttttccgcaaacattatttagcagacggcggaaaattagaagacttaaaatttaaaacgccactttatccactcgtaccaattcttggttttggattgtatggcattatattaatcagtcttatttttatcccagaacaacgacttggaatctattgcactgtcccatttatcatcttttgctacacttactatcactttaaagttaagaaaagaaattctactaacactcatagtgaaactaaaattagcgagacttcgtaa

SEQ ID NO: 9218 - protein, 474 aa, Bacillus cereus
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 9219 - DNA, 1416 bp, Bacillus cereus
  CDS (1)..(1416)
atgaatcaacaaattgaacaaacagatttaaaacgaacaatgaaaagtagacacctatttatgattgcactcggcggtgttatcggaaccgggttatttatgggatctggtcaaattgtccataatgccggacctggtggtgctattcttgcatttttagtcggtggatttgttatgtatttaacgatgttatgtcttggtgaattatccgtcgctatgccagaagcaggttcattccaaagttatgcaagcaaattcatttcacctggttttggatttgttgtcggttggatgtattggttaaattgggctgttacagttggcgtagagttaacaactgtaagtattttaatgaaacgctggtttccagacgtttcttcctggatttggtgcgttacatttgcagcagcactcttcctcgtaaacgctttatcagcaaaagcatatgcagaagcagagttttggttcgcaagtgtaaaagtcgcaacaattgttattttcatcgtacttggcggcgctgttatgttcggtctactagactttaatggaaagccagctccaatgcttcataatttcactgaaaatggcgggctatttccaaatggtgcattagctgttcttcttacgatgattacagtaaattactccttccaaggaacagaattaatcggaatcgcttcaggcgaaagtgaaaatcctgaaaaaacaattccaaaagcaattaaaaacacaatttggcgaactctcttcttcttcgtcttagcgatatcagttgttgtaggtttactcccatggcaagaggctaatctagtcgaaagtccctttgtacttgtatttgatgtagccggtgtcccatatgcagcagacattatgaactttgttattattacagctgtattatccgttgctaactctggtctctacgcaaattctcgtatgctgtgggcgatggcaaaacaaggaatggcaagtccagcatttacgaaattaactaaaaaaggtgtaccgctaaatgcattaattttcagcctaattttcgctagcctgtccttactaacaagtgtatttgcggcagatactgtctttctagttttaacatctattgcagcaatggctgccgttgtcgtttggatgtcaatcgccgcttcacagtttttcttccgtagaaatttcgtgaaaaacggtggcaacataaatgatttaaaatatcgtacaccgctctatccactagttccaatcgtagcgttttcgctgaatttcattacatttgttagtttggctttcattccagatcaaagaattgctctttattgtggcattccatttatgattatttgttacattttatatcaagttaaatataaaaaaattgtcacacttgaacagccacgaactgtcatacgagaaataaactaa

SEQ ID NO: 9220 - protein, 471 aa, Bacillus cereus
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 9221 - DNA, 1392 bp, Bacillus cereus
  CDS (1)..(1392)
atgcagcacacaaacaaatctggaactttaaatcgtggtttaaaagaacgacatattactttaatgtcactgggctcagctattggcgttgggctatttttaggatccgcttccgccattaaactagcaggtccttctattttgctaggctatatgattgccggtctcgttatttttttcattatgcgagcgcttggggaaatggcaattgaacaacctgttgctggttcttttagtaaatatgcatatgattatattggaccactcgctggttatattactggttggaattactggttcttatgggttgttacttgtatggctgaaattacagcagctggtatttacatgcagtactggttcccagatatcccgcgctggacttgggcattacttgctctattattaatgagcgcttttaacttcttatcggtaaaagtatttggagaacttgagttttggtttgctctcattaaaattgtcacaattatctgtatgatagtagtcggagctggtattattttattcggattcggaaacggtggtatcgctactggtatttcaaatctttggtcacatggtggctggttcccaaatggattttctgggttactactctccatgcagatggtactattcgcttatttaggcgttgaattaatcggtgttacagctggtgaggctcaaaatccgaagaaaacactcgcaaaggcaatcgataacgtattttggagaattctactcttttacgttggggcattattcgttatgatggcaatttatccatggaacgaacttggtgagaaaggcagtccattcgtattaacattccaacaaattggtatcgcaaaagcagcaggtattattaactttgtcgtattaacagcagctctttcttcttgtaacggtggtttatttagtacaggccgtatgctatatacattagctcagcagaaaaaagctcctgaaagatttggtcgtttaaataaaaatggcattccaagccaaggaattgtagcaactgctatcgttttactaattggtgttatattaaactatctcgtacctgcaaaggtatttacatggcttactagcatttcaactttcggtgcaatttggacttggggaattatattagtcgctcaaattaaattccgtaaaagcttgcctactcaaaataaacaaaagttatcgtataaaatgcctttatacccattaagctcatatttctcactcgttttccttgtattagtattaggtataatggcgtattcagaagatacacgaattgcattgattgtcggcccaatttggcttatcggcttagcaatcgtatattacatgaaagggtttcataagattgatgaaacacctaactcaaaaattagttaa

SEQ ID NO: 9222 - protein, 463 aa, Bacillus cereus
MQHTNKSGTLNRGLKERHITLMSLGSAIGVGLFLGSASAIKLAGPSILLGYMIAGLVIFFIMRALGEMAIEQPVAGSFSKYAYDYIGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNKQKLSYKMPLYPLSSYFSLVFLVLVLGIMAYSEDTRIALIVGPIWLIGLAIVYYMKGFHKIDETPNSKIS

SEQ ID NO: 9223 - DNA, 1467 bp, Bacillus anthracis
  CDS (1)..(1467)
atgaatagcgcaacgaatcaaactacctctcaaacagaaactacaaaaggaaaaggtgaattaagacgcggtctaaaatcaaagcaccttacgatgatttctctcggcggtacaattggtaccggactatttcttgccagcggtggtgtcattcattcagctggacctggcggcgcattaattgcatacgccgcaattggaattatggtttactttttaatgacaagcttagccgaactcgcagcttacatgcctgttactggatcttttagcacgtacgcaacaaaatttgttgatccatcacttggctttgcacttggatggaactattggtataactgggcaattactatcgctgctgaactagcggctgtaacattaattatgaaattttggtttccagatactccttccctcatttggagcggattatgtttagctattattttccttttaaactacttatctgttaaaggatttggtgaatctgaatattggttcgcacttattaaagtagctacgattattatctttttaattgtcgggtttatgatgattttcggaattatgggcggcgaaactgttggatttaaaaacttcactgttgcagatgcaccatttaacggcggcatcatggcaattatcggtgtatttatggcagctggtttctcattccaaggtactgaattattaggtgtagctgctggtgaaacatctgatccagagcgtaatattccaaaagcaattcgttcgatcttttggcgtatccttttattctatatccttgcgattctcgttatcggtttattaattccttatacaactgaaagtcttgccgcaagtgatgtaacagtaagtccatttacacttatttttgaaaaagcgggcgttgccttcgctgcttctgttatgaacgctgttattttaacggcagtactatctgctggtaactctggtatgtatgcatcaactcgtatgctttgggacttagctcgccaagggaaagcaccaaagtttcttggtaaattagatagccgcggcgtacctgttaacgcattaatcgtaacatcgattgtcggtagtatcgctttcattgcttctttattcggtgacggtgttgtatacatttggttactaaatgcatcaggaatgtctggctttatcgcatgggttggaatcgcaattagtcattaccgtttccgcaaagcatatatcgcacaaggaaaagatttaaatgacttaccttatagagcaaaatggttcccattcggaccaatcttcgcttttgcgctttgcgtcatcgtaattttaggtcaaaactacggcgcatttatgggcgaatcaatcgattggaacggcgtactcgtttcttacatcggtttaccactcttcttagtactttggttaggatacaaatttacgaaaaaaacaaaagtcattccacttgataaatgtgaactaaaataa

SEQ ID NO: 9224 - protein, 488 aa, Bacillus anthracis
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 9225 - DNA, 1425 bp, Bacillus anthracis
  CDS (1)..(1425)
atgtcgcaagtaaacaatacaaacaatgaattaaaacgtacgatgaaaagtagacacttattcatgattgcactcggtggtgtgattggaacggagttatttaacggatctggctttattataagtcaagctggacctggtggatccgtacttgcctttatggctggtggattattaatgtatttcgttatgctttgtcttggtgaactcgctgtagctatgcctgtttcaggttcttttcaggaatatgcaactaagttcatcaatcctgcaactggatttacaatcggctggttatattggttaagctgggcaaatacgaccggtcttgaatttacaactgctggcattacaatgcagcgctggttccctgatattcctgtttgggtttggtgtttaatatttggtgttacaatcttcatgattaatgcattatctgctcgtagttatgcagaaacagaattttggttttcaagtataaaagtatctgccattatagcttttattattcttggcggcgccgctatgttcggtttaattgatttaaaaggcgacgaaccagccccattattatcaaatttcgtaaatcatggcggtttattcccaaatggacttgcagctattctattaacgatggttacagttaattattccttccaaggtacagaacttgtcggaatcgcagcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgctgtttttgataatatcagtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctttaaacgctttaattttgacaatttctatttctgctttttctcttttaacaagcgtcgtagctgctgaaacagtttacttatggttaatttccatttctggcgtcattacaattattgtttggatgtcaatttgtgtttctcaattctttttccgtaaacattatgtagcagacggtggaagattagaagacttaaaatttaaaacgccactttatccacttgtaccaattcttggttttggattgtatggcattatattagtaagtcttatctttatcccagatcaaagactaggcatttattgtactgtaccatttatcatcttttgctacacttactatcactttaaagtgaagaaaagaatttctactaacacttctagtgaaaataaaattagcgagactatataa

SEQ ID NO: 9226 - protein, 474 aa, Bacillus anthracis
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 9227 - DNA, 1395 bp, Bacillus anthracis
  CDS (1)..(1395)
atggataaaaatcttaagaaagacctcaaaatacgccacattacaatgatctcaattggcggcgtaataggagctggtttgtttgttggaagtggggcagttgtgcattcagcaggaccaggttctatcgtttcatatgcattagcaggacttttagtcgttttcgttatgagaatgcttggggaaatggcagctattaacccgacaagtggatcatttgcaacatatgcaagagaagcaattggtccgtgggccggttatacaattgggtggctatattggtttttctgggtaattgttattgcgatagaagccacagcgggtgctggtattattcagtactggattccagaaatcccgctttggttattaagcttaatattaacgattttattaacattgacgaatgttttttcagtgaaatcatttggagagtttgaatattggttttcttttattaaagtaataagtattgttttgttcctttgtcttggactagctgttattttaggatttgtaccaggaacggaagcacctggcacttcgaacttagtggggcaaggaggatttatgccaaacggtataagttcggtgctacttggaattactgtcgttatattttcatttatgggatcagagattgtagcggtagcagctggtgagtctgcagaacctgtaaaagcagtaaaaacagcaacaaatagtgtaatttggcgtattctcgtatttttcattggatctatcgctgtagttgttacacttcttccgtggaattcagcaaacatactaaaaagtccgtttgtagcggtgctagaacatatagggataccagcggcagcgcaaattatgaattttatcgttttaacagctgtactttcttgtttaaattctggtttatatacgaactcaagaatgcttttttcgatggcggaaagaggagatgctccaaaggcgttcttgaaattgaacagtagtggtgttccagttcgggccgttttattcggaacgttcttcgcttatattggagttgtttttagttacatatctccagataaagtctttttatttttagtgaatgcctctggtgggattgcgttactcgtttatctcgttatagctatttcgcatttaaagattcgtaaaaaaatgggaagggtagaacaacaaaatttgaaagtgaaaatgtggtttttcccgtatgtgacgtatgttacaattgcagctattatagcagttttaattgcgatgcttgccattgaatctttacgttcacaagcacttttgacgatgcttgtcactgttcttataatcatttcttattttatttttaatagaaataaaaatagtacagtgttgaatactaaaagtaagaatgaggaatctgtccgattttaa

SEQ ID NO: 9228 - protein, 464 aa, Bacillus anthracis
MDKNLKKDLKIRHITMISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 9229 - DNA, 1392 bp, Bacillus anthracis
  CDS (1)..(1392)
atggcaaacaaagaattgaaaagaggtttagaagcacgtcatattcaaatgattgctttaggcggaacgattggtgttggtttgtttatggggtcagccagcacaattaaatggacaggtccgtcagttatgcttgcgtatgcaattgcaggtatttttatcttcttcatcatgcgtgccatgggagaaatgttgtatatggagccaagtacaggttcatttgcgacattcggtcataagtatattcatccgctagctggttatatgacagcgtggagcaactggttccagtgggttatcgttgggatgtcagagattatcgcggttggagcgtatatgcaatattggttcccggatttaccagcttggataccaggtgtaatcgcaatggttattcttggcgcagctaacttaatttctgttaagtcatttggtgaatttgaattttggtttgcgatgattaaaatcgttacgattctattaatgattattgcgggatttggacttattttctttggaattggtaacggcggagaagcgattggcatatcgaatctttggtcaaatggcggtttctttacaggtggtttttctggattcttctttgcattatcacttgtagttggagcgtatcaaggtgtggaattaatcggtattactgctggtgaagcgaaggatccgaagaagacacttacaagagcgattcaaagtacaatttggcgtattttaattttctacatcggtgcgattttcgttattgtaactgtgtatccgtgggatcaattaagtacaattggaagtccattcgtagcaacttttgcgaaagttggtattacggctgctgcgggattaattaactttgttgttatcacagcagcaatgtctggttgtaatagtggtatttatagtgctggtcgtatgctatatacgttaggtgtaaatggacaagcaccgaaatatttcacgaaactttctggaaatggtgtacctttattcggtacagttggcgtaattatcggtttagcggtcggtgtagttctaagttatattgcaccaaaaaacttattcgtatatgtatatagtgcgagtgtacttcctggtatggtaccatggtttgtcattttaattagccaaattaattttagaaaagaaaagggagcagagatgaaagatcatccgttcaaaatgccgtttgctcctgttacaaactatttaacaattgcctttttaattatggtattagtcggaatgtggtttaacgatgatacgcgtatttcattagttgtaggtattgttttcttagctatcgtaacaattagtttctatgctttcggaatagggaaacgacctccgttagatgttccaaatgatcaagagatttcaagcaaataa

SEQ ID NO: 9230 - protein, 463 aa, Bacillus anthracis
MANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 9231 - DNA, 1422 bp, Bacillus anthracis
  CDS (1)..(1422)
atgatgaatcaaaaccaaggattaaaaagagaattgaagagcaggcacatatttatgattgcacttggaggagttattggtactggcctttttttaggatctgggtatacaattcatgaagctgggcctggaggagcgattgtagcgtatcttgtcggaggatttgttatgtatttaacgatgctctgtcttggagagttagctgttgcaatgcctgacgcagggtcttatcaaacgtatgcaactaagcacatttcccctgcagcgggttatgtagtcggatggatgtcgtggttgaactggtcagctacgataggtattgaactaattgcagttagtattttaatgaaacgatggtttccagatgtaccgtcatggatttggtgcgtagtgtttgcggtactgctttttgctattaatgcgttatcttcaagaagttttgcagaagttgaattttggtttgcaagtattaaagtcattacaatcattgcatttattattttgggcggggcagcaatgtttggttttctagatatgaaaggaaatgaaccagcaccaatgttctctagttttactgattatggtggattgtttccaaatggattatccgctattttaattacgatgattgctgttaacttttccttccaaggaacagaactagtcggtattgcagcaggtgagagtgaaaatccagagaaaacaatcccgaaggcaattaataatacagtttggcgtatactcgtgttctttgtattatctattttcattcttgcaggattattcccttggcaacaggcgggagtaatagaaagtccattcgtagttgtatttgataaaattggtattccttatgcagccgatattatcaatttcgttattattacagcggttctatccgttgcgaattcaggattatacgcaacttctcgtatgctatggtctatgtctaatcaaggaatgattagtccgatttttggtaagttatctaaaaatggtgttcctatttatgcattgattgtaagtacaattgtaggttgcctttcattactatcaggtatttatgcggaagatacagtttatttatggctactttctattgccgggttcggagcgatattagtttgggcatctattgctctatctaacttattagctagaaggtcatatataaagcagggcggagatgtgaaagacttgaaatttaaaacaccactgtatccattcgtaccgctgcttgcattagtattaaatgtaacagtaattgttggtatggcctttattccagaacaaagaatggcgttatattgtggaattccatttatgattgtttgcttactgttttaccgtgcgacaagaaataaggcacataaagtagaacatattgaaaagacagatacaacagaagtagacagtttataa

SEQ ID NO: 9232 - protein, 473 aa, Bacillus anthracis
MMNQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 9233 - DNA, 1485 bp, Streptomyces avermitilis
  CDS (1)..(1485)
atgacctcgcagccgaccctgtcgaaggccgaaaacggcccggaccgacccggagaacccggcggcggcctccaggccggactcaagaaccgtcacctttcgatgatcgccatcggtggcgtcatcggagccggtctcttcgtgggctccagcaccggcatcgccaccgcgggcccaggcatccttctctcgtacgccctcgtcggcacgctcgtcgtcctcgtgatgcgcatgctcggcgagatgtccgcggccaacccgacgtccggctccttctccgcgcacgccgaccgcgcgctcggccgctgggccgggttctcgatcggctggctgtactggttcttctgggtggtggtgctcgccgtcgaggcgaccgccggggccaagatcctcgaagggtggatgcccggcgtaccgcagtggggctgggcgctcatcgtgatggtggtgctcaccgcgaccaacctggtctccgtcggttcgtacggcgagttcgagttctggttcgccgggatcaaggtcgtggcgatcggcgcgttcatcgtcgtcggcggcctcgcgatcttcggcgtgctgccgggcgtcgacgccccgaaggccggcctcggcaacctgaccgacagcggcggcttcctgccccacggccccggcgcgatcctcaccggtgtgctcctggtcgtcttctccttcatgggcagcgagatcgccacgctggcggccggtgagtccgaggacccgcagcgcgcggtcaccaagtcgacgaacagcatcatctggcgcatcggcgtcttctacctgggctcgatcctggtcgtcgtgtcgctgctcccgtggaacgacccgtcgatcaaggacaagggctcgtacgtcgccgccctcgactccctcggcatcgcgcacgccggtcagatcatgaacttcatcgtgctgacgtcggtgctgtcctgcctcaactccgggctctacaccgcctcccgcatggcgttctcgctcggccagcgcggggacgcgccgaaggcgttcgcgcggaccacgtcccgcggtgtgccgctggccgcgatcgtcgtgtccgtcgtcttcggcttcgtcgccgtcttcttcaactacaagttcccggactcggtcttcctcttcctggtcaactcctccggtgcggtcgccctgttcgtctggctggtgatctgcttctcgcagctgcggatgcgcaagatcatccagcgggagtcgccggagaagctcgtcgtgaagatgtggctgtacccgtacctgacctgggcgacggccgcgctgatcgtgttcgtgctcggttacatgctgacggacacggagcacgacgggcgcgagacggtgctgctgtcgctgctcgtggccgcggtggtgctggtgatcgccgtggtgaagcagaagctggacggttcccgggcggtggctgccgcgggtgccgacgagccggctgtggccgaggccgtggccgacgcgcactga

SEQ ID NO: 9234 - protein, 494 aa, Streptomyces avermitilis
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 9235 - DNA, 1389 bp, Streptomyces avermitilis
  CDS (1)..(1389)
atgtcctcccgcaccacccttgacacggcaccggagacatccgctgccgacgcccccctgtcccacggcctcaagcagcgccacctgtcgatgatcgctctcggcggagtgatcggcgcgggcctgttcgtcggctccggcgcgggtatcgccgccgccgggccgtcgatcgtcatcgcttactcggtctccggcctgctcgtcatgctggtgatgcggatgctaggcgagatgtcggccgcctatccctcgtcgggctccttctcggcgcacgccgagcgggcgatcggcccctgggcgggcttcaccgccggctggtccttctgggtgctgctgtgcacggccgtcggcctggagggcatcggcgccgcgaagatcgtcaccggctggctgcccggcactcccgagtggggctgggtggccctgttcatggtcgtcttctgcgtggccaatctcgccgccgtgaagaacttcggcgagttcgagttctggttcgcggcgctgaaggtcggcgcgatcagtctgttcctggtcctcggcgtgctggccatgaccggagtgctgcccggcacggactctccgggcgcctcgaacctccacgacttcctgccgaacggcagcgagggcctggtcatcggtctgctcgcgtcggtcttcgcgtacggcggtctggagaccgtgacgatcgcggcggcggagtccgagaacccggtccagggcgtcgcgcgcgccgtgcgcaccgcgatgtggcgcatcgcgctcttctacatcggctccatggcggtcatcgtcacgctcgtcccgtgggactcgaaggaggtcgtcgagaagggcccgtacgtcgccgccctcgaccacctgggcatcccgggcgccggtcagctgatgaacgtggtcgtgctggtcgcgctcctgtcggcgatgaacgccaacatctacggctcctcacgcatcgcctactcgctggtggagcgcggacagggcccgaaggcgctgggccgggtctccgggggcgtcccgaggatcgccgtactggtctcctgcgtgttcggcttcgtgtgcgtggtcctcagctactggcggccgaacgacgtcttcccctggctgctgaacatgatcggcgcggtcatcctggtcgtctggatcttcatcgcggtctcgcagctgctgctgcgccgcaaggtcgagcgagaggcaccggagaagctggtcgtgcggatgtgggcgtacccggtgctgacctgggtggccctggcgggcatggcggcgatcttcatcctgatggcccggcagccggacacccgcgtacagctctactcgacgggcgccatgacgctggtcctggccgccgtcggctacgcctggcagcgggcacgcgcgcgggcctga

SEQ ID NO: 9236 - protein, 462 aa, Streptomyces avermitilis
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 9237 - DNA, 1452 bp, Streptomyces avermitilis
  CDS (1)..(1452)
atgacctcatcgcaggtcgacaagcagtacgacggcaatggggccgtgggcggcgacgcccccgaagaggggtacgagcgcgggctcggcagccgccaggtccagatgatcgcgatcggcggcgccatcggcgtcggcctgttcctgggcgccggggcgaacatcgccaaggccgggcccagcctgatcctcatgtacgccctcgcgggcgtgatcatcttcttcatcatgcgggcgctcggcgagctgctcctgtaccgcccggtgtcgggttccttcgcggagtactcccgcgagttcctcggcccgttcttcggctacttcaccggctggacgtactggctgatgtgggtggtgaccggcatggcggaactgaccgccgccgcgatctacgtccactactggttcccggccgtcccacagtgggtgacggccctggtcttcctggtcgtcctgttcgtggccaacctgatctcggtgaagctcttcggcgagatcgagttctggttctcgatggtcaaggtcaccgcgctcatcggcatgatcgtgatcggcctcggtgtgctcaccttcggcttcagctcggccggtgacaccgcctccgtcgccaacctctggcagttcgacggcttcttccccaagggcatcggctcgtccctgatgaccctccagggcgtcatgttcgcctacctggccgtcgagctggtcggtgtgacggcgggcgagtccgaggacccggagaagaccctcccgaaggcgatcaacaccctgccctggcgcatcgccctcttctacgtgggtgccctcaccgtcatcctctgcgtcgtgaagtggaccgagttcgcgcccggcgtgagcccgttcgtcaaggccttcgcgatgatcggcatcccggccggcgcgggcatcgtcaacttcgtcgtcctcaccgcggccctgtcctcgtgcaactccggcatgtactccacgggccgcatgctgcgcacgctcgcggacaacggcgaggccccgagggtcttcagcaagctctccgcctcgaagacgcccgccttcggcatcacgatctcggtcctcttcatgggcatcggcgtgatcctcaactacgtcgtcccggagaaggccttcggctacgtcacctcggtggccaccgcggccggcatctggacctggctgatgatcctggtcagccacgtcctgtaccgccgcgcggtcgacgcgggccgactgcccgcgtcctccttcccggcaccgggcggcgcgaagtgcagctgggtcgcgatcgtgttcctgctcttcgtgaccggcctgatcgcgtacgacgccgactcccgggtctgcctctacgtgatggccgtctgggccgccgcgctggccatcggctggtacgtcctcaaggcccgcaacccgcaggtcgccgagcgccacgagccgaagttcgagaaggtcggctga

SEQ ID NO: 9238 - protein, 483 aa, Streptomyces avermitilis
MTSSQVDKQYDGNGAVGGDAPEEGYERGLGSRQVQMIAIGGAIGVGLFLGAGANIAKAGPSLILMYALAGVIIFFIMRALGELLLYRPVSGSFAEYSREFLGPFFGYFTGWTYWLMWVVTGMAELTAAAIYVHYWFPAVPQWVTALVFLVVLFVANLISVKLFGEIEFWFSMVKVTALIGMIVIGLGVLTFGFSSAGDTASVANLWQFDGFFPKGIGSSLMTLQGVMFAYLAVELVGVTAGESEDPEKTLPKAINTLPWRIALFYVGALTVILCVVKWTEFAPGVSPFVKAFAMIGIPAGAGIVNFVVLTAALSSCNSGMYSTGRMLRTLADNGEAPRVFSKLSASKTPAFGITISVLFMGIGVILNYVVPEKAFGYVTSVATAAGIWTWLMILVSHVLYRRAVDAGRLPASSFPAPGGAKCSWVAIVFLLFVTGLIAYDADSRVCLYVMAVWAAALAIGWYVLKARNPQVAERHEPKFEKVG

SEQ ID NO: 9239 - DNA, 1464 bp, Streptomyces avermitilis
  CDS (1)..(1464)
atgagcaaggacgccgtagacacggccagggttgcatcgcgcaccgatgtgacccagtcgcccgcggacgcaggcgacgccggttacagcaaggacctcaaggcccgccacgtcaacatgatcgcgatcggcggagcgatcggcaccggtctcttcctcggtgccggcggccgcctccacaacgcgggaccagccctcgccatcgcctacctcgtctgcggcgtcttcgccttcttcgtggtccgggccctcggcgaactggtcctctaccggccctcgtccggatccttcgtgtcgtacgcgcgcgagttcctcggcgagaagggcgcgtacgttgccgggtggatgtacttcctgaactggtcgacgaccggaatcgcggacatcaccgcgatcgccctctacacccactactggagcctcttcaccgacatcccgcagtgggtgctcgcgctgatcgcgctcgcggtcgtcctggccgtgaacctgatctcggtgaagatcttcggcgagatggagttctggttcgcgatcatcaaggtcgccacgctggtcggattcatgctgatcggcatcttcctgctggccacgcaccacgaggtcggcggccacaccccgggcctgagcgccgtcacggaccacggcgggatcttcccgcacgggatgatgccggtcgtcctggtgatgcagggcgtgatcttcgcgtacgcggccctggagctggtcggtgtcgcggcgggcgagaccgccgagccggagaaggtcgtcccgcgcgcggtgaactcgatcatgtggcgcgtcggcctcttctatgtcggctcggtcgtcctgctcgcactgctgctgcccggatcggtgtactcggcggaccagagccccttcgtcacggtgctgtcgaagatcggcatcccggcggccggtgacgtgatgaacctggtggtcctcacggccgccatgtcgtcgctgaactccggtctctactcgaccggccgcatcctgcgctccatggccatggcgggctcggcgcccaagttcacggcgcggatgaaccgcagccaggtcccgtacggcggcatcctgctcacctgcgcggtctgcgtcctcggcgtcggcctcaactacctgatgccgacccaggccttcgagatcgtcctgaacgtggcatccctcggcatcatcagcacctgggtgatcatcatgatctgccacctggtgttcgtccgccgcgcccgggcgggcctggtgacccggccgtccttccggctgttcggcagccccgtcacggagatcgtcacgatcgccttcctgctggccgtgctcggcctgatgtggaacgaccccgaggtcggccgtaagaccctcctcctcatcccgctcgtcgccgtcctgctggtgggcggctggttcgcggtccgccgccgggtctcgcaggccgaggaccgggagctcgcgcagctgaagtag

SEQ ID NO: 9240 - protein, 487 aa, Streptomyces avermitilis
MSKDAVDTARVASRTDVTQSPADAGDAGYSKDLKARHVNMIAIGGAIGTGLFLGAGGRLHNAGPALAIAYLVCGVFAFFVVRALGELVLYRPSSGSFVSYAREFLGEKGAYVAGWMYFLNWSTTGIADITAIALYTHYWSLFTDIPQWVLALIALAVVLAVNLISVKIFGEMEFWFAIIKVATLVGFMLIGIFLLATHHEVGGHTPGLSAVTDHGGIFPHGMMPVVLVMQGVIFAYAALELVGVAAGETAEPEKVVPRAVNSIMWRVGLFYVGSVVLLALLLPGSVYSADQSPFVTVLSKIGIPAAGDVMNLVVLTAAMSSLNSGLYSTGRILRSMAMAGSAPKFTARMNRSQVPYGGILLTCAVCVLGVGLNYLMPTQAFEIVLNVASLGIISTWVIIMICHLVFVRRARAGLVTRPSFRLFGSPVTEIVTIAFLLAVLGLMWNDPEVGRKTLLLIPLVAVLLVGGWFAVRRRVSQAEDRELAQLK

SEQ ID NO: 9241 - DNA, 1461 bp, Streptomyces avermitilis
  CDS (1)..(1461)
atgagcgagcagtccctcaaaggcgaggcccaaggcgcgatacggaccgggacgcagccctcgcggcacgtcgacgccggagacgcgggctacgccaagtccctgaagtcccggcacgtcaacatgatcgccatcggcggcgccatcggcaccgggctcttcctcggcgcgggcggtcgcctcgccgacgcgggaccgtccctcttcgtcgcgtacgcggtctgcgggatcttcgccttcctcgtcgtccgggcgctcggcgaactcgtcctgtaccggccctcctccggcgccttcgtgtcgtacgcccgggagttcctcggcgagaagggcgcgtacacggccggctggatgtacttcctcaactgggccaccaccggtatcgccgacatcaccgcggtggccgtctacacccactactggggcatgttctccgacatcccgcagtgggtgatcgcactgatcgcgctcgccgtcgtcctcaccgtgaacctgatctccgtacgcatgttcggcgaactggagttctggttcgcgatcatcaaggtcagcgcgctcgtcgtcttcatgctcatcggcatcttcctgctggtcacccagcacccggtcgacggccaccaccccggcccgtccctgatcaccgaccacggcggcatcttcccccacggcctgctgccgatgctgctgatcatccagggcgtcgtcttcgcgtacgcctccgtcgagctggtcggtgtcgcggcgggcgagaccgagaaccccgagaagatcatgccgaaggcgatcaactcgatcatgtggcgcgtcggcctcttctacgtcggctcggtcgtcctgctgtcgatgctgctgccctggaacaagtacaccgccggccagagccccttcgtgaccgtcctctccaacatcggcgtcccggcggcgggcggcgtgatgaacctcgtcgtcctcaccgcggccatgtcctcgctcaactccggcctgtactccaccggccgcatcctgcgctccatggccatgtccggctccgcgccgaagttcaccggcgtgatgagccgcagccaggtcccctacggcggcatcctgctcaccagcggcatctgtatcctcggcgtcggcctcaacttcgtggtcccggccgacgccttcgagatcgtgctcaacttcgcggcgatcggcatcctcgccacctggggcatgatcatgctctgccacctcatgttctggcggaagacccgcaccggcgagctgtccaggccgagctaccgcctccccggctcgccgtggaccgagatcgtcaccatcggcttcctcgtcagcgtgctcgtcctgatgtacgccgacggcggcgccggccgtacgacggtgctgtgcctgccgctgatcgcggcggcgctggtggccggctggtacggcgtacgcggccgggtcgcccgcaaggcctccggagcggacgcgtga

SEQ ID NO: 9242 - protein, 486 aa, Streptomyces avermitilis
MSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 9243 - DNA, 1353 bp, Enterococcus faecalis
  CDS (1)..(1353)
atgagtgaaacacaacaaacaaccttaaaaaaacaattaagctcgcgccacattacgatgttagccttagggggagcgattggcgcaggtctttttaaaggaagtggcgaagcaattggtattgctggtccttctgttttaatcgcctttctaattggcggtgctgttctcttcatcgtcatgagtggtttaggaaaacttgttttagatggcggagacacacatcatggtttgtctggcttggttcgaccatttttaggtgcacattctgctgattttattgattgggtttattattccatgtggacaattaatattatcgcagaagcggttgccgcagcttcctttttacaactttggtttcctaatattcctgcttggttttttgtttttattttagctattttaacgacgctcattaatctttactcggttcgtttatttgcagaaacagaatattggttggcgtttgctaaaattagtgtcatcattttgttaattatttttggtgtttatctggtgggacaacaaatgctaggcagtggtgtcttccctactttacaaagtatcaccgatcatggtggcttcgccccacatggcatgaaaggtatagttaattctttattagtagttatttattcttatggcggttcagaattaatcgcgattactgtcagtgaagcagatgatcctaaaaaagccattcctaaagcgattcgtggtgtgatgggacggattatttccttctatatcattccattattcttacttttgattattttcccttggaataccttagcaggcacaacggtgagtccatttgttatggtttttgaaaaaatgaatattccttttgctgctgacatcgtaaattttgtgattattttagccttgttttcttctattaattctggagtatacgcctcttctcgccttttatattttcgcttaaaagataaaaaaggacccatgagtaaactaggggttttaaacaagcaccaagtacctcaacgttcagttttcttctgcgccagtgttttatatctgggcgttattctttcttattttgttggcgatgaattatttggttacttagccggttctctctcttacactgtcttgctaatttggattttaattagcgctgcggcgtttgttctgtctttaaaacgagggtctctctttgaaaaaagtattaatctccttgcgttaatcattttaggtctcatctttattggcatcttatttacaaattcgttaggcgtcactcttttaacaggcctactgtactttgttattttctttagttatcgtaagaaaaatgattcctttctactctctgatgaaagctaa

SEQ ID NO: 9244 - protein, 450 aa, Enterococcus faecalis
MSETQQTTLKKQLSSRHITMLALGGAIGAGLFKGSGEAIGIAGPSVLIAFLIGGAVLFIVMSGLGKLVLDGGDTHHGLSGLVRPFLGAHSADFIDWVYYSMWTINIIAEAVAAASFLQLWFPNIPAWFFVFILAILTTLINLYSVRLFAETEYWLAFAKISVIILLIIFGVYLVGQQMLGSGVFPTLQSITDHGGFAPHGMKGIVNSLLVVIYSYGGSELIAITVSEADDPKKAIPKAIRGVMGRIISFYIIPLFLLLIIFPWNTLAGTTVSPFVMVFEKMNIPFAADIVNFVIILALFSSINSGVYASSRLLYFRLKDKKGPMSKLGVLNKHQVPQRSVFFCASVLYLGVILSYFVGDELFGYLAGSLSYTVLLIWILISAAAFVLSLKRGSLFEKSINLLALIILGLIFIGILFTNSLGVTLLTGLLYFVIFFSYRKKNDSFLLSDES

SEQ ID NO: 9245 - DNA, 1413 bp, Shigella flexneri
  CDS (1)..(1413)
atggtagatcaggtaaaagtcgttgccgatgatcaggctccggctgaacagtcgctacggcgcaatctcacaaaccgacatgttcagcttattgccattggaggtgccattggtactgggttgtttatggggtccggcaaaacgattagccttgccgggccgtcgatcattttcgtttatatgatcattggttttatgctctttttcgtgatgcgggcaatgggggaattgctgctttcgaatctggaatacaaatcttttagtgacttcgcttccgatttactggggccgtgggcgggatatttcaccggctggacttactggttctgctgggttgtaaccggtatggcagacgtggtggcgatcacggcttatgctcagttctggttccccgatctctccgactgggtcgcctcgctggcggtgatagtgctgctgctgacgctcaaccttgccaccgtgaaaatgttcggtgagatggagttctggtttgcgatgatcaaaatcgtcgccatcgtgtcgctgattgtcgtcggcctggtcatggtggcgatgcactttcagtcaccgaccggtgtggaagcgtcattcgcgcatttgtggaatgacggcggctggttcccgaaaggtttaagtggcttctttgccggattccagatagcggttttcgctttcgtggggattgagctggtaggtacaacagctgcggaaaccaaagatccggagaaatcactgccacgcgcgattaactccattccgatccgtatcattatgttctacgtcttcgcgctgattgtgattatgtccgtgacaccgtggagttcggtagtcccggagaaaagcccgttcgttgagctgtttgtgttggtaggtttgcctgcggctgccagcgtgatcaactttgtggtgctgacctctgcggcgtcttccgctaacagcggtgtcttctctaccagccgtatgctgtttggtctggcgcaggaaggtgttgcgccgaaagcgttcgctaaactttctaagcgcgcagtacccgcgaaagggttgaccttctcgtgtatctgtctgctcggcggcgtggtgatgttgtatgtgaatcctagcgtgattggcgcgttcacgatgattacaaccgtttccgcgattctgtttatgttcgtctggacgattatcctttgctcttacctggtgtaccgcaaacagcgtcctcatctgcatgaaaagtcgatctacaagatgccgctcggcaagctgatgtgctgggtatgtatggcgttctttgtgttcgtggtcgtgttgctgacactggaagatgacactcgccaggcgctgctggttaccccgctgtggtttatcgcgctggggttgggctggctgtttattggtaagaagcgggctgctgaactgcggaaataa

SEQ ID NO: 9246 - protein, 470 aa, Shigella flexneri
MVDQVKVVADDQAPAEQSLRRNLTNRHVQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 9247 - DNA, 1254 bp, Shigella flexneri
  CDS (1)..(1254)
atggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtttttttcatcatgcgttcaatgggcgaaatgttgttcctcgaaccggttaccggttcgttcgccgtttatgcgcatcgttatatgagcccgttttttggctatctcaccgcctggtcttactggtttatgtggatgacggtggggatctcagaaatcaccgccattggcgtttatgtccagttttggtccccggagatggcgcagtggatacccgcattgatcgcggtggcgctggtggcgttggcgaatctggcggcggtacggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgcgggtggctggaaagggttcctgaccgctctgtgtattgtggtggcgtcctaccagggcgtggagctgattggcattactgccggtgaagcgaagaatccgcaggtgacgctgcgcagtgccgtaggcaaagtgctgtggcggatcctgattttctacgtaggcgcgattttcgttatcgtcaccatcttcccgtggaatgaaattggcagcaacggcagcccgttcgtactgacttttgccaaaatcggtattaccgcagcggcgggcattatcaactttgtggtgctgacggctgcgctctctggctgtaacagcggcatgtacagttgcggacgtatgctctacgcactggcgaaaaaccgtcagttaccggcggcaatggcaaaagtttcccgtcacggcgtaccggttgcgggtgtggcagtatctattgctattctgctaattggctcatgcctgaactacatcattcccaatccgcagcgtgtgtttgtctacgtctacagtgccagcgtgcttccggggatggtgccatggtttgtgatattgataagccagctgcgttttcggcgtgcacataaagcggcgattgccagccatccgttccgctcaatcctgttcccgtgggccaactacgtaacaatggcattcctgattgcgttttga

SEQ ID NO: 9248 - protein, 417 aa, Shigella flexneri
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMTVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLIAF

SEQ ID NO: 9249 - DNA, 1278 bp, Shigella flexneri
  CDS (1)..(1278)
atgacccgacgcgggaaatgtcggggcgctctcccaagtgacacactttcgagaggattcaggatggggcaatcatcgcaaccacacgagttaggcggcgggctgaaatcacgccacgtcaccatgttgtctattgccggtgttatcggcgcaagtctgtttgtcggttccagcgtcgccatcgccgaagcggacccggcggtattactggcctatctgttcgccggattactggtggttatgattatgcggatgctggcggaaatggcagttgccacgcccgataccggttcgttttccacctatgccgataaagccattggccgctgggcgggctataccatcggctggttgtactggtggttttgggtactggttatcccactggaagccaacatcgccgccatgatcctgcactcgtgggttccaggcattcccatctggttattttccctcgtcattaccctcgccttaactggcagtaatttattaagcgttaaaaactacggcgaatttgagttctggctggcgctgtgcaaagtcatcgctatcctggcctttattttccttggtgcagtcgcaattagcggtttttacccttatgccgaagtgagcgggatctcaagattgtgggatagcggcggctttatgcccaacggtttcggtgcggtattaagcgcgatgctgatcaccatgttctcgtttatgggcgcagaaattgtcaccattgccgccgcggaatccgacatgccggaaaaacatattgtccgcgccaccaactcggttatctggcgtatttctatcttctatttgtgctctatttttgtcgtcgtggcattaataccgtggaatatgccggggctgaaagccgttggatcttatcgctcggttctggaattgctcaatattccccatgcgaaattaatcatggactgtgtgatattactttccgtaaccagttgcctgaactcggccctgtataccgcctcaaggatgctctactccttaagccgtcgcggtgatgctcccgcggtaatgggtaaaatcaaccgcagtaaaaccccgtacgtggcggtgttactctccaccggcgcagcattcttaacggtggtggtgaactattacgcgcctgcgaaggtatttaaatttctgatcgacagctccggcgctatcgccctgctggtttatttagtcatcgccgtttcacagttgcggatgcgcaaaattctgcgagcagaaggaagcgaaattcgcttgcgaatgtggcttgatccctag

SEQ ID NO: 9250 - protein, 425 aa, Shigella flexneri
MTRRGKCRGALPSDTLSRGFRMGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDP

SEQ ID NO: 9251 - DNA, 1818 bp, Kluyveromyces lactis
  CDS (1)..(1818)
atggctgaaaaggtttacttggacgcacagttgtccagagttgacacagacgaagatatcgaaaagcaacaattgtttggtgatgataacatagtaatcgagagatcttcgcaattattttacgatggtcaatctgatagcaaggttcatggtataacttctggtcatggttcggatgttaagaacgttgttactcatacgtcagaattcgatggtaaacatgatggtatcagattgaagaaagctctagaggctagacatgtttctatgattgctattggtggttcccttggtactggtcttcttatcggtacagggtcttctcttgcacttgcaggaccagctgccatccttatcgcttatgcgtttgtcggattgttggtgtttttcgttatgtcttgtcttggtgaaatggcagcttatatccctctagatgggtttacctcatattctactagatacgcagaccctgccttgggtttcgcagtcggttacgcatacttgttcaaatactggattatcgttcctaaccaattgaccgctggtgctcttgtcattcagtactgggtcgatcgtgacaaggtgaaccccggtgtatggatcactattttattggtcgctatcattacaatcaatttcttgggtgttagattctttggtgaaatcgaatactatatctctgcagtgaagattaccgtcatgctgggtcttatcattttgttgttggttcttgcatgtggtggtggtccaaaccatgaggtgttgggtttcaaatattggaaaaatccaggtgcattcaaagaatactctactgccatcactggtgctaagggtagattcgtgtcgttcgcttcggttttcgtgctagcccttttcgcttatttgggtactgaactatgtggtatcgttgtctctgaatgtaagaacccaagaaaagcggttccaaaggctatcaaattgaccatgtaccgtattatcgttttctacttgatttccatcttcttgcttggtatgtgcgtgccattcaatgatccattgttaattagcgctaagagtgccaagacatctgcatctgcatcgccatttgtcgttgccattgttaacgcaggtatcccagttttgccccacatcatgaatgcttgtattttgatctttgtgttttctgctgccaactctgatctttacgtggcttctagatccctttacggtttggcaattgataacaaggctccaagaatctttgctaagacaaacaaacaaggtgtgccatactggtcattactggtaggtgtcttatttgcattattagcatacatgaacgtttcttccggtagttctgaagttttcacatatttcgtcaattgtgtgtctatctttggtctactaagttggatctcaatcttgatcacatatatcagattcgacaaagctttcagggttcaaggtatcgataaatcaaccttggcttaccaatcgcctttgcaaccatatggagcttggttctccttattcttttgcattttgatcggtttgatcaaaaacttccctgcattcttaggtgacaccttcgactacaagtcattcatcactggttacattggtatcccaacttacatcatctcatacatcggttacaaattgtggtacaagaccaagatcatcccatccgaagaagttgatctcgtctcattcaaagaagcagtcgatttggaagaagaagaaggtaaaatgttagatgaggaaagagctgcacatcttgcagcacacggaaaggatctcaaatggtgctacgaaaagatcttcggctgggtcatgtga

SEQ ID NO: 9252 - protein, 605 aa, Kluyveromyces lactis
MAEKVYLDAQLSRVDTDEDIEKQQLFGDDNIVIERSSQLFYDGQSDSKVHGITSGHGSDVKNVVTHTSEFDGKHDGIRLKKALEARHVSMIAIGGSLGTGLLIGTGSSLALAGPAAILIAYAFVGLLVFFVMSCLGEMAAYIPLDGFTSYSTRYADPALGFAVGYAYLFKYWIIVPNQLTAGALVIQYWVDRDKVNPGVWITILLVAIITINFLGVRFFGEIEYYISAVKITVMLGLIILLLVLACGGGPNHEVLGFKYWKNPGAFKEYSTAITGAKGRFVSFASVFVLALFAYLGTELCGIVVSECKNPRKAVPKAIKLTMYRIIVFYLISIFLLGMCVPFNDPLLISAKSAKTSASASPFVVAIVNAGIPVLPHIMNACILIFVFSAANSDLYVASRSLYGLAIDNKAPRIFAKTNKQGVPYWSLLVGVLFALLAYMNVSSGSSEVFTYFVNCVSIFGLLSWISILITYIRFDKAFRVQGIDKSTLAYQSPLQPYGAWFSLFFCILIGLIKNFPAFLGDTFDYKSFITGYIGIPTYIISYIGYKLWYKTKIIPSEEVDLVSFKEAVDLEEEEGKMLDEERAAHLAAHGKDLKWCYEKIFGWVM

SEQ ID NO: 9253 - DNA, 1746 bp, Saccharomyces kluyveri
  CDS (1)..(1746)
atgtcctttatccaagacagttatcgtaaggatctggagaaaatcgtctccaactcaaacaccacatctaaggatgtcgaaaatttggacctttccaaccaagatgatatctcatctcaagaatcccatttaaatattgacggtaagcatgacggtatccgtttgaaaaaagaattggaagcccgtcacgtttctatgattgccatcggtggttctttgggtaccggtttgttgattggtactggtacctccctttcccttgctggtcctgtttctattttgatcgcttactcctttgtcggtttcttggtctacattgttatgacatgtcttggtgagatggccacctacattccattggatggtttcacaagttatgcatcccgttactgtgacccagctttgggttttgccgttggttattcctaccttttcaaatacctgatcattacaccaaatcaattgaccgctgccgctttggtcttgcagtactgggtgtccagagagaaggtcaacccaggtgtctggattaccattttcctggttattattgtcacgatcaacgttgtaggcgtcaaattctttggtgaatttgaattttggctatcgagtttcaaagttcttgtcatgctgtgtctgatcgttctgctatttgttataatgttgggtggtggcccatcccatgaccgtttgggtttcaggttttacaaggatccgggtgcgttcagaccttattcagaagccatcagtggttccaagggtaaatttgtctcttttgtcgcagtctttgtttacgctttgtttgcatacttgggtaccgaattgtgtggtattgtcgctgcagagtgtaagaacccaagaagaaacgttcctcgtgctatcaagttgacgctgtaccgtatcgttgttttctaccttgtcaccatcttcttgttgggtatgactgtcgcttacaacgatccattgttgctacaagccaagaagaagtctacttctgccgctgcttctcccttcgtcgttgccatcaagaatgcaggtatcccagttttgccacacatcttcaacgcatgtgttttgatgttcgttttcagtgcttgtaactcggacttgtacgttgcttctagaagtttgtacgggttggccattgacaacaaggcaccaaagattttcgccaagactaacaagtggggtgttccatacaactctttgatcttgtgtatcctgttctgtctattggcttatatgaacgtgtcttctggttccgctcaagtcttcaactatttcgttaacgttgtgtctatctttggtttgatgagttggatcgccattttgattacctacatctacttcgacagggctttaagagcacaaggtgtggataaatctacgctagcttatgccgcaccactagcatccaaaggtgcttatttcgctttgtttttctgctgtttgattgctttgattaagaatttcaccgtatttttgggtcacaaatttgactacaagaatttcatcaccggctatattggtatcccagttttcatcatctgtttctttggttacaaatacatccgtggtaccaaattcgttaaaccagaggaagctgacttgtacactttcaaagaacttatcgacttggaagaagaagaaggtaagctttgggacgctgcacaaaaggaaaagatggaaagctctccaaagaacttcaaatggttttacgaaaagtttttgggctggatcttttaa

SEQ ID NO: 9254 - protein, 581 aa, Saccharomyces kluyveri
MSFIQDSYRKDLEKIVSNSNTTSKDVENLDLSNQDDISSQESHLNIDGKHDGIRLKKELEARHVSMIAIGGSLGTGLLIGTGTSLSLAGPVSILIAYSFVGFLVYIVMTCLGEMATYIPLDGFTSYASRYCDPALGFAVGYSYLFKYLIITPNQLTAAALVLQYWVSREKVNPGVWITIFLVIIVTINVVGVKFFGEFEFWLSSFKVLVMLCLIVLLFVIMLGGGPSHDRLGFRFYKDPGAFRPYSEAISGSKGKFVSFVAVFVYALFAYLGTELCGIVAAECKNPRRNVPRAIKLTLYRIVVFYLVTIFLLGMTVAYNDPLLLQAKKKSTSAAASPFVVAIKNAGIPVLPHIFNACVLMFVFSACNSDLYVASRSLYGLAIDNKAPKIFAKTNKWGVPYNSLILCILFCLLAYMNVSSGSAQVFNYFVNVVSIFGLMSWIAILITYIYFDRALRAQGVDKSTLAYAAPLASKGAYFALFFCCLIALIKNFTVFLGHKFDYKNFITGYIGIPVFIICFFGYKYIRGTKFVKPEEADLYTFKELIDLEEEEGKLWDAAQKEKMESSPKNFKWFYEKFLGWIF

SEQ ID NO: 9255 - DNA, 1752 bp, Saccharomyces kluyveri
  CDS (1)..(1752)
atgagctcggatatgtccaccgcaaattccaaaaaagaagaggagtctacgtatgcgattattcaaacatcctcaccttgctctaaaaagtattcctatatttccggacaggttaacaggtttattaattcttttagaagaaaaggtgagagtgaagatgttaaggaattgaaaggagagaatgaggaatgtggggctgccaccaaaatgaaaaaaagcatcaaatctcgtcatttattgatgatatcactaggtaccggtattggcacaggtttgcttgttggaaatggtaaggcactggccaaagctggacctgcaggtttagttatagggtatgcagttgcctcgattatgctatactgtattatccaggccgctggtgagttgggtatttgttattctgggatggctggtaactacacggcgtattcgtcactgttggtagaccccgctttaggtttttcagtttcctgggtctactgtgtgcaatggatgacagttttacctctacaattggttaccgctgcaatgactgttagatactggacaaatgccaacccggacatatttgtcgctgtatttttcgttgtaataatggtgattaatatgtttggtgctaaaggttatgctgaagcagagttcctgttcaacatatgcaaagtattgatgattgctgggtttgttatcttgggtattgctataaattgtggcggtgccggtaccagtggatatattggtgctaagtattggcattcgccaggttcatttgctgctggttttaaaggtgtttgttacgtgttctgttacgcagcttttagctacggtggtattgaagtcatggtattgacagctagtgagcaagaaaatccaaggaaatctatcccaaatgcttgtaagaaagtcatttaccgtatactgatgatttacatgctgactacaatcattgtatgtttcctagttccatacaacagcagcgagttgatgggttcttccggcgagtctgcatcacatgcctccccacttgtcattgctgttgcatcgcatggtgttaagatcgtcccacatattataaatgccgtcatattaatctcggtcatttctgttggcaactcctcaatgtattctgctcctagactattactatctctgtctgagcaaggttacgctccaaaatttttaaattacgtggatagacaaggtagaccattgatttgttttgccattaccttgctagttgcgttaattgcatttgtcgccgcgtccgacgccgaagaggatatatttgcttggctattggcgatctcagggttatcccaaatcttcatctggacttccatatgcctttcccatgttagattcagagatgcgatgcacgcacaaggtctttctttgggacaaatcggttacaaatcacaaacaggttattggggttcgtggtttgccatagttataagtgttttggtgttaattgcccagttctgggttgcaattgcaccaattggtgaagaaggtagattaaatgcagaaacatttttccagaattacttggctttcccaattttgttgggtgcttactttggctataaagtttatcacaaagactggagattatgcattccagcaagtgaggtagatttgtcctcccacagaaatatatctgatgaagagatattgagacaagaagattacgaatggaatgagaagatgtccaattcttccatttgggttaggctgtgccatttttggtgctga

SEQ ID NO: 9256 - protein, 583 aa, Saccharomyces kluyveri
MSSDMSTANSKKEEESTYAIIQTSSPCSKKYSYISGQVNRFINSFRRKGESEDVKELKGENEECGAATKMKKSIKSRHLLMISLGTGIGTGLLVGNGKALAKAGPAGLVIGYAVASIMLYCIIQAAGELGICYSGMAGNYTAYSSLLVDPALGFSVSWVYCVQWMTVLPLQLVTAAMTVRYWTNANPDIFVAVFFVVIMVINMFGAKGYAEAEFLFNICKVLMIAGFVILGIAINCGGAGTSGYIGAKYWHSPGSFAAGFKGVCYVFCYAAFSYGGIEVMVLTASEQENPRKSIPNACKKVIYRILMIYMLTTIIVCFLVPYNSSELMGSSGESASHASPLVIAVASHGVKIVPHIINAVILISVISVGNSSMYSAPRLLLSLSEQGYAPKFLNYVDRQGRPLICFAITLLVALIAFVAASDAEEDIFAWLLAISGLSQIFIWTSICLSHVRFRDAMHAQGLSLGQIGYKSQTGYWGSWFAIVISVLVLIAQFWVAIAPIGEEGRLNAETFFQNYLAFPILLGAYFGYKVYHKDWRLCIPASEVDLSSHRNISDEEILRQEDYEWNEKMSNSSIWVRLCHFWC

SEQ ID NO: 9257 - DNA, 1569 bp, Saccharomyces castellii
  CDS (1)..(1569)
atgaaagaggagatccgtgagataagtgttgaggtggaggcggagacggtcaggcgtgagctaaagcagcggcacatggggatgatagcgttggggggcacgatcgggacggggctgttcatcggtgtgtcgacgccgttgatgaacgctgggcctgtgggggccctgatcgcgtacctgttcatggcgaccctggcgtactcggtgacgcagtcgctgggggagatggcgacgttcatccctgtgacctcgtcgttcaccgtgttctcgcagcggttcgtgtcgccggcgtttggggcagccaacgggtacatgtactggttctcgtggtgcatcacctttgcgctggagctgtctgttgtgggccaggtgatccagttctggacgtttgcggtgccgctggccgcctggatcagcatcttctgggtgctgctgacggggatgaatatgttcccggtgaagtactacggggagtttgagttctgggtggccctggtcaaggtggtcgcgatcatgggctttctgatatactgtttctgtatggtctgtggtgctggagtcacggggcccgtgggcttccgctactggcgccacccgggcgcctttgggcccggtattattgcaaaggacaagaatcaagccaggtttttagggtgggtctcgtcgctaatcaacgctgcatttacgtttcaagggaccgagctggtgggtattactgccggtgaggctgccaacccgaggaagaccgttccaagggccatcaagaaggttgtgtttaggattctgtttttctacattctgtcgctgtttttcataggcctcctggtaccgtacgatgactggaaactgacgagcacagactcatatgtgtcggcgtcgcccttcattatcgcgatcgagaacagcggcacgcatgtcttgccgcacattttcaacgcggtcatcgtcgccaccatcatctcggcgggcaattccaacatatacgtcggctcgagaatcatgtacggtctgagcacaagcaggctggcaccgggcatcctctcacgcaccacgcagcacggggtgccctgggtggccgtgctggtcacctcgctgtttggcgccctggcatacatggagacgagcacgggtgggcagaaggccttcaactggctgctgaacatcacaggtgtcgcagggttctttacctggctgtttatatcactatcccatatcaggttcatgcaggcgctggagatgcgaggcatatccagagacgacctgcccttcaaggccaagtggatgccaggcctggcatattacggggtgttcttcatgacgttgatcatcatcatccaaggcttcaccagcttctgtccctggaacggcatcgactttctgaccgcctacatctcggttttcatgtttatcgctatctggatcgccttccaggcctggttcaggtgcaggcttatttggagggtcgaggacgtggacatagacaccgacagaagggccgtcgaagaggcagtgtggatcgagcaggagcccagaggtttctgggacaagttctggaacgtggtggcataa

SEQ ID NO: 9258 - protein, 522 aa, Saccharomyces castellii
MKEEIREISVEVEAETVRRELKQRHMGMIALGGTIGTGLFIGVSTPLMNAGPVGALIAYLFMATLAYSVTQSLGEMATFIPVTSSFTVFSQRFVSPAFGAANGYMYWFSWCITFALELSVVGQVIQFWTFAVPLAAWISIFWVLLTGMNMFPVKYYGEFEFWVALVKVVAIMGFLIYCFCMVCGAGVTGPVGFRYWRHPGAFGPGIIAKDKNQARFLGWVSSLINAAFTFQGTELVGITAGEAANPRKTVPRAIKKVVFRILFFYILSLFFIGLLVPYDDWKLTSTDSYVSASPFIIAIENSGTHVLPHIFNAVIVATIISAGNSNIYVGSRIMYGLSTSRLAPGILSRTTQHGVPWVAVLVTSLFGALAYMETSTGGQKAFNWLLNITGVAGFFTWLFISLSHIRFMQALEMRGISRDDLPFKAKWMPGLAYYGVFFMTLIIIIQGFTSFCPWNGIDFLTAYISVFMFIAIWIAFQAWFRCRLIWRVEDVDIDTDRRAVEEAVWIEQEPRGFWDKFWNVVA

SEQ ID NO: 9259 - DNA, 1773 bp, Saccharomyces bayanus
  CDS (1)..(1773)
atgacgacgcctaagcaagactctgaagtagaggaaaaacacatgtacactgagccggccggaacgttctttcatgacgtcgaagcctctcaaactcatcacaggcgtggatcattgtcgctgaaagatgagaagagcaaggaactgtatccattgcgctcctttcccaatggagtcaatggccaggacactttctcgatggaggaagatatacaggacgaagacgagggcgaagtgcagaatgcggaggtgaaaagagaacttaaacaaaggcacatcggtatgattgcccttggtggtaccatcggtaccggtctgttcatcggtctatctacacctctaacgaacgccggccccgtgggtgctctgatatcctatttattcatgggttcgttggcttactccgtcactcaatcactaggtgaaatggccacattcattccagtcacatcttcgttcacggtcttttcgcaaagatttctgtcgcctgcatttggtgcagccaacggttacatgtattggttttcttgggccgtcacctttgccctggagcttagtgtggttggacaagtcattcaattttggacgtacgccgtcccattggcagcatggattagtattttctgggtgatcatcaccgcaatgaacatgttccccgttaaatattacggtgaatttgaattctgggtcgcctctatcaaagtcatcgccattatcgggtttttgatctactgtttttgcatggtctgtggtgctggtgtcaccggcccagttgggttccgttactggagaaacccaggtgcatggggcccaggtattatctccaagaataagaacgaggcaaggttcctaggttgggtttcctctttgattaatgctgcgttcacattccaaggtactgaattggttggtatcactgctggtgaggccgccaacccaagaaaaactgttcccagagccatcaagaaggttgttttccgtatcttgaccttctacatcggatccctattgttcattggtcttttggtgccatacaacgatcctaaattaacctctgccacctcttatgtctccacttctccatttattattgccattgaaaactcaggtacaaaagtattgccccatatattcaatgctgttatcttaacaaccatcatttccgcagcaaattcaaatatttatgtgggctctcgtgtcttatttggtttatccaaaagcaagttggctccaaagtttttttcaaaaaccacaaaaggtggtgtcccatatattgcggttttcgccacttccatatttggtgctttagcttacatggaaacttccaccggtggtgggaaagtattcgcatggttattgaatatcactggtgtcgctgggttcttcgcttggttgtttatctcggtatctcatatcaggttcatgcaagctttgaaataccgtggcatttctcgtgatgaattgccattcaaagccaaactaatgcccggattggcttattatgctacttttttcatggtagttattatcctcatccaagggttcacctcttttacaccaacattcaacggtgttaatttccttgccgcctatatttctgttttccttttcttggcaatttggattctatttgaactgatatttagatgcagatttgtctggaaaatcgaagacgtggatatcgattctgacagaagagacatcgaagccattgtgtgggaagaacctgagccaaagaccctttgggacaagttttggaatgttgtaggttaa

SEQ ID NO: 9260 - protein, 590 aa, Saccharomyces bayanus
MTTPKQDSEVEEKHMYTEPAGTFFHDVEASQTHHRRGSLSLKDEKSKELYPLRSFPNGVNGQDTFSMEEDIQDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAVTFALELSVVGQVIQFWTYAVPLAAWISIFWVIITAMNMFPVKYYGEFEFWVASIKVIAIIGFLIYCFCMVCGAGVTGPVGFRYWRNPGAWGPGIISKNKNEARFLGWVSSLINAAFTFQGTELVGITAGEAANPRKTVPRAIKKVVFRILTFYIGSLLFIGLLVPYNDPKLTSATSYVSTSPFIIAIENSGTKVLPHIFNAVILTTIISAANSNIYVGSRVLFGLSKSKLAPKFFSKTTKGGVPYIAVFATSIFGALAYMETSTGGGKVFAWLLNITGVAGFFAWLFISVSHIRFMQALKYRGISRDELPFKAKLMPGLAYYATFFMVVIILIQGFTSFTPTFNGVNFLAAYISVFLFLAIWILFELIFRCRFVWKIEDVDIDSDRRDIEAIVWEEPEPKTLWDKFWNVVG

SEQ ID NO: 9261 - DNA, 1836 bp, Saccharomyces bayanus
  CDS (1)..(1836)
atgggcaagtttagaaatataatatcgtccaaaaaatgggacgaggagcaggacaattccgaggaacagagcatacgggacgactcgacaaatcagatagaacatgagatggaggtgatagacacatccaacaagccggtcgcatactccattgacgagaaacaggacaatttgaagaagaagagcgggttgatgctagatggcaccattggtgacataaattcgatcacgaactcgttaacgaggtcccaaattgcctcgcacgagcaaggtggggacgacgaagaagaggaggctcactacgaagacaagcacgtcagaagagccttgaagcagagacacattggtatgatcgcgctcggtggtaccatcggtactggtcttttcgtcggtatctccacccccttgagcaatgcaggccccgtcgggtccctgattgcttatattttcatgggtacagtggtttacttcgtaacacagtcgctgggtgaaatggccacttttatccccgtgacgtcatccatcacagtcttctcaaagaggtttttatcacctgcattcggtgtttccaacggttacatgtactggttcaattgggccatcacgtatgcagtggaagtctccgttattggtcaagtcattgaatactggacaacgaaagttcctttgggggtttggattgccatattttgggtccttatcactctaatgaattttttccccgttaaagtttatggtgagtttgaattctgggtggcatcggtaaaagtcctggccatcatggggtacttgatatacgccttggttatcgtctgtggtgggtccaaacaaggtcctattggtttcaggtactggagaaatccaggtgcttgggggcccggtatcatctccagtgacaagaatgaagggcgttttctcggttgggtctcctctttgatcaacgccgccttcacgtaccaaggtactgaactggtcgggatcactgctggtgaagccgccaacccaagaaagaccgtccctagagctatcaacaaagttgtcttcaggattgtacttttttatatcatgtctttgttcttcattggtctcttggtcccatacactgacccccgtctatccgccagttccgctgtcattgcatcatcaccatttgtcatttccattcaaaacgctggtacttatgctttgccagacattttcaacgctattgtcttgatcactgttatctctgccgctaactcaaacgtttacgttggttcccgtgttttgtactctttggcccagaccggtaacgctccaaagcaatttggatacgtcactaaacaaggtgttccataccttggtgtcttgtctacagctgcattgggtcttttggccttcctggttgtcaacaacaacgccaacaccgcattcaactggttgatcaacatctccactttggctgggttatgtgcttggttattcattagtttgtcacacatcagattcatgcaagctttgaatcaacgtggtatctctcgtgatgatttgcccttcaaggctaaattcatgccctacggtgcctactacgcgtcctttttcgtcactgtcatcattttcattcaagggtttcaatcattctgtccattcagagtggccgacttctttacgtcctacatttccttaattcttttggctgtcgtgttcactggttgccagctatactacaaatgtagattcatttggaaactggaagacattgatatcgactctgacagaagagaaatcgaagctatcatttgggaagacgatgagccaaagaatttgtgggagaaattctgggcagccgttgcataa

SEQ ID NO: 9262 - protein, 611 aa, Saccharomyces bayanus
MGKFRNIISSKKWDEEQDNSEEQSIRDDSTNQIEHEMEVIDTSNKPVAYSIDEKQDNLKKKSGLMLDGTIGDINSITNSLTRSQIASHEQGGDDEEEEAHYEDKHVRRALKQRHIGMIALGGTIGTGLFVGISTPLSNAGPVGSLIAYIFMGTVVYFVTQSLGEMATFIPVTSSITVFSKRFLSPAFGVSNGYMYWFNWAITYAVEVSVIGQVIEYWTTKVPLGVWIAIFWVLITLMNFFPVKVYGEFEFWVASVKVLAIMGYLIYALVIVCGGSKQGPIGFRYWRNPGAWGPGIISSDKNEGRFLGWVSSLINAAFTYQGTELVGITAGEAANPRKTVPRAINKVVFRIVLFYIMSLFFIGLLVPYTDPRLSASSAVIASSPFVISIQNAGTYALPDIFNAIVLITVISAANSNVYVGSRVLYSLAQTGNAPKQFGYVTKQGVPYLGVLSTAALGLLAFLVVNNNANTAFNWLINISTLAGLCAWLFISLSHIRFMQALNQRGISRDDLPFKAKFMPYGAYYASFFVTVIIFIQGFQSFCPFRVADFFTSYISLILLAVVFTGCQLYYKCRFIWKLEDIDIDSDRREIEAIIWEDDEPKNLWEKFWAAVA

SEQ ID NO: 9263 - DNA, 1713 bp, Saccharomyces bayanus
  CDS (1)..(1713)
atgagtaaaaatgtggacattagcgtgtccaaagagggtcaatacgaacttaactccatctccacgataaaggaggaggagctggtagacgtccagtacgatggacagggtgccccggcggctatcgccgccggggggtgcattgcgaacgacgatgccaaggcggcagaggcgctaccccgggaggtgaaacggaacttgaagcagcggcatatagggatgattgctctgggaggcaccatcggcacgggcctcataataggtatcggtccgccgctggcgcatgcgggtcccgttggcgccctgatatcgtatatattcatggggaccgtcatttactcggtgacacagtcactgggggagatggcaacattcatacccgtgacgtcctcgttctccgtctttgcacagaggttcttgtcgcctgcccttggcgccaccaacggctacatgtactggctgtcgtggtgcttcaccttcgcactggaactatctgttctggggcaaatcatccagtattggacagatgctgtgcctctgtccgcttggatcgtaattttctggtgcctgctcacgctgatgaacatgttcccagtgaagtactacggggagttcgagttttgtattgcttccataaaggttatcgcgctgctcgggttcatcatctactcgttttgcatggtatgtggtgccggacagccggatggacccatcggattcaggtactggagaaatccaggagcctgggggcccggtatcatctccagtgacaagaacgaagggcgttttctcggttgggtctcctctttgatcaacgccgccttcacgtaccaaggtactgaactggtcgggatcactgctggtgaagccgccaacccaagaaaggccgtcccaagggcaattaagaaagttgtggtcaggatcctagtcttctacatcatgtcgctgtttttcataggccttttggttccgtacaacgacccgaaactggacagtgacggatcgtttgtgtccgcatcccccttcatgatcagcatcgagaattccggcaccaaggtcctcccagacatattcaacgcggtcgtgctgatcaccatagtctccgcgggcaactccaacgtgtacatcggctcaagggtcctgtacagtctatccaaaaacgacttggcgccccggttcctgtcgatcgtgaccaagggcggggtcccctactttgccgttctggcaacatctgtattcgggttcctggccttcttggaaacctccgcaggtagtggcaaggctttcaactggctgttaaacattactggtgtggcaggatttttcgcatggctgctgatttcattttcgcacatccgctttatgcaagcgataagcaaacgcggaatatcgaggaacgatctgccttacaaggctcgcatgatgccttatctagcctactacgcatcctttttcatcgccctgatagtcctgatccagggcttcactgcatttgcgcccagtttccagcctgtagatttcgttgccgcatacatatccgtcttcctatttgttgcaatctggttttcattccagctttggttcaagtgtcccataatcttgaagttgcaggacgtcgacatagattccgaccgccgcgaaatagaggagcaggtatggatagaacccttacgcaaaaccaagtggcagtgcgtgtgggatgtccttgcataa

SEQ ID NO: 9264 - protein, 570 aa, Saccharomyces bayanus
MSKNVDISVSKEGQYELNSISTIKEEELVDVQYDGQGAPAAIAAGGCIANDDAKAAEALPREVKRNLKQRHIGMIALGGTIGTGLIIGIGPPLAHAGPVGALISYIFMGTVIYSVTQSLGEMATFIPVTSSFSVFAQRFLSPALGATNGYMYWLSWCFTFALELSVLGQIIQYWTDAVPLSAWIVIFWCLLTLMNMFPVKYYGEFEFCIASIKVIALLGFIIYSFCMVCGAGQPDGPIGFRYWRNPGAWGPGIISSDKNEGRFLGWVSSLINAAFTYQGTELVGITAGEAANPRKAVPRAIKKVVVRILVFYIMSLFFIGLLVPYNDPKLDSDGSFVSASPFMISIENSGTKVLPDIFNAVVLITIVSAGNSNVYIGSRVLYSLSKNDLAPRFLSIVTKGGVPYFAVLATSVFGFLAFLETSAGSGKAFNWLLNITGVAGFFAWLLISFSHIRFMQAISKRGISRNDLPYKARMMPYLAYYASFFIALIVLIQGFTAFAPSFQPVDFVAAYISVFLFVAIWFSFQLWFKCPIILKLQDVDIDSDRREIEEQVWIEPLRKTKWQCVWDVLA

SEQ ID NO: 9265 - DNA, 1857 bp, Saccharomyces bayanus
  CDS (1)..(1857)
atgaacgacagcgacagtctctttgtcgacgaggccaatccagctccatgtacacatggtctgcacgagagagggcacgcggaaaaggagaagaaggacttcacagtgactgaaaaccaagatgaaggactacaacagcaagcgaagcgccaagggacgagtgggaaattcaaactacaaaacgaatgcaaaaaattcttcgactcgttcaaaagacagctgccagcggatcaaaattccgaactagagtcacaagaaaggaacaatttgacaaggtccatcaaatcacgccatttgatcatgatcagtctcggcaccggtatcggtacggggctgctggtcgggaatggccaagttctcggaacggcaggacccgccgggttggtgcttggttatggtatcgcctctatcatgctttactgtatcatccaagccgccggtgaactgggtctttgttatgccgggttaaccggtaattacaccaggtactcttccattttggtcgacccttcattggggtttgccgtttccgtggtttataccatccaatggttgaccgttcttcctttgcagttggtcacggcagcgatgactatcaaatattggaccaatgtgaacgcagacatctttgttgccgcagttttcatttttgtcatcatcatcaacttgtttgggtccaaaggctatgccgaagctgaattcatgtttaatatctgtaaaattctgatggtaatcggattcgtgatcctggccattgtcatcaattgcggtggtgcaggtgataggaaattcatcggtactaaatactggcacaatcctggtccatttgctcacggtttcaaaggtgtctgtactgttttttgttatgccgccttcagttacggtggtatcgaagtcctgcttctatcagcagccgagcaagagaacccaacaaaatccattccaaacgcttgcaaaaaagttgtgtatcgtatcttgttcatttacatgttgacgaccattttgatttgcttcctggtaccatacaacagtgacgaattattaggctctggtagctcttccgggtcacatgcatctccatttgtcattgctgttgcgtcccacggtgtcaaagtcgtgcctcacttcatcaatgctgtgattttgatttctgttatttctgtggctaattcttcgttatattctgcaccaaggctactactatcgttggcagaacaagggtttttacctaaatgtctggcgtatgttgacagaaacggcagacctttgctttgttttcttgtttctattatctttgggtgcatcggctttgttgccacgagtgacgctgaagaacaggttttcacatggttattagccatttccagtctttcccaattgtttatttggatgtcgatgtctctgtcacatattagattcagagacgccatggccaagcaaggccgttcaatggacgaggtgggatacaaagcacaaacaggctactggggatcttggcttgcggttttgattgcgttatttttcctagtttgccagttttgggtcgccatcgcacccgttagcaaacatggtaaattggatgctaatgttttcttccagaattatttggcaatgcccattgtcttgtttgcctatttcggccacaagatctacaccaaatcgtggaagttttggattccagccgaaaaaatcgatttggactcacacagaaccatatacgtcccaccaatactcatggggactaacaagattgatgacgatgatcttaaagaatatgaaacttcagagtcatcggaaaacccgaacggctcaggctcaagaaagtttttcaagagaatggctaatttctggtgttaa

SEQ ID NO: 9266 - protein, 618 aa, Saccharomyces bayanus
MNDSDSLFVDEANPAPCTHGLHERGHAEKEKKDFTVTENQDEGLQQQAKRQGTSGKFKLQNECKKFFDSFKRQLPADQNSELESQERNNLTRSIKSRHLIMISLGTGIGTGLLVGNGQVLGTAGPAGLVLGYGIASIMLYCIIQAAGELGLCYAGLTGNYTRYSSILVDPSLGFAVSVVYTIQWLTVLPLQLVTAAMTIKYWTNVNADIFVAAVFIFVIIINLFGSKGYAEAEFMFNICKILMVIGFVILAIVINCGGAGDRKFIGTKYWHNPGPFAHGFKGVCTVFCYAAFSYGGIEVLLLSAAEQENPTKSIPNACKKVVYRILFIYMLTTILICFLVPYNSDELLGSGSSSGSHASPFVIAVASHGVKVVPHFINAVILISVISVANSSLYSAPRLLLSLAEQGFLPKCLAYVDRNGRPLLCFLVSIIFGCIGFVATSDAEEQVFTWLLAISSLSQLFIWMSMSLSHIRFRDAMAKQGRSMDEVGYKAQTGYWGSWLAVLIALFFLVCQFWVAIAPVSKHGKLDANVFFQNYLAMPIVLFAYFGHKIYTKSWKFWIPAEKIDLDSHRTIYVPPILMGTNKIDDDDLKEYETSESSENPNGSGSRKFFKRMANFWC

SEQ ID NO: 9267 - DNA, 1902 bp, Saccharomyces bayanus
  CDS (1)..(1902)
atgtcctcgtcgacgtcgccatacgaactgaaggacttgaaaaatagctccactgaagtacatgccgcggagcaggagaacgaaatcgagtatttcgaaacagactccaatgaccgtccctcgcagcagcctcatctggactacgagcaacacaacacctctgccgtgcgtcggttcctcgactccttcaagagggccgaccaggatcaagagcaggaggcagaagtggcacagatgaacgacctcacgtccgccatttcgccctcgtccagacaggctcacgagctggagaaggacgagactactgacaagatagctcctcacacgggccacaaatccgactcgctgaagaagaccatccagcccagacacgtgcttatgattgcgctcggtaccgggatcggtaccgggctactggtgggtaatggtacagcgctggtgcatgcgggccccgctgggctgctcatcggttacgccatcatgggttccattctgtactgcatcatccaggcctgtggtgagatggccctcgtgtacagcaacctgaccggtgggtacaatgcatacccgagtttcctggtggatgacgggttcgggtttgccgtcgcctgggtttactgtctgcaatggttatgtgtgtgtcccctggagctggtcacggcgtccatgaccatcaagtactggaccacgtccgtcaacccggacgtgttcgtcatcatcttctatgtcctggtcatcaccattaacattttcggcgctcgtggttacgcagaggcggaattcttcttcaactgctgcaaaatcctcatgatgaccgggttcttcattctcgggatcatcatcgatgtcggtggggccggaaacgacggctacattggtggcaagtactggcacgaacccggtgcgttcaacggtgtgcacgccattgacagattcaaaggtgtcgtcgccactttggtcaccgctgccttcgcgtttggtgggtccgaattcattgccatcaccactgccgaacagtccaacccaagaaaggccattccaggtgccgccaagcagatgatctacagaatcctgttcctgttcctggccaccatcatcattgtgggtttcctcgtgccatacaactccgaccaactgttgggttccagcggtggcggtaccaaggcctccccatacgttattgccatcgcatcccacggtgttcgtgtggccccacatttcgtcaacgccgttatcctactgtcggtcctatccatggccaactcctctttctactccagtgcccgtttgttcctaactttatccgagcaaggttacgcccccaagatcttttcctacattgacagagccggcagacctttgattgccatgtgcgtctccgcattgtttgccgtcattgccttctgtgctgcatcccccaaggaggaccaagtgttcacttggttgttggccatttccggtctatcccaacttttcacgtggaccgccatttgtctttctcatatcagattcagaagagccatgaaagtccaaggcagatcccttggtgaattgggtttcaaatctcaaaccggtgtttggggctctatctactcctgtatcatgatgatcctgattcttattggccaattctgggtcgccatcgcccccattggcgaaggtaagctggacgctcaagccttcttcgagaactacctggccatgccgatcctgattgtactgtacgtgggttacaaaatgtggaacaaggattggaaactgttcattagagccgataagatcgatttgacctctcacagacaaatcttcgacgaagaattaatcaagcaagaagatgacgaatacagagaacgtttgagaaccggcccttattggagaagggtcttggccttctggtgttga

SEQ ID NO: 9268 - protein, 633 aa, Saccharomyces bayanus
MSSSTSPYELKDLKNSSTEVHAAEQENEIEYFETDSNDRPSQQPHLDYEQHNTSAVRRFLDSFKRADQDQEQEAEVAQMNDLTSAISPSSRQAHELEKDETTDKIAPHTGHKSDSLKKTIQPRHVLMIALGTGIGTGLLVGNGTALVHAGPAGLLIGYAIMGSILYCIIQACGEMALVYSNLTGGYNAYPSFLVDDGFGFAVAWVYCLQWLCVCPLELVTASMTIKYWTTSVNPDVFVIIFYVLVITINIFGARGYAEAEFFFNCCKILMMTGFFILGIIIDVGGAGNDGYIGGKYWHEPGAFNGVHAIDRFKGVVATLVTAAFAFGGSEFIAITTAEQSNPRKAIPGAAKQMIYRILFLFLATIIIVGFLVPYNSDQLLGSSGGGTKASPYVIAIASHGVRVAPHFVNAVILLSVLSMANSSFYSSARLFLTLSEQGYAPKIFSYIDRAGRPLIAMCVSALFAVIAFCAASPKEDQVFTWLLAISGLSQLFTWTAICLSHIRFRRAMKVQGRSLGELGFKSQTGVWGSIYSCIMMILILIGQFWVAIAPIGEGKLDAQAFFENYLAMPILIVLYVGYKMWNKDWKLFIRADKIDLTSHRQIFDEELIKQEDDEYRERLRTGPYWRRVLAFWC

SEQ ID NO: 9269 - DNA, 1392 bp, Streptococcus pyogenes
  CDS (1)..(1392)
atggagtttagaatgtctataaaagaacaaacagacaataacgaactagaaaatggaatggtaaggggcttagaaaatcgtcatgtgcagttaattgcgattgcaggaacgattggaacaggtctctttttaggggcaggacgctctattgccttaacaggaccatctattatttttgtgtatatgattacaggtgccttcatgtttatgatgatgcgtgccatcggtgaaatgctctattatgatccagatcaacacacctttatcaattttatttccaaatacattggtccaggctggggttatttttcgggtctatcctattggatttcccttatttttattggaatggcagaaatcacagcagtaggtgcttatgtgcaattttggttcccaagctggccagcctggttgattcagttggttttcttagtcttacttagttcgatcaacttaattgctgtgcgcgtttttggggaaacagagttttggtttgccatgattaagattttagctattttagctttgattgcaacagctattttcatggtattgacaggttttgaaactcacacaggccatgctagcctttccaatatttttgaccatttttccatgttcccaaatgggaaactaaagttctttatggccttccaaatggttttctttgcttatcaagctatcgaatttgtggggattaccacttctgagacggctaacccaagaaaagttctaccaaaggctattcaagaaattccaacccgtattgtgatcttttatgtgggagccttggtctctattatggcaattgtgccatggcatcagttaccagttgatgaatctccttttgtgatggtgttcaaattgattggtattaaatgggcagcagccttgattaactttgtggtcttgacatcagcagcgtcagcgcttaactcaaccctttattcaaccggtcgtcatctctatcagattgctaatgagactccaaacgctttgaccaatcgcttaaagattaatactttatctcgacaaggggtgccaagtcgtgccattattgcttcagcggttgtggttggtatctcagctttgattaatattttgccaggagttgcagatgcgttctcactcattacggcctcctcatcaggtgtatatattgctatctacgccttaaccatgattgctcactggaagtaccgtcaatctaaggactttatggcagatggttatttgatgccaaaatataaagtgacaacgcctttgacccttgctttctttgcttttgtctttatctctcttttcttacaagaatccacctatatcggcgccattggagcaacgatttggattattgtttttgggatttatagcaatgtcaaatttaaataa

SEQ ID NO: 9270 - protein, 463 aa, Streptococcus pyogenes
MEFRMSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIVFGIYSNVKFK

SEQ ID NO: 9271 - DNA, 1392 bp, Pseudomonas syringae
  CDS (1)..(1392)
atgagcagtaccgctaactcttccgagctcgaacaagggctgaaacctcgacacattacgatgctgtcgattgccggcgtcattggcgctggtctgttcgtcggctccggccacgcgattgccgaggccgggccagccgtgctgttggcctacgccgcagcgggtacgctggtggtgctggtcatgcgcatgctggccgaaatggccgttgcctcgccggataccggctcgttttcgacctacgccgaccgggccatcggacattgggccggctttaccatcggctggctgtactggtggttctgggtgttggtgattccgctggaagccaacgccgctgcgaccattctgcacgcctggttccccgacatcgccatatggatgttcaccctggtcatcacattgctgctgaccgcgaccaacctgttcagcgtgaagaactacggcgaattcgagttctggtttgcgctcatcaaggttgtggcgatcatcgccttcgtggtgctgggtgttgcggccatttttggtttgctgccgaccagtagcgtgagtggcgtcagtcatctgttcgacaccggtggtttcctgcctaacggcatgggcgcggtgcttgctgccatgctgactaccatgttctcgttcatgggcaccgagatcgtgaccattgcggcagccgagtccaggaaccctggcaagcagatcaccaaggccaccaattcagtgatctggaggatcttcctgttctatctggtttcgatcttcatcgttgtgtcgctggtgccgtggaatgatccgcgcctggccgaggtgggttcgtatcagaccgtgctggatgcgatgggcattccgaacgccaagctgattgtcgatctggtggtgttggttgccgtgaccagttgcctgaactcggcgctgtataccgcttcgcgcatgctcttctcgctcggcaagcgcggcgatgcaccggcgttgtccaagcgcaccagcaagggcggcacgccatactgggcggtgatcatgtcgactgcggcggcgttcctgaccgtatttgccaactacgtcgcacccgctgccgtgtttgacttcctgctcgccagctccggtgccattgcgctgctggtgtatctggtgattgccgtttcgcaactgcggatgcgccagaagcgcattgctgcaggcgagaccatcgacttcaaaatgtggctgttcccatggctgacctgggcggcgattgcgttcatcgttgccgtgctgaccatcatgttgatccagcaagagcaccgcgtcgaaatcatcgccaccggcgtgctcagcctgctggtgatcggcgccggcctgatcgtctctcgtcgccgcaaggccgggcccgtgggcgctgctgcactgggctga

SEQ ID NO: 9272 - protein, 463 aa, Pseudomonas syringae
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPDIAIWMFTLVITLLLTATNLFSVKNYGEFEFWFALIKVVAIIAFVVLGVAAIFGLLPTSSVSGVSHLFDTGGFLPNGMGAVLAAMLTTMFSFMGTEIVTIAAAESRNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYVAPAAVFDFLLASSGAIALLVYLVIAVSQLRMRQKRIAAGETIDFKMWLFPWLTWAAIAFIVAVLTIMLIQQEHRVEIIATGVLSLLVIGAGLIVSRRRKAGPVGAAALG

SEQ ID NO: 9273 - DNA, 1377 bp, Pseudomonas syringae
  CDS (1)..(1377)
atgacgtcacaagatggtttgaaacgcgggttatccgcccgccacatccgcttcatggccctgggctctgccatcggcacagggttgttctacggctcggcctcggcgattcaacaggccggtcccgctgtattgctggcgtacctgatcggcggcgcggcggtgtacatggtaatgcgcgcactgggcgaaatggctgttcacgacccggtgtccggttcgttcagccattacgccacacgctacatggggccgctggccggtttcgtgctgggctggacctacgcgttcgagatgatcatcgtctgtctggccgatgtgacagccttcggcatttacatgggcttctggtttccggaagtgccgcgctggatctgggtgctgggcatcgtgttcctgatcggcgcgctcaacctgtgcaacgtcaaagttttcggcgaaaccgaattctggctgtcgatcctcaaggtcagcgccatcgtggcgatgatcgttgcaggcttcggcatcatgatcttcggcatcggcagctcgaccagcggcactgaaatcggcatcagcaacctgtgggcgcatggcggcttcatgcccaacggcgtcaccggcctgatcgcttcgtttgcagtggtgatgtttgctttcggcggcatcgagatcatcggcatcacggccggtgaggcaaaggacccgcaacgcagcctgccgcaggcaatcaacgcggtgccgctgcgtattctgctgttctacgtgctgaccctgtttgtgctgatgtgtatttatccgtggccgcaaatcggcacccaaggcagcccgttcgtacagattttcgacaacctgggcattgcctcggcggcgaccattctcaacatcgtggtgatctcggcggcggtgtcagctatcaacagcgacatcttcggcgcaggccgcatgatgtacggcctggcccgcgacggtcaggcgccggcgagttttgcgcgcctgtcgcgtcagggcgtgccgtggatgaccgtgctggtgatgggcgtgacgctgctcggcggcgtgctgctcaactacctgatccccaaagacgtgttcctgctgatcgcgtcgctggcaaccttcgccacggtctgggtctggctgatgatcctgctgactcaggtcgccatgcgccgctcgatgagccgcgaagaggtcacacagctcaagtttgcggtgccgttctggccttacgggcctgccgccgccattgccttcatgctgttcatcttcggcgttctgggctatttcccggacaaccgtgcagccttgatcgtcggcgcaatctggattgcgctgctgctcatcgcctacgggttgtgggtcaagccaaaggcgctcaacaaaacccattga

SEQ ID NO: 9274 - protein, 458 aa, Pseudomonas syringae
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSTSGTEIGISNLWAHGGFMPNGVTGLIASFAVVMFAFGGIEIIGITAGEAKDPQRSLPQAINAVPLRILLFYVLTLFVLMCIYPWPQIGTQGSPFVQIFDNLGIASAATILNIVVISAAVSAINSDIFGAGRMMYGLARDGQAPASFARLSRQGVPWMTVLVMGVTLLGGVLLNYLIPKDVFLLIASLATFATVWVWLMILLTQVAMRRSMSREEVTQLKFAVPFWPYGPAAAIAFMLFIFGVLGYFPDNRAALIVGAIWIALLLIAYGLWVKPKALNKTH

SEQ ID NO: 9275 - DNA, 1410 bp, Pseudomonas syringae
  CDS (1)..(1410)
atgagtgaaacaactgcaccctcgggcgaattgaaacgcggtctgaagaatcggcatatccagctgatcgctctgggcggcgcaatcggcacgggcttgtttctcgggtcggcgggcgtgctgaaatcagccgggccttcgatgattctcggttatgcgatctgtggcttcatcgccttcatgatcatgcgccagctcggcgagatgattgtcgaagagccggtggccgggtcgttcagccattttgcgcacaactactggggcggtttcgccgggtttctgtcgggctggaactgctggctgctgtacatcctggtgggtatgtcggagctgaccgcggtcggcaaatacattcactactggttgccgcacatcccgagttgggtgtcggcagcggtgttcttcgtgttgatcaacgccatcaacctgaccaacgtcaaggtgttcggcgagaccgagttctggttcgcgatcatcaaggtggtggcgatcatcggcatgatcgcgctgggcagctacatgctggtcagcggcagcggtggcccgcaggcgtcggtcagcaacctctgggagcatggcggattcttccccaatggcgtcagcggtttggtgatggcgttggcgatcatcatgttctcgttcggcggcctggaaatgctcggttttaccgctgccgaggccgaacagccgaagactgtgatccccaaggcgatcaatcaggtcatctaccgcatcctgattttctacatcggcgcgctggtagtgctgttgtcgctgacgccgtgggacagcctgctggccagcctcaatgcctcgggtgattcctacagcggcagcccgtttgtgcaggtattctcgatgctcggcagcgatgcggcggcgcatatcctcaatttcgtggtactgaccgcagcgctgtcggtctacaacagcggcacctattgcaacagccgcatgctggtgggcatggccgagcagggcgatgcgcccaagctgctggcgcaggtcgataaacgtggcgtgccggtcaaggcgattttcgcgtccgccgccgtgacgctggtggccgtgctgctcaactacttcgtgccgcaacaggcgctggagttgctgatgtcactggtggtggccacgctggtcatcaactgggcaatgatcagctactcgcacctgaaattccgccagcacatgaatcgcaccgggcaggtgccgctgttcaaggcgctgtggtatccgtatggcaactacgtttgcctggcgtttgtggtgttcattctcggcatcatgctgatgatccccggtatccagatctcggtttacgcgataccggtctggctggcggtgatgtgggtgtgttaccgagccaaaaacaggcgtagcgttgtcgtgaatgccgagactggcaaataa

SEQ ID NO: 9276 - protein, 469 aa, Pseudomonas syringae
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPHIPSWVSAAVFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPKLLAQVDKRGVPVKAIFASAAVTLVAVLLNYFVPQQALELLMSLVVATLVINWAMISYSHLKFRQHMNRTGQVPLFKALWYPYGNYVCLAFVVFILGIMLMIPGIQISVYAIPVWLAVMWVCYRAKNRRSVVVNAETGK

SEQ ID NO: 9277 - DNA, 1407 bp, Pseudomonas putida
  CDS (1)..(1407)
atgacgcaaacctcacccatagcgacagatgaaccgcacctgcaacgcaacctgaccaaccgccacatccagctgatcgccatcggcggcgcgatcggtaccggtctgttcatgggctcaggcaagaccatcagcctggccgggccatcgatcatcttcgtctacatgattatcggcttcatgctgttcttcgtcatgcgcgccatgggcgaactgctgctgtcgaacctgaactacaagtcgttcatcgacttttccgccgacctgctcggcccctgggccggctactttactggctggacctactggttctgctgggtggtcaccggcattgccgacgtggtcgcgatcgccgcctacacccagttctggttccccgacctgccgcagtggataccggcgctgacctgcgtagggctgctgctgtcgctgaacctggtcaccgtgaaaatgttcggcgaactggagttctggttcgccctggtcaagatcgttgccatcctcggcctggtcgctaccggcctgtacatggtcatcaccggcttcacctcgcccagcgggcgcaccgcccagctggccaacctgtggaatgacggcggcatgttcccccatggcctgatgggcttcttcgccggtttccagatcgccgtgttcgccttcgtcggcatcgagctggtgggtaccaccgccgccgaagcgaagaacccggaacgcaccctgccgcgggcgatcaactcgatcccgatccgtatcatcgtgttctatgtgctggcgctgatcgcgatcatggccgtgaccccgtggcgcgatgtggtgcccggaaaaagcccgttcgttgagttgttcgtgctggcaggcttgccggcggcggcaagcatcatcaacttcgtggtgctgacctcggcggcttcgtcggccaacagcggcgtgttctccaccagccgcatgctctacggcctgtcgcaggaaggtgacgcgcccaaggctttcgagaagctgtcgagccgttcggtgccggccaacggcctgtatttctcgtgcacctgcctgttgctcggtgcggtgctgatctacctggtgccgaacgtggtcgaggcattcaccctggtcaccaccgtgtcggcggtactgttcatgttcgtgtggacgctgatcctgctgtcatacctgaagtaccgcaaagaccgcgcggcgctgcaccaggcatcgaactacaagatgccgggcgggcgcttcatgtgctacgtgtgcctgtcgttctttgcgttcatcctggtgttgctgagcctggaggcggatacccgttcagcactggtggtgacaccgatctggtttgtcgtgctggcggtgacctaccagctcgtacgcagcaggcgccatccccgcacggccgtgcgtaacggctga

SEQ ID NO: 9278 - protein, 468 aa, Pseudomonas putida
MTQTSPIATDEPHLQRNLTNRHIQLIAIGGAIGTGLFMGSGKTISLAGPSIIFVYMIIGFMLFFVMRAMGELLLSNLNYKSFIDFSADLLGPWAGYFTGWTYWFCWVVTGIADVVAIAAYTQFWFPDLPQWIPALTCVGLLLSLNLVTVKMFGELEFWFALVKIVAILGLVATGLYMVITGFTSPSGRTAQLANLWNDGGMFPHGLMGFFAGFQIAVFAFVGIELVGTTAAEAKNPERTLPRAINSIPIRIIVFYVLALIAIMAVTPWRDVVPGKSPFVELFVLAGLPAAASIINFVVLTSAASSANSGVFSTSRMLYGLSQEGDAPKAFEKLSSRSVPANGLYFSCTCLLLGAVLIYLVPNVVEAFTLVTTVSAVLFMFVWTLILLSYLKYRKDRAALHQASNYKMPGGRFMCYVCLSFFAFILVLLSLEADTRSALVVTPIWFVVLAVTYQLVRSRRHPRTAVRNG

SEQ ID NO: 9279 - DNA, 1392 bp, Pseudomonas putida
  CDS (1)..(1392)
atgaacaccgtgggatctgatggcaaccttgcacaaggtttcaagccacgtcacgtaacgatgctgtccatcgccggcatcatcggcgccggacttttcgtcggctctggccatgccatcgcggcagccggcccagcaaccataatttcctatttcgtggccggtaccctggtggtactggtcatgcgcatgctcggcgaaatggccgtggcgcaccccgacaccggatcgttttccacctatgccgaccaggccattggccgctgggccggctataccatcggctggttgtactggtggttctgggtactggtcattcctatcgaagcattggccgccgggcatgtgctgaacgcctggttcccgcaggtggacagctggatcttcgccctggcttcggtgttgctgctggccggtaccaacctgttcagcgtggccaagtacggcgagttcgagttctggtttgccatcctcaaggtcaccgccatcctgggcttcatcggcctgggcttcgccgcgctgatggactggctgcccaaccgcgaggtcagtgggctgagcgggctgatggccgaatacggcggttttgcgccgaaaggctggtcggcagtggtgggtgcgttcatcactgtgatgttcagcttcatcggcaccgaggcagtgaccatcgccgcgtccgagtccagcgacccgtcgcgcaacatcgccaaggccacccgctcggtgatctggcgtatcagcaccttctacatcctgtcgatcttcgtgatcatttcggtggtgccgtggaacgacccgcagctggcggtggtgggttcgtaccagcgtgcgctggaaatcatgaacatccccaacgccgcgttcatggtcgacctggtggtgctggtagccgttaccagctgcatgaactcgtccatctacatcgcttcgcggatgatgttttcgctggccaagcgcggtgacgccccggccttcctcaacaagacctccaaggtcggtgtaccgcgtgctgcagtgttcggtagcaccctgatcggtgcggccatcgcagtcctcaactactttgcaccgaagggcgtgttcgagttcctgctggccagctctggcgccatagccctgttggtgtacatggttatcgccatctcccagctgcgcatgcgccgccgactggagcgcgagaacaccgaactgaagttccgcatgtggctgttcccgtacctgacctgggcggtgatcatcttcattgccggggcgctggcggtgatgatgtacacgcctgagcatcgggcggaagtgagctcgacattgggcctggcgatcgtgatttccttcctggggatcgtgacgtcgaggggtcatgcgcaaccggtggcagcgcgatcgatggggtga

SEQ ID NO: 9280 - protein, 463 aa, Pseudomonas putida
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMDWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMFSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVAARSMG

SEQ ID NO: 9281 - DNA, 1419 bp, Pseudomonas putida
  CDS (1)..(1419)
atgagtggacaaaacatgcattcaggcgagctaaagcggggcctgaagaaccgccatatccagttgatcgccctcggcggtgcgattggtaccggcctgttcctcggctcggcaggcgtgatgaaatccgccggcccgtcgatgatccttggctacgcgatctgcggcttcatcgccttcatgatcatgcgccagctgggtgaaatgatcgtcgaagagccggtggccggctcgttcagccatttcgcccacacctactggggtgggttcgccggcttcctgtcgggctggaactgctgggtgctgtatatcctggtggggatgtcggagctttcggcggtcggcaagtatgttcactactggtggccggagatccccacctgggtcacggcggcagccttcttcgtgctgatcaacgccatcaacctgatgaacgtgaagttcttcggtgaagccgaattctggttcgccatcatcaaagtggtcgccatcgtcagcatgatcggcctgggtgcctacctgctgaccagcggcagcggcggccctgaagccaccgtggccaacctgtggacacacggcggcttcttccccaacggcgtcagcgggctggtaatggccttggctttcatcatgttttcctttggtggcctggaaatgctcggcttcaccgccgccgaggccgacaagccaaagaccgtgatccccaaagcgatcaaccaggtcatctaccgcatcctgattttctatgtcggtgcgttggtggtgctgctgtcgctgaccccgtgggacaacctggtcgccagcatcgacgcctcgggtggcagctacggcagcagcccgttcgtgcaagtgttctcgctgctgggcagtgacgtggctgccaacctgctgaacttcgtggtgctgactgcggcgctgtcggtgtacaacagcggcacctactgcaacgcccgcatgctgctgggtatggccgagcagggcgatgccccggcgtcgctggccaaggtcgacaagcggggcgtgccagtgcgttcgatcctggtgtcggctgccgtgaccttcgtcgccgtgctgctgaactacctgatgccgcaaaacgcgctggaactgctgatgtcgctggtcgtggccaccctggtgatcaactgggcgatgatcagctactcgcacctgaagttccgtcagcacctcgaccgtaccggccagaaaccgctgttcaaggcgctgtggtacccgtacggcaactatgtggtgctggctttcgtggtgctgattctgggcatcatgctgatgatcccgggtatccaggtgtcggtgtatgcaatcccggtgtggctgcttgcaatgttggtggtgtacatggtcaagtcgcgtcgccaggtgaatgcgggcggtgctgttgagactgtggccaagtaa

SEQ ID NO: 9282 - protein, 472 aa, Pseudomonas putida
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPEATVANLWTHGGFFPNGVSGLVMALAFIMFSFGGLEMLGFTAAEADKPKTVIPKAINQVIYRILIFYVGALVVLLSLTPWDNLVASIDASGGSYGSSPFVQVFSLLGSDVAANLLNFVVLTAALSVYNSGTYCNARMLLGMAEQGDAPASLAKVDKRGVPVRSILVSAAVTFVAVLLNYLMPQNALELLMSLVVATLVINWAMISYSHLKFRQHLDRTGQKPLFKALWYPYGNYVVLAFVVLILGIMLMIPGIQVSVYAIPVWLLAMLVVYMVKSRRQVNAGGAVETVAK

SEQ ID NO: 9283 - DNA, 1383 bp, Pseudomonas putida
  CDS (1)..(1383)
atgcaatcacacggtttgaagcaaagcctcaagcagcggcatatcaccatgatcgcgctgggtggggtgatcggtgcagggctgttcatgggctcgggctcactgatcgcatcggcagggcccgcggccatactgtcgtatttcattggtggcctggtggtcaccctggtcatgttcatgctgggcgaaatggcctgccgcaacccggatgcagggtcgttctcgacctacgccaacacctacctcggcgactgggctgggtttgcggtcggctggctgtactggttcaagtcgatgatgaccatcaccctggaagcggtactgctgggcgccatcctgcatgacttcctgccctggctaccgatctgggcaggcgccttcctgatgctggtgacactcatggccagcaacgcctactcggtgcgttcgtttgccgaagtagagtattggctggccgcgatgaaggtcgccaccatccttatcttcatgctgctgggcgtctcgatcctgctcggcctgcacagtgatattcccgccccaggcctgatcaacctcaccgcccatgacggcttcatgcccaacggcctgtcaccggtgatggccggcgttatcgtggtgattttctccctgggcggcagcgaaattgccgctgtggccgcgggtgaatcagagaacccccgacagaacgtgatccgcgcgatcaagagcgtgatcctgcgggtgatgctgttctatgtaggttccgtgtcgatcctgatcctttgcctgccctggaccgacaaggccaacctggcctcgccctatgtttcactgttcagcctggccgggttcggtggtgcggcagtggccatgaaactggtgctgttcgtctcgttcatgtcagtgatgaactcgttcatgttctccaactcacgcatgctgttctcgctgagccagcgcggtcacgcacccaagctgttctcacgcaccagtgccaagggcgtaccgatcaatgcactgctgctgagcctgtcgatctgcacgatgatcctgaccgtgcactttgtcagtggcggcgacctgttcatgaccttggccaagagtaccggcagcctggtcatggtcgtatggatcttcatcatcatcgcccacgtggccatgcgcatcaaaacccgccacgaagcggtcgccccaaacgccttccgtgcctggctgttcccctacaccaatatcattgcgctgttcgccttgctggcagtcatcggcacccaggcgttcgacccggcatcgcgtttccaattctggttcacggtgctgacggtactgctggtggtggcggggtacttcctgatgcgccagcggctggcgtcaagcgcggtgttagcccacgaacgtgatgcatga

SEQ ID NO: 9284 - protein, 460 aa, Pseudomonas putida
MQSHGLKQSLKQRHITMIALGGVIGAGLFMGSGSLIASAGPAAILSYFIGGLVVTLVMFMLGEMACRNPDAGSFSTYANTYLGDWAGFAVGWLYWFKSMMTITLEAVLLGAILHDFLPWLPIWAGAFLMLVTLMASNAYSVRSFAEVEYWLAAMKVATILIFMLLGVSILLGLHSDIPAPGLINLTAHDGFMPNGLSPVMAGVIVVIFSLGGSEIAAVAAGESENPRQNVIRAIKSVILRVMLFYVGSVSILILCLPWTDKANLASPYVSLFSLAGFGGAAVAMKLVLFVSFMSVMNSFMFSNSRMLFSLSQRGHAPKLFSRTSAKGVPINALLLSLSICTMILTVHFVSGGDLFMTLAKSTGSLVMVVWIFIIIAHVAMRIKTRHEAVAPNAFRAWLFPYTNIIALFALLAVIGTQAFDPASRFQFWFTVLTVLLVVAGYFLMRQRLASSAVLAHERDA

SEQ ID NO: 9285 - DNA, 1383 bp, Pseudomonas putida
  CDS (1)..(1383)
atggcttcgcaagacaacaagaaacagcgctcactgcagcacggcctgacttcccgtcaggtttccatgatctccattgccggcatcatcggcgccgggctgttcatcgggtcctccaacgccattgccaccgccggcccggccatcctcatctcctacgccatgactggcctgctggtcttgctggtgatgcgcatgctgggtgaaatggccatcgcaaaccccaatagcggctctttttccacctacgcctcggaggccatcgggccttgggcgggctttaccattggctggttgtactggtggttctgggtgttgatcattccggtggaggccattgccggtgctgacatcctgcatgcctacttccctggcgtgccgtcctggctgttcgctttcctgatcatgctggtgctgtcgggcaccaacctggtcagcgtgaagaacttcggtgccttcgagtactggttcgcgctggtcaaggtggtcgcgatcattggcttcatcggggtctgcaccttggcggtgttcggcttctggccgctggcagaggtatccggggtgagccggctgtgggacagcggtggtttcatgcccaatgggtttgggacggtgcttgggggcgtgctgatcaccatcttctcgttcttcggtgccgaaattgtcaccatcgcggctgacgaaaccgccaacccgaaagacaagattcgccgcgccaccaacctggtggtgtaccgcatcgccatcttctacctggcgtcgatcttcctggtggtgtcgctggtggcctggaacgaccccgggctcaaagcggtagggtcgttccagcgtgtactggaagtgctgaacgtgccgggcgccaagttgctggttgacctggtggtgctggtggcggtgacaagttgcatgaactcggggctctacacggcgtcgcgcatgctctattcgctgggcgcgcgtggtcaggcgctgagcgtgaccaagcgcatctccggttccggcgtgccgaccgtggcagtgatcttctccaccctggcgggcttcgctggctgcttcgtcaactatgtgttcccgggcaaagtgtttggcttcctgctgtcgaccaccggcgccatcgccttgctggtgtacctggtcatcgccgtgtcgcaactgcgcatgcgtgcccgtgccgagcgtgaagggcgtccgctggaactgaagatgtggctgttcccatggctgacctggctggtgataggcaccatcgtcatggtgctgggctacatgctgttcagcgatgcctatcgctacgaaacgctgatgactgccggggtgaccgcgttcattttgctggtttcgctgacccagcggcgtgcgaagatggttgcccagacggcctga

SEQ ID NO: 9286 - protein, 460 aa, Pseudomonas putida
MASQDNKKQRSLQHGLTSRQVSMISIAGIIGAGLFIGSSNAIATAGPAILISYAMTGLLVLLVMRMLGEMAIANPNSGSFSTYASEAIGPWAGFTIGWLYWWFWVLIIPVEAIAGADILHAYFPGVPSWLFAFLIMLVLSGTNLVSVKNFGAFEYWFALVKVVAIIGFIGVCTLAVFGFWPLAEVSGVSRLWDSGGFMPNGFGTVLGGVLITIFSFFGAEIVTIAADETANPKDKIRRATNLVVYRIAIFYLASIFLVVSLVAWNDPGLKAVGSFQRVLEVLNVPGAKLLVDLVVLVAVTSCMNSGLYTASRMLYSLGARGQALSVTKRISGSGVPTVAVIFSTLAGFAGCFVNYVFPGKVFGFLLSTTGAIALLVYLVIAVSQLRMRARAEREGRPLELKMWLFPWLTWLVIGTIVMVLGYMLFSDAYRYETLMTAGVTAFILLVSLTQRRAKMVAQTA

SEQ ID NO: 9287 - DNA, 1407 bp, Pseudomonas putida
  CDS (1)..(1407)
atgactgacagcgttgaaaaaatccagctcacccgcgccctgaaaagccggcacatcttcatgctgtcgctgggtggggttattggaaccggcctgttcatgggctcgggcgtaaccatcaatcagggcgggccggtgggcgcgatcctggcttacctggtcgcaggcttgctgatgtacctggtgatggtctgcctgggcgagctgtcggtgcagatgccggtgtccggttcgtttcaggcccacgccaccaaatacattggcccggccaccgggttcatgatcggctgggtgtactggatgagctgggccaccaccgtaggcctggagttcaccgctgccggcatgttgatgacccgctggttcccggaggtgccgatctggtactggtcggcgctgttcgtggtggtgctgttcgggctcaacgccctggccacgcgtgcctttggcgaggccgagtactggttctcgggcatcaaggtggcaaccatcctcggcttcatcgtcattggcctgctggtgatcttcggtgccatccccctgagcagcggggcacccgcaccgatgctgaacaacctggtgggcgagtcgctgttcccccatggcctgtcggcagtgttcgcggtgatgatgaccgtggtgtatgccttccagggctgcgaaatcatgggggtggctgccggtgagaccgagcacccggaaaagagcatcccgcgggcggtgcgcaatgtggtgttccgcgtgctgatcttctatgtgctggcgattgccgtgctgtcggccattgtgccgcacgagcaggccgggctgatggaaagcccgttcgtgcaggtgttcgacatggtcggcatcccttacgccgccgacttgatgaacttcgtcatcctcacggccatcctctcggtgggcaactccgggttgtatgcctccacgcgtatcctctgggccatgtccaagactggcatggcaccgaaaagcctgtcgccgctgagcaagcgtggcgtgccgctgcgggcgctgagcatcaccctgtgctttgcgctgatctcgctgatgaccagcttcgtcgcggctgacacgctgttcatggtgctgatggcggtgagcggcatgtccggcaccgtgacctggatcgtcatcgccctggcgcagtaccgtttccgcaaggcctggctgcgtgacggcgggcaactgcaggacctgaagtacaaggcgccgctgtacccactggtgccgctgctgtgcatcaccctgtgcagttcgctgttcgtgttcctggcgctggatgaaacccaacggccgtcgctgtactggggctttggcttcattgccctgtgctatgcggcgtacttcttcgtcaaccgccgtcggcagggggccttcgcacccagcacaccaggggtttga

SEQ ID NO: 9288 - protein, 468 aa, Pseudomonas putida
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 9289 - DNA, 1392 bp, Pseudomonas putida
  CDS (1)..(1392)
atgcaaacccacaagaacaatttgagtcatggattgaaatcacggcatgtcaccatgctgtccattgccggcgtgatcggcgccgggctgtttgtcggctctggccgcgccatcgccgaagcggggcctgccaccatcctggcctatatcctggcgggcggcctggtggtgctggtgatgcgcatgctggctgaaatggctgtggcctccccggacaccggctcgttttcaacctacgctgacctcgccatcggcaaatgggccggttacaccatcggttggctgtactggtggttctgggtgctgatcattccgatcgaggccaatatcgccgctaccatcatcaactcctgggtcccgcagctggagatctgggtgttgtcgttggtgatcacgttgctgctgacggccaccaacctgttcagcgtgaagaattacggtgagttcgagttttggctggcactggtcaaggtggtggccatcgtcagcttcatcgccctgggtgtttgcgccattttcggcctgttgccgggggccggcgtcagcggcgtctcgcgcctgtgggatacggggggcttcatgcccaacggctttggtgcggtgctgagcgcgatgctgatcaccatgttctcgttcctcggggccgaggtggtgaccattgctgcggctgagtccgacgaggcgggcaagcatatttccaaggccaccaattcggtgatctggcggataacgctgttctacatcctgtcgatcttcatcgtcatcgcattggtaccgtggaccgacccacgcctggcgaccgaaggctcttatgtcacggtgctggacaccctcggcgtgccaaatgccaaggccatcatcgacttcgtggtgctgacgtcggtgaccagctgcctcaactcgtcgctgtacaccgcctcgcgcatggtctattcgcttagccgccggggtgatgccccggcctgtgcccagataaccagccgcagtggtacacccgtggtggcagtcttgttgtcgactggggctgcattcctggcggtgatcgccaactacctggtgccggccaaggtgtttggcttcctcatggcaagctccggcgccattgccttgctggtgtatctggtcatcgccatttcccagctgcgcctgcgccagcgcctgacggcacagggcaagacactgggttatcgcatgtggctgttcccgtggctgacctggggcgtgatcctgttcatcagcggcgtactggtattgatgctgttccgcccggatcatcgcctggaagtggtctcgacgatggtgctggcggtgttggtggtgtgctcgggggtgctggtgacccggcgccgggcgcgcggcggggccgtggctggcgtagggcagggcgcctga

SEQ ID NO: 9290 - protein, 463 aa, Pseudomonas putida
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQLEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVPNAKAIIDFVVLTSVTSCLNSSLYTASRMVYSLSRRGDAPACAQITSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGVLVTRRRARGGAVAGVGQGA

SEQ ID NO: 9291 - DNA, 1413 bp, Pseudomonas putida
  CDS (1)..(1413)
atggacgcaacatccacaaccaccaccgcgaaaagcgggcacgagagcaagctcagtgcctcgctgaagtcgcgccacctgacgatgatgtcgatcgccggggttatcggcggcgccttgttcgtcggttccggcagcgtgatccacagcgccggcccagccgctgtcctggcctacctggcaggcggcatcctggtggtgctgatcatgcgcatgctgggtgaaatggcgacttcctcgcctgacaccggctcgttctcgacctacgccgaccgcgccattggccgttgggccggttttaccatcggctggctgtactggtggtactgggtcatcctcatggcctgggaagcctatgtggcgggcaagatcctgcatggcttcttccccgacgtcagcgtcaacgtgttcgtgctggccacaaccctgttgctgatcaccgtcaacttcttcaacgtcaagcactacggtgagttcgagttctggttcgccttgatcaaggtgattgcgatcgtctgcttcctgatcgtgtgtacggctgccgtgatgaacatctggcagttcggtgaagtgcgtggcatcagccacctcaccgccgaaggcttcatgcccaatggcatcaccactgtgatcggtgccttgctcggggtgatgttcgccttcctcggcgccgaaatcgttaccatcgcggcctccgaagccaaggacccggctgcgcagatcgtcaaggcgaccaactcggtggtctggcgtgtgtgcctgttctacgtcggctcgatcttcctgatcgtctgcctggtaccgtggaacgacccgcacctgggtgtttctggctatggcgcttatcgccgtaccctggagctgctgggggtgccgtatgccgagctgttgatgaacttcgtggtgctgacttccgtgagcagctgcctgatctccggccactacaccgcttcgcgcatgctgttctccctggcccagcgtggcgacgcgccgtcgttcttcaagatcacccgcgccggtaccggtgtaccggtgtacgcgatcatgggttcgtgcgccgtggccgtggtatgtgcattgatcaacttcagcgagaccctgcgcccgaaagacgtgctggacaccctgatgaacaccaccggcatgatcgccctgctggtgtacctggtcatcgccttctcgcagctgcgcatgcgccgcaagctgattgccgagggcaaggaagtacgcctgaagatgtggctgttcccgtggctgacctacctggtgatcgcgttcatcgtggctgccctggtcaccatggccttcatgcctgactaccagatcctggtcatttccaccggtatcgctgcggcggtcgtggtggcgatgggtgtggtgcaccagatccgctctggtagcaagcagcactaa

SEQ ID NO: 9292 - protein, 470 aa, Pseudomonas putida
MDATSTTTTAKSGHESKLSASLKSRHLTMMSIAGVIGGALFVGSGSVIHSAGPAAVLAYLAGGILVVLIMRMLGEMATSSPDTGSFSTYADRAIGRWAGFTIGWLYWWYWVILMAWEAYVAGKILHGFFPDVSVNVFVLATTLLLITVNFFNVKHYGEFEFWFALIKVIAIVCFLIVCTAAVMNIWQFGEVRGISHLTAEGFMPNGITTVIGALLGVMFAFLGAEIVTIAASEAKDPAAQIVKATNSVVWRVCLFYVGSIFLIVCLVPWNDPHLGVSGYGAYRRTLELLGVPYAELLMNFVVLTSVSSCLISGHYTASRMLFSLAQRGDAPSFFKITRAGTGVPVYAIMGSCAVAVVCALINFSETLRPKDVLDTLMNTTGMIALLVYLVIAFSQLRMRRKLIAEGKEVRLKMWLFPWLTYLVIAFIVAALVTMAFMPDYQILVISTGIAAAVVVAMGVVHQIRSGSKQH

SEQ ID NO: 9293 - DNA, 1419 bp, Pseudomonas putida
  CDS (1)..(1419)
atgccagtcggcaaccactctgcccacggccaggccactgaaggcggcccgctcaagcgtgaactgggcgaacggcacatccgcctgatggcgctgggcgcctgtatcggtgtcggtcttttcctcggttcggccaaggcgatcgaaatggccggcccggccatcatgttgtcctacatcatcggcggcctggccattctggtgatcatgcgcgcccttggtgaaatggccgtgcacaaccctgtcgccggctcgttcagccgttatgcccaggattacctcggcccattggcgggcttcctgaccggctggaactactggttcctgtggctggtgacctgtgttgccgaaatcacggcagtggccatctacatgggcatctggttccccgacgttccgcgctggatctgggccctggcggcgctgggcagcatgggcgcggtcaacctggtggcggtgaaggcttttggtgagttcgagttctggttcgcgctgatcaagatcgtcaccatcatcgccatggtgcttggcggcatcggcatcattgccttcggctttggcaatgacggtgtggcagtggggatctccaacctgtggagcaacggcggtttcatgcccaatggtgtgaccggcgtgctgatgtcgctgcagatggtgatgttcgcctatctgggtgtggaaatgatcggcctcaccgccggtgaagcacgcaacccgcaaaagaccattccgcaggccatcggctcggtgttctggcgcatcctgctgttctacgtcggcgcgttgttcgtgatcctgtcgatttacccgtggaacgaaatcggtagccagggcagcccgttcgtcatgaccttcgagcgcctcggcatcaagaccgctgccggcatcatcaacttcgtggtcatcacggcggcgctgtcgtcgtgcaacggcggcatcttcagcaccgggcgcatgctctatagcctggcacagaacggccaggcgccggcggccttcgcccgcacctcgaagaacggcgtgccacgcaatgcgctgctgctgtcgatcggcgcgttgctgctgggcgtgctggccaactacctggtgccagaaaaggtcttcgtctgggtgacctcgatcgccaccttcggtgcgatctggacctgggtgatgatcttgctggcgcagctgaagttccgtgccggccttaccactgccgagcgcaaggcactgaagtaccgtatgtggctgtggccgttgagctcgtatctggcactggccttcctggtgctggtggtggggctgatggcgtacttcgaggatacgcgtgtggccctgtacatcggcccggcgttcctggtgttgctgacagtgctgtattacacgttccgcctggcgccgaaagacgcacaaggtgtgacgagtacagcctcctga

SEQ ID NO: 9294 - protein, 472 aa, Pseudomonas putida
MPVGNHSAHGQATEGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVLGGIGIIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYTFRLAPKDAQGVTSTAS

SEQ ID NO: 9295 - DNA, 1362 bp, Pseudomonas putida
  CDS (1)..(1362)
atgcaagaccagagcacgcccgagcggttacagcgcgggctgaagaatcgccatatccagctgatcgcgctgggcggggccatcggtaccgggttgttcctgggcattgcccagaccatccagttggccggcccctccgtgttgctgggctacgccatcgccggcctgatggccttcctgatcatgcgccagctgggtgaaatggtggtggaagagccggtcgccggcagcttcagccacttcgcccaccaatactggagcgagtttgccggctttgtctcaggctggaattactgggtggtgtacgtgctggtcggcatggccgagctgacggcggtcggtatctacgtgcagtactggtggccggacttccccacctgggccacggcggcgatcttcttcgtggtgatcaacctgatcaacctgactcaggtaaaggtctatggcgagatggagttctggttcgccctggtcaaggtggtagccatcgtcagcatgatcggctttggtgcctggttgctgggtagcggtcatggtggcccggatgccagcgtggccaacctgtggcagtacggcggcttcttccctaacggcgtcacgggtctggtaatggccctggcggtgatcatgttctcgttcggtggcctggagttggtcggcatcacggctgccgaggctgacaacccgcgcgagagcatccccaaggccaccaaccaggtggtgtaccgtatcctgattttctacatcggtgccttggcagtgctgttgtcgctgtacccttggcagaaggtggtgcagggcggcagcccgttcgtgatgatcttccacgaactggacagcgacctggtggcgaccatcctcaatatcgtggtgctgacggctgcgctgtcggtgtacaacagctgtgtgtacgccaatagccgtatgctgtttggcctggccagccagggcgatgcgccgcgtcagttgctgaaggtgagccgtagcggcgtgccgctgaccgcgctggccgtgtcggcctttgcgaccggcctgtgcgtgctgatcaattacctgatgccgggcggggcctttggtttgctgatggcgttggcagtgtccgcgttggtgatcaactgggcgagcatcagcattacccacctcaaattccgcaaggccaagctggccgccgggatcacccccttctacaaaagcctggggcacccgctgaccaactacctgtgcctggcgttcatcgtgctgatcctggtagtgatgtacctgacgccgccgattcgcatctcggtaatgctgatcccggcatggatcgctgtgctgtgggtggctttcaagctgaagaaggctcgccaggccaagggctga

SEQ ID NO: 9296 - protein, 453 aa, Pseudomonas putida
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPDFPTWATAAIFFVVINLINLTQVKVYGEMEFWFALVKVVAIVSMIGFGAWLLGSGHGGPDASVANLWQYGGFFPNGVTGLVMALAVIMFSFGGLELVGITAAEADNPRESIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALAVSAFATGLCVLINYLMPGGAFGLLMALAVSALVINWASISITHLKFRKAKLAAGITPFYKSLGHPLTNYLCLAFIVLILVVMYLTPPIRISVMLIPAWIAVLWVAFKLKKARQAKG

SEQ ID NO: 9297 - DNA, 1440 bp, Pseudomonas putida
  CDS (1)..(1440)
atgtccgtgcagacaaccacaactagaaatgcctcggcgcataccttcaagcaggatatgcaaacccgccacatcgtcatgctggcgctgggcggagtgataggcaccggcctgtttctcacgtcgggctacaccgttaaccaggccggcccgttgggcgcggtcatcgcttacatactcggcgcaatcatggtgtacctggtcatgatgtgcctgggcgagctggcggtacacatgccggaagtcggctcgttcagcagttacgccacgcgttacctcggcccgggcaccggctacatggtggcctggatgtactggctgacctggacggtggcaatcggctccgaattcaccgccgcgggcatcctgatggtgcgctggttccccgacacgccggtatggatgtggagtgcgctgttcggcgctgcggtgttcatcagcaatatcatttcggtgcgatcgttcgccgaaaccgaattctggttgtcactggtcaaggtgttggccgtcatcgcctttctggtggtgggcggcggggccattctgggtggcttcgagatccagcaggcgcacagtgcagggctgggcaatttcacccgtgaagggttgttccccaccggtttctggtccattgcaatgaccctgctggcagtggccttcgcgttctcgggtaccgagctgatcggcatcgctgccggcgaaaccaaagacccggaaaagaacgtgcccaaggccattcgcaccacggtcctgcgcctggcgctgttcttcatcggcaccatctttgtactggccaccttgctgccgcgtgaacaggccggggttattgaaagcccgttcgtgatggtctttgcgatgattggtatcccgtatgcggccgatatcatgaacttcgtcatcatcaccgcgctgctgtctgccgccaactccggcctctacgccgcttcgcgcatgctctggaccctcagcgaccaaggcaacatgccccgccgttacgccacgctgtcgcgccgcggcacccccttcaatgcgatcgtgctgagcatggctggcggcatggcttcgctgttgagcagtgtgtttgcccccgacaccatctacctggcgctggtgtcgatttcagggttggccgtggtagtggtgtggatcagcatcgcggccagccagatcgcattccgccgtcattacatcgccagcggcggcaagctcgaggacctcaagttccgggtgcgtggctacccgttcgtaccactgggggccattttctgctgcgtactggcctgcgtcggcattgccttcgacccagctcagcgggttgccctgtacttcggcttgcccttcattgcctggtgctacctggcctattggctgacgtgcaagtaccgcagccgccgtacggccccgctggaaatcgtcgccccaggttccgaggccgcctag

SEQ ID NO: 9298 - protein, 479 aa, Pseudomonas putida
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 9299 - DNA, 1386 bp, Pseudomonas putida
  CDS (1)..(1386)
atgagcggtaacaattccaatgacctcgctcaggggctcaaacaacggcatgtgaccatgctgtccatcgctggcgtcatcggtgccggcctgttcgtaggctccggccacgccatcgcagcggccggccctgccgtgctgctggcttacgctgccgccggtacgctggtcgtgctggtgatgcgtatgttgggtgaaatggcagtcgcctcgcctgacaccggttcgttctctacgtatgccgaccgcgccatcgggcgctgggccggtttcaccattggctggctgtactggtggttctgggtgctggtgattccgctggaggccaacgccgccgcagccattctgcatgcctggttcccggcggttgacctgtgggcgttctccctcatcattaccctggcactgacactcaccaacctgtgcagcgtgaagaactacggtgagttcgagttctggtttgccctgctcaaagtgctggcgatcatcggcttcatcgccgtgggctgtgctgccttgttcggctttgtaccgagcagccaggtgagcggtaccagccacctgttcgatacccagggcttcatgcccaacggcctgggcgcggtgctggcagccatgctgaccaccatgttctcgttcatgggtaccgaaatcgtcaccatcgccgctgccgagtcgaaggacccgggcaagcagatcagccgtgccaccaactcggtaatctggcgtatctgcctgttctacctggtatcgatcttcctggtcgtggccctggtgccgtggaacgacccggccctggccgagacgggctcctaccagaccgtgctgagccgtatcggtgtgccgaatgccaagctgatcgtcgacattgtcgtgctgattgccgtgaccagctgcctgaactcggcgttgtacacttcttcgcgcatgttgttctcgctgagcaagcgtggcgacgccccggccatcgcccagcgcaccaccaaggcggcgaccccgcacgtggcggtactgctgtccaccgcagcggcattcctttgcgtgttcgccaacttcgtggcaccggcccaggtgttcgagttcctgctggccagctctggcgccatcgcgctgctggtgtacctggtgattgccgtttcgcagctgcgcatgcgcgcccagcgtgaagcccgcggcgagaagatcaccttcaagatgtggctgttcccgggcctgacctgggcgaccattgccttcatcgttgccattctggtggtcatggcgctgcgtgaggatcaccgtgcggagatcattgcgactgcgctgctgagtattggtgtggtggcggctggcttgctggtgcaccgcaagcgcgaggctgccgggcgggcggcgctggacagctga

SEQ ID NO: 9300 - protein, 461 aa, Pseudomonas putida
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPSSQVSGTSHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRAALDS

SEQ ID NO: 9301 - DNA, 1383 bp, Lactobacillus plantarum
  CDS (1)..(1383)
atgaaaataactaatgctgatggcacgatccgggcacttagtaaccggcatgtccaaatgattgcaattggtggcacgattgggacaggattatttcttggttcagggagtacgatttcaaagacgggaccgtcagtcatgtgggtgtacttggtgttgggcttcttcttctttttaatgatgcgggcaattggtgagatgttctattctgatcctacccaacacacattcgtggcgtttatttcccgctatttgggaccgagtgttggttattttacagggtggacctattggatcggtttgatttttgtctgtatggctgagctgacggctacggcaacgtatgtcaaattttggttaccaaatgtccccgcctggctaattgagattagcttcctgttaattttggcgggcgttaatttaacggctgcacggttatttggcgaagcagagttctggtttgcgatgattaagatcgtcgcaatcattgcactgattatcactggtattttcatgatggtgggacatcacccaaccccattaggccaggcttcaatcggcaatttgttccataattatcaggtctttcccaatgggatagctaattttatctcggcatttccaatggtcttctttgcttttcagggcattgaatttgtcagtataacgattggtgaggccaagaaccctcaccgcgttatcaaaaaggcggtcaatgaaactttgttgcggattttgttgttttatattggtgcgttaattgtcattatgggcattattccgtggacgtcactgtcacccgatagcagtccgtttgtgcaagtcttcaagttggcagggtacccagcagcggccgccatcattaactttgtcgtcttaacgtcggcagcctcatcgctaaatagttgtttgttctcagctggacgtcacttctatcagctagccactgaaatgccagttacgagtcgcatgcaccaaatctttggtcagatttcgaaaagtggtgtgccggcagcagcaatcgtgttgtccgcgatactagtgctagtgacccccatcatgagtttaagtgctgcaacgacggcagtttttaccgtcgtgaccgggatctctagtgatatgtacctgattgtttacacgctggcgatgctggcccatcggaagtaccggctatctaatgactatctggcggatgggtttaagatgccggcgtaccgaatcacgagcccactgacgattgccttttttgttcttatttttgccagtctattcttcattcaagctgatattgtcggtgcaatcggtgcgattatttggacgttactatttggtggcatcacttttgctcaccaagcgcgcttgcgagctgtaacgcggtcgtaa

SEQ ID NO: 9302 - protein, 460 aa, Lactobacillus plantarum
MKITNADGTIRALSNRHVQMIAIGGTIGTGLFLGSGSTISKTGPSVMWVYLVLGFFFFLMMRAIGEMFYSDPTQHTFVAFISRYLGPSVGYFTGWTYWIGLIFVCMAELTATATYVKFWLPNVPAWLIEISFLLILAGVNLTAARLFGEAEFWFAMIKIVAIIALIITGIFMMVGHHPTPLGQASIGNLFHNYQVFPNGIANFISAFPMVFFAFQGIEFVSITIGEAKNPHRVIKKAVNETLLRILLFYIGALIVIMGIIPWTSLSPDSSPFVQVFKLAGYPAAAAIINFVVLTSAASSLNSCLFSAGRHFYQLATEMPVTSRMHQIFGQISKSGVPAAAIVLSAILVLVTPIMSLSAATTAVFTVVTGISSDMYLIVYTLAMLAHRKYRLSNDYLADGFKMPAYRITSPLTIAFFVLIFASLFFIQADIVGAIGAIIWTLLFGGITFAHQARLRAVTRS

SEQ ID NO: 9303 - DNA, 1386 bp, Lactobacillus plantarum
  CDS (1)..(1386)
atgacgaaagaaaattcacagcctgcgacggaacaactctcgcgaggcttaaaaagccgccatgttcaattaattgccatcggcggcacgattgggaccggactgttcttaggggccggtcaatctatccacttggcggggccagcgatcctgatcgcatacttagtgaccggtttagtgtgctttttattaatgcgggcgttaggtgaactactgttatctgaccttcatacgcattcttatattgattttattaagcaatacttaggtgataagaccggctttgtggctggatggacgtattgggtttgctggatcacgattgcgatggccgaaattacggctgctggtgagtatatgcagttttggtggcctaggttaccgcaatggcttccggggctgattatcttgattttattgctgggcttgaattctattaatgtctcagcgttcggtgaaactgaattttggtttgcgattattaagatcgctgctatcttggcattaattgctgttgggattggcatggtcttgttaagcgttaagacccctgtgggccacgccagcttaaccaatttggttagttatggcggttttatgccacacggaatcaaaggcttagtgctttccttccagatggtcctgttcagttttattgggatcgagatggtcggcatgacagcttctgagacggctgatccgaagacggtgattcccaaagcaatcaatgatattcccgtgcggatcattctgttttatgttgggtcactattctttctaatgtgtatgtacccgtggcaatacttttcagcggcacacagcccgttcgtacaagtattcaccaatttgggaattcgttcagcggctgcgattatcaacttcgtagtgctcacggcggccgcttctagttgtaatagtgcgttattcagtaccgggcggatgttattctcactaacgtatgatggcaaaagcaagtttgccaaacgaatggggatactatcgacccgccaagttccccgcaatgcgttatggttctcgacgctggtgattgggttgtcagtaattctaaacttactgatgcctgggaaagtcttctcgctgattgcgagtgtatcgactacttgttttatctttatttggggcgcaatcgtcgtcgcacatatcaagtatcgacgtcaagcgggcagtcaggctaaagtgaaattccggatgccactgtttccgttatctgattacttcattctagtgttcttagcttttatcgctgttgttctctgtctgaagtttgaaacgttaatcgcgttactcgtgtcagcggtctgggtggttggcttatacattgtcaagatcgttagtgaccgaattcgtcaacggacacacgactag

SEQ ID NO: 9304 - protein, 461 aa, Lactobacillus plantarum
MTKENSQPATEQLSRGLKSRHVQLIAIGGTIGTGLFLGAGQSIHLAGPAILIAYLVTGLVCFLLMRALGELLLSDLHTHSYIDFIKQYLGDKTGFVAGWTYWVCWITIAMAEITAAGEYMQFWWPRLPQWLPGLIILILLLGLNSINVSAFGETEFWFAIIKIAAILALIAVGIGMVLLSVKTPVGHASLTNLVSYGGFMPHGIKGLVLSFQMVLFSFIGIEMVGMTASETADPKTVIPKAINDIPVRIILFYVGSLFFLMCMYPWQYFSAAHSPFVQVFTNLGIRSAAAIINFVVLTAAASSCNSALFSTGRMLFSLTYDGKSKFAKRMGILSTRQVPRNALWFSTLVIGLSVILNLLMPGKVFSLIASVSTTCFIFIWGAIVVAHIKYRRQAGSQAKVKFRMPLFPLSDYFILVFLAFIAVVLCLKFETLIALLVSAVWVVGLYIVKIVSDRIRQRTHD

SEQ ID NO: 9305 - DNA, 1341 bp, Lactobacillus plantarum
  CDS (1)..(1341)
atggaaaatcagcaacttgcccgtaaactaaaacgccgtcacgtgcagatgattgcgcttggtggcgcgattggaaccgggctctttttaggctccggtttagcaatcaaacaggcggggccgtcgatcttgttggcttatgccattggcggtttcttctgttacttgatgatgcgagcactgggcgagctattattgtcggatacgcgtttacattcgtttctagaattcattaatcgatatttaggtaaacgtttcgagtttgccattgggtggacctattggctctgctggatcagtttagctatggctgacttgactgcgagtggtatctacattcgttactggtttccgtggatcccgcagtgggtgacacccttaataattattttgattttattagtattcaatatgctctccgtcagtgcgtttggcgaattagaatattggttttcgatgattaaagtggtggctatcattgctttgatcgtgacgggggctatcttgattggttcatcggcccatgtcggtgggcaaacggtctcggtgacaaatttggtcagtcacgggggcttcttcccaacaggcgtccagggcttcttgatgtcattttcgctcgttatctttgcgtttacaggcatcgaaatggtcggaattacagctggggaagccgaaaacccagaaaaagaattaccacgggccatcaatagcttacccattcgaatctcattcttctacgtgggcgctttattcgtgatcatggcaatttatccttggaatcagatcacgaccagtcagtcaccctttgtgcaagttttcagcgacgttgggatcaaagccgcggccagcattatcaacttcgtggttctgaccgcggcgctctcggcttgtaatagtgccatcttcagtacgagtcgaacactatttacacttgcgcacggtgacaacgcgccgaaatggatgggaaaggtcaatcgttacaacgttcccgcccgctcattgttattctcatcattgatcttactggtgatcgtggcgttgaattacgtgattccaagtaccgtcttcacgttgatctctaacgtggcaacaaccaacttcatcattgtttggtgtgccttgttggtgtgccattacgtttacaaacgaaccactgacagtacgcataatccgtttaaactgcccctgttccctgttaccaacatcgcgaccttggccttctttatcgcggtgacggtcgtcttgtgctttgatcaagtcaaccgttgggcagtcatcggttcagtcgtttggttcgtcattttattagtcatcgaacgaagtatgcatcgcaccgtttaa

SEQ ID NO: 9306 - protein, 446 aa, Lactobacillus plantarum
MENQQLARKLKRRHVQMIALGGAIGTGLFLGSGLAIKQAGPSILLAYAIGGFFCYLMMRALGELLLSDTRLHSFLEFINRYLGKRFEFAIGWTYWLCWISLAMADLTASGIYIRYWFPWIPQWVTPLIIILILLVFNMLSVSAFGELEYWFSMIKVVAIIALIVTGAILIGSSAHVGGQTVSVTNLVSHGGFFPTGVQGFLMSFSLVIFAFTGIEMVGITAGEAENPEKELPRAINSLPIRISFFYVGALFVIMAIYPWNQITTSQSPFVQVFSDVGIKAAASIINFVVLTAALSACNSAIFSTSRTLFTLAHGDNAPKWMGKVNRYNVPARSLLFSSLILLVIVALNYVIPSTVFTLISNVATTNFIIVWCALLVCHYVYKRTTDSTHNPFKLPLFPVTNIATLAFFIAVTVVLCFDQVNRWAVIGSVVWFVILLVIERSMHRTV

SEQ ID NO: 9307 - DNA, 1383 bp, Lactobacillus plantarum
  CDS (1)..(1383)
atgtcaaaacaaacccacctcagtcgccagatggaatcacggcacgtactgatgatttcgctcggtggcgtgattgggaccggattatttttaagttccggttacacgattcatcaagcggggccaattgggaccctgctcgcctataccattggagccatcctcgtctatctcgtcatgctctgtctaggtgagctgtcagttgcaatgccctacaccggggcgtttcacgtctatgcgaaaaaatatattggtcccggcacaggctttacggttgccatcctatattggttgacttggacgattgccctcggttcagaatttacagcagcggggctcatcatgcaaacgtggtttccgcacattgcgacctggatctggagcctcgtctttatggtggtcatcttcaccgttaacgccctctccgtacgctggtttgcggaaacggaattctggtttgccagtatcaaagtcatcgcgatcattgcttttattgtgttaggcggactggcaatggtcggtatcctgccacttcacggtcataccagtgccccgtttctgagcaactatacgcgtaacggttggttccccaatggttttggtggcgtctttacaactatgctaacggtcaactttgccttttctggaactgagctaattggaattacagctggtgagactaaggatccggcccacaccattccgaccgcaatcaaaacgaccctctggcgcctgattattttcttcatcggtagcatgttcgtcatggccgcactgattccttacaaacaagcaggtgtgacgcaaagtccattcgtgctcgtcttcaaagcgattgggattccctacgccgctgatttaatgaatttcgtcgtattgaccgccattatgtcggccgctaattctggcctctacgcgtctacccgcatgctgtggtcacttgcgaacgagggaaccattccaaaggttttcaaacgaaccacgaagcgtgatgtgccgttagtcgccctaattactagcatgctgggtggcattctggccctattgtcgagtgtctatgccgccggttcggtgtacctggtcttagtatccatttcaggacttgccgtcgtcattgtttggatggcaattgccctttcggagatcaacttccgcaaagcctacctgaaaagtgggcagtcgcttgatcaattgacttttaaaacgcccggctacccggtcgtcccgtggctggcctttatcttaagtgggctctcttgtatcttgatttggtttgaccctaaccagcggattgccttgtattacaccattcccttcgtggcgatttgctatctaggctactatctcaatcaacgttatcgacggacccacgccgcaaagtaa

SEQ ID NO: 9308 - protein, 460 aa, Lactobacillus plantarum
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 9309 - DNA, 1452 bp, Lactobacillus plantarum
  CDS (1)..(1452)
atggcagaaaaacaacatcaggaagtgcatcgttccttacagacgcggcatttatccatgattgcattaggtggtagtatcgggaccgggctgtttgtcgcgtccggttcggcaatttcaacggctgggccagggggagcattactggcctacgttggtattggagtgatggtttactttttaatgactagtctgggcgaaatggcaacttatttgcccgtttcaggttcgttttccacgtatgccacgaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgttttgatttttacgatcaacgcgctgtcagtccggtcgtttggagaaactgagtactggctttcgctaattaaagtggtgaccgtgctcgtattcttggttatcggtgtcttgacgatcgtgggaatcatgggcggtcatgccactggcctcagtaactttacctataaaaaggcaccatttgtcggtggaattccaacgattttgagtgtcttcgtggtcgctggtttttcgtttcaaggaaccgaattaattgggatcacggccggggagtcagcaacaccggagaaaagtattccggcggctattaaacaagttttctggcgtattttgttattttacattttagccattttcgtgattgcggcgattattccttatacgtcgaaagatcttctagggtcatcagcgagcgatattgccatcagtccgttcacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtcgggtcaatcgtcgtgggattccaatcatggcattattaggaacgacggtgattggattactcacgttcttgtcgagtctattcggtgaacggatttatattttcctcgtttcggccagtgggttaacgggttttatcgcttggctaggaatcgctatttcgcatctgcgtttccgtcgcgcgtttgttaagcaggggcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgctatcatactaagatgattccgctagacaaggttgatttgacacgcaaacgacaccatcaagattaa

SEQ ID NO: 9310 - protein, 483 aa, Lactobacillus plantarum
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 9311 - DNA, 1365 bp, Lactobacillus plantarum
  CDS (1)..(1365)
atgcagagaaaattaagtacgggccagatgcaaatgattgcactgggcggcacgatcggagtgggcctatttatgggatccagctcaacgatcaagtggaccgggccgtcagtgctaattgcgtacatcgtatcaggggcctttctatacctgattatgcgggcactaggtgagatgctgtatgtcgatccgaataccggttcgtttgccaagtttgcttctgaatatattcaccccgtttttggatacttgacggcttggagcaacatttttcagttcgtcgttgttgggatgagtgaaatgattgcactaggcggctactgccggtattggtggccgaacttgccagattggattccgggcctaattgccattgtattcttatgtgcggccaaccttatctcggttaaaatgtttgggacactggaaacctggttctcacttattaaagtggtgacgattattctgatgattattgccggtttaggtctgattatttttggtattggtaacggcggtcatccaattggaatcagtaacctgtggacccatggtggtttcttcactggtggggtgaagggctttgtcttcgcactagcaattgtgttggcgtcgtatcaagggattgaattgattggagtcacagctggtgaagctgaaaatccacaaagcacgatcgttaaagcgattcgttcaacggttgcccggattttaatcttttacgtgggtgccatcttcgtaattgtcagcatttacccctgggataagttaagccagattggttcaccgtttgtacagacatttgccaaaattgggattaccgctgcggcttcgattatcaacttcgtggttattacggcttccttatcgggaacaaattctggaatttatagtgcgagtcgaatgacttacacgttggcggaaagtcaccagttaccaaggaagatgactttattaaatcgtcatggagtaccattttattccgttattgcgattgcgactgggattctaattggagtcgtcttgaatgttgtgttaccaatgtttttcaaggatgctagcgagattttcgtgatggtttacagttcgagtgtcttgcccggtatggtaccgtggtttgttattctagtgagtcaaattgcgttccgtaagcaaaacgcagccaagatggcgaaccatccttttaaaatgccattatcaccctattcaaattatttaacgttggccttcctcgcgttaacactggtcttcatgtttattaatccggaaacgcgctactcaattttagtcggtgttgtatttctggtcatcatgacattgatttatttccgtaaatacgccggtaacaaggaagaaacgttgtaa

SEQ ID NO: 9312 - protein, 454 aa, Lactobacillus plantarum
MQRKLSTGQMQMIALGGTIGVGLFMGSSSTIKWTGPSVLIAYIVSGAFLYLIMRALGEMLYVDPNTGSFAKFASEYIHPVFGYLTAWSNIFQFVVVGMSEMIALGGYCRYWWPNLPDWIPGLIAIVFLCAANLISVKMFGTLETWFSLIKVVTIILMIIAGLGLIIFGIGNGGHPIGISNLWTHGGFFTGGVKGFVFALAIVLASYQGIELIGVTAGEAENPQSTIVKAIRSTVARILIFYVGAIFVIVSIYPWDKLSQIGSPFVQTFAKIGITAAASIINFVVITASLSGTNSGIYSASRMTYTLAESHQLPRKMTLLNRHGVPFYSVIAIATGILIGVVLNVVLPMFFKDASEIFVMVYSSSVLPGMVPWFVILVSQIAFRKQNAAKMANHPFKMPLSPYSNYLTLAFLALTLVFMFINPETRYSILVGVVFLVIMTLIYFRKYAGNKEETL

SEQ ID NO: 9313 - DNA, 1380 bp, Staphylococcus epidermidis
  CDS (1)..(1380)
atggcagataaactgcaaagagaattaagcaatagacatatacaattaattgctattggcggggctattggaacaggtttatttcttggtgctggccaatctattcatttagcaggcccatctatcttactaacatacataatagtaggttttgttctctttatgttcatgagagctatgggagaattactgttatccaatttaggatttaaatcgtttggtgacattgctcatcatcatattggttctatggcaggttttatggtggggtggacatattggttaacatggattatttcaggaatggcagaagtgactgctgttgccaagtatgtttccttctggtatccaacaattccaaactggttaacagctgcagcgactattttagttttagttgctttaaatctattcagtgctaaattatttggagaattagaattttggctatctattattaaagttttgactattttagctttgatagccgttggtgttgttatgattgtatttggaatgaagacaagctatggccctgcaacggtaacgaatatatggaaagacggaggctttttccctaatggtgcacaaggtttcttcatgtcattccaaatggcaattttctcatttattggtattgagttgattggaataactgcaggggagactaaagatcctcacaaaacaattcctcaagcaattaataatgtaccgtttagaatattattattttatataggatcgttggcagttatcatgtctgttgtaccatggcaacaattgaatcctgctgacagtccatacgttaaaatgtttggattagttggaatcccttttgcagcaggtattattaactttgttgtacttacagctgcagcctcttcttgtaatagtggtatatttgctaatagccgtacgatgtttggattagctggaagaaagcaaggtccagcattcttacatagaaccaataagcacggcgtaccacattatgctattttagtgacatgtggcttattaagtatttcagtcgtgttaaatgcaatttttaaagatgcgactaaagtgttcgtacaaattacaacattttcaactgttttaaatattatgatttggacaattattatgatcgcgtatctaggttatttaagacatgaaccgaaacagcataaagaaagtaactataaaatgtggggcggaaaatacatggcttacagtattttagggttctttgcatttatttttattatactattgattaatagtgcaacgcgttatgccgtactttctgcacccgtatggtttgttatcatgctattgatgtatcaaaaatataaaaaagaatctcgcaaagctaaaattaaaaatgaggaagagtaa

SEQ ID NO: 9314 - protein, 459 aa, Staphylococcus epidermidis
MADKLQRELSNRHIQLIAIGGAIGTGLFLGAGQSIHLAGPSILLTYIIVGFVLFMFMRAMGELLLSNLGFKSFGDIAHHHIGSMAGFMVGWTYWLTWIISGMAEVTAVAKYVSFWYPTIPNWLTAAATILVLVALNLFSAKLFGELEFWLSIIKVLTILALIAVGVVMIVFGMKTSYGPATVTNIWKDGGFFPNGAQGFFMSFQMAIFSFIGIELIGITAGETKDPHKTIPQAINNVPFRILLFYIGSLAVIMSVVPWQQLNPADSPYVKMFGLVGIPFAAGIINFVVLTAAASSCNSGIFANSRTMFGLAGRKQGPAFLHRTNKHGVPHYAILVTCGLLSISVVLNAIFKDATKVFVQITTFSTVLNIMIWTIIMIAYLGYLRHEPKQHKESNYKMWGGKYMAYSILGFFAFIFIILLINSATRYAVLSAPVWFVIMLLMYQKYKKESRKAKIKNEEE

SEQ ID NO: 9315 - DNA, 1377 bp, Staphylococcus epidermidis
  CDS (1)..(1377)
atggcaaaacaactacaaagagagttgaataataggcatattcaattaattgctataggtggcgctataggaactggtttatttttaggttcaggacaaacaatttctctaaccggaccttcattactctttacttacatgttgataggtatagtgttatttgcttttatgagagctcttggtgaattattattaagtaactctaaatttaattcattcgtagatattgcaaatgaataccttggtccatttggtggatttgtaattgggtggacctattgggtttgttggattgtctctagcatgtcggacctcactgcgatgggacaatattttgcttattggtatccacaagtcccacactggttgacagtactatttattgtactcctacttatatcatttaatttgcttggcgccagattatttggagaacttgaattttggttttctataattaaagtcgttacaattattacgatggttattgtaggtttagttctgatttttttatcatttaaaacagaatatggacatgcttcttttggtaatttgatacatcatggcgggatgtttccacatggtgcagctggatttttaatgtccttccaaattgctgtatattcatttatcggtatagaacttataggagtcacagctggcgaaacaaaaaatccagaaaaaacaattcctaaagcaataaataacgttcctatacgaattttattattttatataggtggtttacttgtaatcatgtctgtcattccatggtttaaagttgatcctgatagtagtccgtttgttaaattattcacactaattggtgttccctttgctgctggcatagttaattttgttgttttaacagcagcagcatctgcaacaaatagcggaatatattctaatagtagaattttatttggtttagcgaaacaaggtttaggtcctaaagtattgacaaaaactaattctaatggtgtaccttatctctcaatgttagtatcttcaataacattgttaatcgcagctttattaaattttattttcccagatgctattaaattatttatttatgtaacgacactatctaccgtcctattccttgtagtgtggggaatgattatcgtttcttacatcgcatacgtaaagaagaatcctgaacaacatcaatcaagtgcatttaaattatggggcggaaaaattattgcctatattgtgttatcttttttcatatttatctttattttgctattctttagcaaagatactagagtagctatttttatttcaccattatggtttatcttcttgttcttttattataagaaatacaagaataatgctgaatctttagccgatagacagcgacattaa

SEQ ID NO: 9316 - protein, 458 aa, Staphylococcus epidermidis
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 9317 - DNA, 1377 bp, Staphylococcus epidermidis
  CDS (1)..(1377)
atggaaaataatgagttgcaaaggggattgaatgcacgtcagatgcagatgattgctcttggtggaacaattggtgttggtctttttatgggagcaacaagcacaattaagtggacaggtccatcagttattcttgcatatttaattgctggtatttttttatttttaatcatgagagccatgggtgaaatgatatatattaatccaaccactggttcttttgcgacgtttgctagtgactatattcatccagcagctggctacatgactgcttggagcaatgtatttcaatgggttgtcgtcggcatgagtgaagtgattgcagtaggagaatatatgaactactggttcccaagccttcctaattggataccaggagtgatagcagttctctttttgatggctgctaacctagtttcagtaaaagcgtttggagagtttgaattttggtttgccttaattaaagttgtaactattgtattaatgattattgcaggattaggattaattttatttggtataggcaatggagggaatccaatagggatttctaacttatggtcacatggtggatttatgccaaatggattcattggatttttctttgctttatctattgtgattggatcataccaaggtgttgaattgattggcatctcagcaggtgaaaccaaaaatcctcaaacaaatattgtaaaggcagtcaacggagtgatatggagaattttaattttctatattggtgcaatttttgtcattgtatcagtatatccttggaaccaattaggtagtattggtagtccttttgttgcaacgtttgctaaagtgggcattacgtttgctgctggtttaataaactttgtagtcttaacagcagcattgtctggttgtaattcaggtatttttagtgcaagtcgaatgatttatactttggcaaaaaaaggacaaatgcctaaagtatttactaaagtaatgaaaaatggcgtacctttctacactgtatttgcagtatctatgggaatattaattggtgctttattaaatgttatacttccattaattattgatggagctgatagtatctttgtatatgtatatagtgcctctattttaccgggaatgataccttggtttatgattttatttagtcatctaagatttagaaggttacatcctgaaaaggttcacaatcatccttttaaaatgccgggaggggcaattgccaattatttaactatcatgtttttactcctagtattagtcggtatgttacttaacaaagaaactgtagtatcggttgttattggtatcgtgtttttaacagctgtgacactttattatcttattagatatcacaaaaaggaacgacaaatatag

SEQ ID NO: 9318 - protein, 458 aa, Staphylococcus epidermidis
MENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLGLILFGIGNGGNPIGISNLWSHGGFMPNGFIGFFFALSIVIGSYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 9319 - DNA, 1359 bp, Staphylococcus epidermidis
  CDS (1)..(1359)
atggctgagaatttacaaagagaattgagcaatagacatgttcaattaattgccatcggaggtgctataggaactggtctgttcctaggtgccggacaaactatcgcaatgactggtccctcaatattacttacttatattattatagggttcatgttatttatgttcatgcgtggattgggagaaattattattcaaaatacgaatttcaaatcttttgctgacgtgaccaacacatatataggaccgttcgcaggatttgtaacgggttggacttactggctatgttggattattactggtatggctgaagtgactgcagttgccaaatatataagtttttggttcccagacatacctaattggattagtgctttattctgtgtacttattctaatgtctttcaatttattaagtgcaaagttgtttggtgagcttgaattctggttcgcaatcattaaaatagttacaatcattgctttaatcgttataggtgtaatcatgattttattcgcattcaagacaccatttggtaacacaagtttaactcatttgtatcaacatggaatttttccaaaaggagcttctggattctttatgtcattccaaatggcattgttctcatttgttggtattgaaatgattggtgttactgcaggagagacaaaagatccagaaaaaactatacctaaagctatcaatagtgtacctattagaattttaatcttttatgttggtgcattagcagtcatcatgtccattattccatgggataaagtagatccagataatagtccattcgttagattgtttgcattaattggtataccgtttgcagcaggaataattaatttcgttgttttaacagctgctgcctcttcatgtaacagcggtattttctcaaacagcagaatgctttatggactttcaaaccaaaatcaagcaccaccaacatttgctagtactaataaacatggtgtgccacataaagcaatcattgcatcatcagctttattgttaattgcagcactactgaattacatattccctgatgcaacacttgtatttacttatgttactacgatttctacagtattatttgttgtggtttgggcattaattattattgcttatattaactatagtcgtaaaaatccagaacttcataagaaagcgacatataaactaccaggcggtcaatacatgggataccttatacttattttctttgtttttgtatttgccttgttatttataaatgttgatacaagaagagcgatttactgcacgcctatttggtttattttattaggtttaatgtacttaagatacaaaaaagctgataaagaatcacgataa

SEQ ID NO: 9320 - protein, 452 aa, Staphylococcus epidermidis
MAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTAGETKDPEKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 9321 - DNA, 1503 bp, Staphylococcus epidermidis
  CDS (1)..(1503)
atgaaaaagaataataaacaaaatgacggtgttcaaagaggattaaaagatagacatatttcaatgattgccattgggggatgtataggaactggtctattcatgacttctggtggagctatacatgacgcaggtgcattgggtgctttgattgcctatgcagttattggagcgatggtgttctttctaatgacgtcgttaggggagatggcgacatatttgcctgtgtcaggttcatttagtacttatgctacacgctttgtcgatccttcactaggttttgctttaggatggaattattggttcaactgggtgataacagtagcagctgatgttactattgcagcgcaagttatacaatattggtcccctatgcaaggtataccagcttgggtctggagttgtattttccttattattattttcgcgcttaattctttatccgttagagtatatggagagagtgaatattggttcgcacttatcaaagtagttacagtcatcatatttataggaattggtatcttaactattttagggattatgggtggagaatttgtaggatttgatacgtttacaaaaggagatgggccaatactaggtgggaatttaggaggtagcttgctatcaattcttggtgtatttctagtcgcaggcttctcattccaaggaactgaacttattggtattacagcaggtgaatctgaaaatccagaaagagcagttccaaaagcgattaaacaagtattttggcgtatacttttattttacattctagctattttcattattggtatgttgattccatatgatagtaaggcattaatgggcggtggtgatagtatagctacttcaccttttacattagtatttaagaatgctggattagcttttgctgcttcatttatgaatgctgttatattaacaagtgtattatcagcaggtaactcaggaatgtatgcttcaacaagaatgttatattcgatgagtaaagataaattagcttataattcttttggaaaaacaaataaaagtggcgtaccttatgtatctctaattgcaactggagtactagtcattcttattttcgcattgcaacatttaagtggagatgcatatgaatacattgtagctgctagcggaatgactggttttattgcttgggttggtatagcaatcagtcactttagatttagacgcgcatttgataaacaaaattatgataaatcaaaattaaaatataaagcgaagttattcccatttggtccgatttttgcaggtattttatgtgtaatagttatcattggacaagatgtagattttattaaaacaggtaactttgatatgaatagattttttataacttacatgggaatacctgtattcttaattttcttcttttatcataaatttagatataaaactaaaaagattcctctaaacaaagttgacttaaggcaagatgtttcgatggaagaagtaagacaccataaaaataattaa

SEQ ID NO: 9322 - protein, 500 aa, Staphylococcus epidermidis
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 9323 - DNA, 1449 bp, Staphylococcus epidermidis
  CDS (1)..(1449)
atggaagataataatatgaaacgtggtctcaattcgagacatatatctatgatagctataggtggcgctataggtactggactttttgtggcaactggaagtgtcatttctcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttaactctgttgtttttaattaatattttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgataaaatagggatcgcttttgctgcatccgtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcctttggtagtatcgcatctggtgatattttaggtgtcattcgaaactttacaccattatttattctagctatcatctatattgctcataaattaatcaaacggacacattttgtcaaactggaagaaatagatttaactccgcataattacaagaattaa

SEQ ID NO: 9324 - protein, 482 aa, Staphylococcus epidermidis
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 9325 - DNA, 1419 bp, Yersinia pestis
  CDS (1)..(1419)
atgcgagaatgtaccatgaagaatgattcatccacgctcaagcgcggccttagtgcacggcatatccggtttatggcattaggttctgccattggtactggcctattttatggttcggctgaggcaatccgtctggcggggcctgcagtgttattagcttatttgattggcggtgcggcagtctttatggtgatgcgagccttgggcgaaatggccgtacatgaccccgtggccggctcttttggtcactatgccagccgttatctggggccattggcggggttcctgacgggctggacctatacctttgaaatggttgttgtggcactggctgatgttaccgcttttggtatttatatggggctgtggtttcctgatgcgccccaatgggtatgggtgctaagtatcattttctttatcggtgcgctgaatctatgttcagtgaaagtctttggtgaaatggagttctggctctcgttgctaaaagtggctgccattatcgccatgattgccgcaggtttgggcattatgatgtttggtttcggggcggggcatgacagcacaggcgtcagtaatttatgggctcatcaagggtttatgccaaatgggatcacgggggtgattgcatcatttgctgtagtgatgtttgcttttgggggaattgaaattattggggtgacggccagtgaagcgaaggatccgggaaaggtattaccacgagccatcaatacagtgccaatacgtattctattgttctatgttttgaccctgtttgtcctgatggctatctatccgtggaatagtattgggcaaaatggcagcccctttgtggagatttttagtagtttaggcataaactctgccgctaatattcttaatttggtggtaataaccgctgcaatttcagcgattaacagtgatatttacggtgctggccgtatgatgtacggcctcgcgcaggaaggattggcccctaagagcttcagtcgattgacacgtaatggcgtgccctatatgactatcttggtgatggcgattacgctgctgtgcggtgtggtattgaattaccttatcccgaaaaacgtgttcttggttattgcatcgatcgccacttttgcaaccgtctgggtgtggctaatgattctggtatcacaagtggctatgcgccgctcaatgagcaaagcacaagtcgctcggctggcattccccgtgccattttggccgctagcgcctatccttaccattctctttatggcctttattattgctgtgttaggttacttccctgcgactcgtattgcgatgtatgtcggcctggcgtgggtggcattaatgacactggcgtggtggatttggttacgtaaagccccttcatgcgttattcaagagcgggcgaaaagcagtgagatgccatcgtaa

SEQ ID NO: 9326 - protein, 472 aa, Yersinia pestis
MRECTMKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 9327 - DNA, 1512 bp, Yersinia pestis
  CDS (1)..(1512)
atgtttgtacctcaaccatcaaacaagcctttatccttgatgctggcgggtttaagtgttaaaaaaaccgccgcagactcatttatgaaatgcgttgtttattcacaccagtgcgtaatcagtgcaacagagggtaggatggaacagcagttacagaactcatcgttaaaacgcggtttaaaaaatagacatattcaactaatagctttgggtggcgcaatcggaaccgggttatttctcgggattgcccaaaccatcaatatggccggcccctcagtaatattggggtatgcaataggcgggtttattgcttttctgattatgcgtcaattaggtgaaatggtcgtcgaagagcctgttgctggctcattcagccactttgcctataagtattggggcgattttgctggttttctatcgggctggaactactgggccatgtttattctggtcggtatggctgaattgactgcggtaggcatatatattcagtattggtggcctgagataccgacatgggtttcagcagcagtattctttatcataatcaacgctatcaacttagttaacgtacgtctgtatggcgaaacggagttttggtttgccatcattaaagtggctgcaattatcggtatgattgtgttcggtgcttatctactggcatcgggatctggtgggccagccgcctcggtgacaaatctctgggcgcaggggggttttatgccccatggctttcgtggtttgatcatggcaatggcggttattatgttctcttttggcggtctggagatggtagggattactgcagcagaagccgaagatccacggaacagtattcctaaagcgactaatcaggtcgtttatcgcattcttattttttatattggctcactgacggtgcttctgtctcttttcccgtggaacaatgtcgtcgaagggggaagtcctttcgtgatgattttcgatgcgttagatagcccttgggtggcaacagcattgaatgtggttgtcctgaccgccgccctgtcggtgtataacagtggtgtgtattgtaacagtcgtatgctttttgggctggcatcacaggggaatgcgcctaagttgttgaccaagttaaataagcgtggtgtccccatccgttcaattgcactttcagcattagcgacttcagctggcgtggtgattaactatattatgcccggcaaagcctttgaattacttatggcgttggtggtttcaacactggtaatcaactgggtgatgatttgcctggcgcatctgaagtttcgcaaggctaaagttaaagagggcgttgtgcctcgcttcaaagcactctggtacccctacggcaattatctgtgcctggtcttcctcgcattaattctcgtcattatgtatctcaccgaagggattcggatctctgtgttgatgatgccagtatggatagcgttactttggtgtggttttgtacttactcggcgtaagtgtccaaaaacggtgactagcctctaa

SEQ ID NO: 9328 - protein, 503 aa, Yersinia pestis
MFVPQPSNKPLSLMLAGLSVKKTAADSFMKCVVYSHQCVISATEGRMEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 9329 - DNA, 1530 bp, Yersinia pestis
  CDS (1)..(1530)
atgatgtcaggaaaacactctgcggagacccatcacgccgcgaaaaaacgctggttagattctcatgatacgggttaccacaaaagtatgggcctacgtcatatacaaatgatagccattggcggatccatcggaacaggactgtttttaggtacaggtgcccgcttacaaatggctgggccagcattagcactggtttatctggtttgtggaattttttcatttttcattctccgggccttgggggaactggtcttacatcgccctaccagcggcagctttgtttcttacgcccgtgaatttctcggagaaaaagcatcctatgtcgcgggctggatgtacttccttaactgggcgatgacaggcatcgtcgatatcaccgcagtggcgctttatatgcattattgggggacattttctgatgttccgcaatggctgtttgccctaggcgcactctcgattgtcgctaccatgaatatgattggagtaagatggttcgccgaaatggagttttggtttgcactgattaaagtcgccgctattgccctgtttttgattgtcggtgtgatcttcctcggtacgggtcaaagcgtcgcgggtcatacaactggtattcatttgattaccgacaacggcggtttctttcctcacggcctcttacctgccctgataatggtacaaggcgttatattcgccttcgccggtattgaattaattggcactgcggctggtgaatgtaaagaccccgaaaaaatgctgcccaaagccattaatagcgtgatatggcgtataggtttgttttacgttggctccgtcgtcctactggtctgcttgctaccctggcatgcttatcaagcgggtcaaagcccattcgtgacattcttcagtaacttgggggtcccttacattggcactattatgaatatagtggtgctatccgccgcactctccagtttgaactccgggctttactcgaccgggcgaatcctccgttcactgtcaatggggggatcggcacctaaatttatgtccaagatgagcccgcaatccgtgccctatgcagggattttggtcactgtgggcatttatgtcttgggggtactactcaactacctcgttccctctcaagtttttgaaattgtcctgaatatagcctccttggggatcattagttcatgggcatttattatcatttgtcagatgaaattacgtcaggcaataaaaagaggaatggcaaaacctgtctccttcaaaatgcccggtgcgccagtgacatcttggctgacattgatctttttggcgggcgttttggtgatgatggcctttgactatccaaatggcacctggaccatcgctagcatacccgtgctcacactgctactgatcgccgggtggttcagtctgcgtaaacgcgccaatgaggtagcggccgcaccgatagatgtctggtcacaagaaatattgttcgaagaacctgatgctcaaaatgtatcgcctaaagagttatatgagcaaaaatcagtaggttaa

SEQ ID NO: 9330 - protein, 509 aa, Yersinia pestis
MMSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 9331 - DNA, 1401 bp, Yersinia pestis
  CDS (1)..(1401)
atgatgagtgatcaacaagagggtgctgagctaaaacgggggcttaaaaaccgccatattcagcttattgccctaggtggtgcaattggtaccggactattcctcggcatagcacagaccatcaaaatggctgggccttcggttttactggggtacgcaattgggggttttattgcgtttctgataatgcgccagctaggcgaaatggtggttgaagaacctgtagccggttcctttagccactttgcgtataaatattggggacactttgccggttttgcttctggctggaactactgggtgctgtatgtgttggtggcgatggccgaactaaccgcagtggggatctatgtgcaatattggtggccagaaatccctacctgggtctccgccgccgtcttcttcttggccatcaacgccatcaacctggctaacgtaaaagtctatggtgagatggaattttggtttgccatcattaaagtgatcgcgattattgcgatgattttatttggcggttacctgctcatcagtggccggggtggcccagaagccacggtaaccaacttatgggcccaaggcggtttcttcccgaatggcatcatgggtctggtgatggcaatggcggtaattatgttctctttcggtggccttgaattagtgggtatcaccgcagcagaagcagaagacccggccaaaagcattccgaaggcaaccaatcaggttatctaccgtattcttctgttttatattggttctctggcaatcttgttatcactctacccatggggaaaagtggtcgaaggcggcagcccattcgtattgattttcgatgcgctggacagtaattcagtcgccactgtcttgaatattgtcgtactgacggcggcactctcggtctacaacagttgcgtatactgtaacagccgcatgttgtttggtttagctaaacaaggtaatggcccgaaaatcctgttgaaagtggatggccgaggtgttccagtcattgcgattgctgtttctgcgtttgctaccgcgttttgtgtactgattaactacctgttacctggccgtgcctttgaattactgatggcattagtggtatccgcgttggtgatcaactgggcgatgattagcctggcacacctgaaattccgtgcggcgaaaaaccgccagggcgtaataccaaaattcaaagcattttggtatccgttcggtaactgtttgtgtttgttgttcctgaccggcatcttagtgatcatgtttctgacacccagcatccggatttcagtgatacttattcctgtctgggtagtcgtcctagcgattggttatattctgaagaatcagagccaacgtcagaatcagcaactgagcgctagcagcaggaaagtaaccaagtaa

SEQ ID NO: 9332 - protein, 466 aa, Yersinia pestis
MMSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 9333 - DNA, 1398 bp, Streptococcus mutans
  CDS (1)..(1398)
atgtcacatcaaaatgcaaaaaatacaacacagaatccgaaagagcttgagaatggcatggttcgtggcttacaaaatcgccatgtgcaattgattgccattgccggaaccatcggaacagggctttttttaggagcagggcgttccatttcattaacaggcccttccatcatcatcgtttatctcttaacaggacttttcatgttttggatgatgcgtgcgatgggtgaaatgctttaccatgatcctgatcagcatacttttatcaattttattaccaaatacattggtaaagaatggggttatttcgcaggttggtcctattgggtatctgtcattttcttaggaatggcggaaatcacagctatcgccaaatatgttcagtactggtttccatcttggcctgcttggataattcagattgtttttcttttaatattaggatctgttaatttaattgctgttcgtgtttttggcgaagcagaattctggtttgccatgattaaaatcattgccatcttagcattgattgcaacagctatcttcatgttactgactggttttaaaacgagtcagggaccagttagttttgccaatatttctaagggatttgaaatgtttcccaatggttggatgaaatttctcatgtctttccaaatggtcttctttgcttatcaggctattgaatttgttgggattaccgtatccgagacacaaaatccaagaaaggttttaccaaaagctatccaagaaattccaatgcgaattgtgattttttatgtcggtgccttaattgctattatgaccattttcccatggagagcattgccatcagatacatcaccatttgtcatggtcttcaaactggcgggtatcaaatgggcggctgccttaatcaactttgttgtgctaacttccgcagcgtctgctctaaactcgacactctattcaactggtcgtcacctttatcaattagctaatgaagcacctaatcaatttatgaaacgcttcaaaatcggaacactttcaaaaactggtgtcccaagtaaagccattattttctcagctattgttattgctatttcagcttttatcaatgtactgcctggaataaaagacgcttttgctttgattactgcgtcttcttctggtgtttacattgccatttatgttttgaccatgctggctcacctgaaatatcgtaaatcaaacgattttatggcagatggctatttaatgcctcattacaaaattttaaatcctatcacaattatttttatggtctttgtttttataactttgtttttacaggactcaacctatatcggagccattggagcaactatttggattgctgcctttggtttctacagtaagtttaaatttaaaaaacaatag

SEQ ID NO: 9334 - protein, 465 aa, Streptococcus mutans
MSHQNAKNTTQNPKELENGMVRGLQNRHVQLIAIAGTIGTGLFLGAGRSISLTGPSIIIVYLLTGLFMFWMMRAMGEMLYHDPDQHTFINFITKYIGKEWGYFAGWSYWVSVIFLGMAEITAIAKYVQYWFPSWPAWIIQIVFLLILGSVNLIAVRVFGEAEFWFAMIKIIAILALIATAIFMLLTGFKTSQGPVSFANISKGFEMFPNGWMKFLMSFQMVFFAYQAIEFVGITVSETQNPRKVLPKAIQEIPMRIVIFYVGALIAIMTIFPWRALPSDTSPFVMVFKLAGIKWAAALINFVVLTSAASALNSTLYSTGRHLYQLANEAPNQFMKRFKIGTLSKTGVPSKAIIFSAIVIAISAFINVLPGIKDAFALITASSSGVYIAIYVLTMLAHLKYRKSNDFMADGYLMPHYKILNPITIIFMVFVFITLFLQDSTYIGAIGATIWIAAFGFYSKFKFKKQ

SEQ ID NO: 9335 - DNA, 1377 bp, Streptococcus mutans
  CDS (1)..(1377)
atggaaaaccacaattttgaaaatgaaggtcagtttaagcgaaaaatgaccagtcgtcatctctttatgttgtccttaggcggtgttattggaacagggcttttcttaagttcaggttatacaattgctcaagctggtcccttaggagcggtaatttcttatttagttggtgctattgttgtttaccttgtgatgctttctttgggtgaattagcagtagctatgcctgttacaggttcttttcatacctatgctaccaaattcatcagtcctggaactggttttaccattgcttggctttattggatttgttggacggttgctttagggacagagtttcttggtgcaggtatgttgatgggacggtgggttccttatgttcccacttgggtctttgcagcactttttgccttgcttatttttggtctcaatgctctcagtgttcgttcttttgctgaagcagaatccttcttttctagtataaaggttttagctattcttgtttttattattcttggttttggagccatgcttggtttggtttcttttaatggtaagcacgaagtatttctttttagtcatttgacagctcatggagctctgccaaagggacttccagcattaatgtcagtcatgctggcagttaattatgccttttctggaacagagctcatcgggattgcagcgggagaaacgaacaatcctaaagaagctgttcccaaggctattaaaacaacaattggtcgtttagtgattttctttgtattgacaattgttgtcttagcatcgtttttaccaatgaaagaagcaggtgtatccagtgctccttttgttgatgtttttgataagatgggcattccttttgctgctgatatcatgaatttcgttattttgacagctattttgtctgctggtaattcaggactttatgcttccagccgcatgctttggtctttggccaacgaaggtatgattagtccgagggttgttaaaatcaatgaacacggtgttcctatgagagctttgctcctatcgatggcaggtgctgttttatccttgttttcaagtatctatgcggcagataccgtttatttggctctgatgtcaatcgctggctttgctgttgttgtagtctggttgtccattcctatggcacaaattaattttcgtaaggaatggctgaaaagtcatgcccaagaagacttgttttataaaacgccttttactccaattctgccttacattacgattatgctattgttgatttcgattattggtattgcttgggatgcatcacaaagagcgggtctttatttcggtataccttttattctactttgttatctttattattattggcggcataagacattgtag

SEQ ID NO: 9336 - protein, 458 aa, Streptococcus mutans
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 9337 - DNA, 1389 bp, Streptococcus agalactiae
  CDS (1)..(1389)
atgtcaaaaaataataatgaccacactcaaaaatctgagaatggtatggtacgcggcctagaaaatcgtcacgtacagttaattgcgattgcagggacaatcggaactgggctttttcttggtgcaggtcgttcaattagcctgacgggtccttcaatagttcttgtctatgctatcactggcgctttcatgttcttcatgatgcgtgctattggagagatgctttatcaagatccaaatcagcatacttttattaatttcattaccaaatatttaggacccggttggggatttttctcaacactttcttattggatttccctaatatttatcggtatggcagagattacagccgtaggagagtatgttcaattttggttccctgaatggccatcctggattatccaaattgtttttttagctatcctaagttctatcaacttaattgctgtaaaagcattcggagaaaccgagttttggtttgctatgataaaagttattgcaattcttggtttaatagcaaccggtatctttatggtattgacaaactttgacaccggtcacggataccatgcttcaatctcaaatatcaccaatcattttgaatggttccctaaaggtaaattgaatttcttcatggctttccaaatggtattctttgcttatttagctattgaatttgtcggagtaacaacttctgaaacagctaatccacgtaaagttttaccaaaagcaatccaagaaattccgatgcgtattattttattctacgcaggttcattattagcaattatggccatcttcccatggcaacagttaccagttaatgagtcacctttcgttacagtattcaaactagctgggattaagtgggctgccgctttgattaactttgttgtcctaacgtctgcagcatctgctcttaattctactttgtactcaacagggcgtcatttattccaattggctaatgaatcaccaaatgctcttacaaaagcgttaaaattagaccaattatctcgtcaaagcgttccaagtcgagctattattgcatcagctgtaatcgttggagcttcagcacttatcagtgttttacctggtatttcagatgccttctccttaattactgcatcatcttctggtgtttacatttctatctatgttcttattatgattgcacattggaaatatcgtaaatcacctgattttatggaagatggttataaaatgcctgcctacaaaatcctttcaccaatcacacttctcttcttcctctttgtattcgtttctctcttcttgcaagattcaacatacatcggggctattggagcaaccatctggattattggatttggtttatatagtcacttcaaacataaatcacattaa

SEQ ID NO: 9338 - protein, 462 aa, Streptococcus agalactiae
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNALTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 9339 - DNA, 1377 bp, Streptococcus agalactiae
  CDS (1)..(1377)
atggaaaatcatcgttatgaagatgaaggtaaattccagcgtaagatgaccagtcgtcatctctttatgttatctctaggtggtgttatcgggactgggcttttcttgagttcaggttataccattgcacaggctggtccgcttggagctgtgctgtcttatttgattggtgccgttgtggtttatttggtcatgctatcacttggtgaattggcagttgccatgccggtgacggggtcattccacacttatgccactaagtttatcagtcctggcacaggttttactgttgcctggctatattggatttgttggacggtcgccttgggaactgaatttttaggtgctgccatgctcatgcagcgctggttcccagatgtgccggcttgggcatttgcttctttctttgcccttgtgatttttggcttaaatgctctcagtgtgcgcttttttgcagaagcagagtctttcttctcaagtattaaggttattgctatcattatctttattatcttgggcttaggtgctatgtttggtctagtttcctttgaaggtcagcacaaagctattcttttcactcatctgactgccaatggtgactttccaaatggtatcgttgcagttgtctcagtcatgttggctgttaactatgccttctctggtactgagttgattggtattgcggcaggtgaaacggataatccaaaagaagctgtgccaagggctattaaaacgacaatcggtcgcttggttgttttctttgtactgacaattgttgtcctagcttcgctattgccaatgaaagaggcaggcgtatccacagcaccattcgttgatgtctttgacaagatgggagtcccttttgcggcggatatcatgaactttgttatcttgacagccatcctgtctgctggtaactcaggtctctacgcatcaagccgtatgctctggtcccttgccaatgaaggtatgttgtcaaaatctgtcgtgaaaatcaataaatacggtgtcccaatgcgtgctcttctcttgtcaatggcaggagcagtgctgtcgctcttttcaagtatttacgctgcagacacagtttatctagccttggtttcaatcccgggctttgctgttgttgtcgtatggctagccattccggtcgcacaaatcaatttccgcaaggaattcttgaaagagaatcgactagaagatttgtcttacaaaacaccctttacaccagttctcccttatatcacaatcgttttgcttttgatttcgattgtggggattgcttgggatagctcacaacgtgctgggctttacttcggtgttccatttattattttatgttatatttatcacaaactacgttacaagacatggtga

SEQ ID NO: 9340 - protein, 458 aa, Streptococcus agalactiae
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 9341 - DNA, 1413 bp, Escherichia coli O6
  CDS (1)..(1413)
atggtagatcaggtaaaagtcgttgccgatgatcaggctccggctgaacagtcgctacggcgcaatctcacaaaccgacatattcagcttattgccattggcggtgccattggtacagggctgtttatggggtccggcaaaacgattagccttgccgggccgtcgatcattttcgtttatatgatcatcggttttatgctctttttcgtgatgcgggcaatgggggaattgctgctttcgaatctggaatacaaatcttttagtgacttcgcttccgatttactcgggccgtgggcaggatatttcaccggctggacttactggttctgctgggttgtaaccggtatggcagacgtggttgccattaccgcctatgcgcaattctggttccctgggctttctgactgggttgcttcgttatccgtgatcattctgttactggttctaaacctcgccacggtaaaaatgttcggtgagatggagttctggtttgcgatgatcaaaatcgtcgccatcgtgtcgctgattgttgtcggcctggtcatggtggcgatgcactttcagtcaccgaccggtgtggaagcatcatttgcacatttgtggaatgacggcggctggttcccgaaaggcttaagcggcttctttgccggattccagatagcggttttcgctttcgtggggattgagctggtaggtacaacagctgcggaaaccaaagatccggagaaatcactgccacgcgcgattaactccattccgatccgtatcattatgttctacgtcttctcgctgattgtgattatgtccgtgacgccgtggagttcggtagtcccggagaaaagcccgttcgttgaactgtttgtgttggtaggtttgcctgcggctgccagcgtgatcaactttgtggtgctgacctctgcggcgtcttccgctaacagcggtgtcttctctaccagccgtatgctgtttggcctggcccaggaaggtgtggcaccgaaagcgttcgctaaactctctaagcgcgcagtacccgcgaaagggctgaccttctcttgtatctgtctgctcggcggcgtggtgatgttgtatgtgaatcccagcgtgattggcgcgttcacgatgattacaaccgtttccgcgattctgtttatgtttgtctggacgattatcctttgctcgtacctggtgtatcgcaaacagcgtcctcatctgcatgagaagtcgatctacaagatgccactcggcaagctgatgtgctgggtatgtatggcgttctttgtgtttgttctggtgttgttgacactggaagatgacacccgccaggcgctgctggttaccccgctgtggtttatcgcgctggggctgggctggctgtttattggtaagaaacgggctgctgaactgcggaaataa

SEQ ID NO: 9342 - protein, 470 aa, Escherichia coli O6
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLSVIILLLVLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFSLIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVLVLLTLEDDTRQALLVTPLWFIALGLGWLFIGKKRAAELRK

SEQ ID NO: 9343 - DNA, 1386 bp, Escherichia coli O6
  CDS (1)..(1386)
atggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttacgcgcatcgttatatgagcccattctttggttatctcaccgcctggtcttactggtttatgtggatggcggtggggatctcagaaatcaccgccattggcgtttatgtccagttctggttcccggagatggcgcagtggatacccgcattgatcgcggtggcgctggtggcgttggcgaatctggctgcggtgaggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgctggtggctggaaagggttcctgaccgcattgtgtattgtggtggcgtcctaccagggcgtggagctgattggcattactgccggtgaagcgaagaatccgcaggtgacgctgcgcagtgccgtaggcaaggtgctgtggcgaatcctgattttctacgttggcgcgattttcgttatcgttactatcttcccgtggaatgaaataggcagcaacggtagcccgttcgtactgactttcgccaaaatcggcattaccgcagcggcgggcattatcaactttgtggtgctgacggctgcgctctctggctgtaacagcggcatgtacagttgcggacgtatgctctatgcactggcgaaaaaccgtcagttaccggcggcaatggcgaaagtttcccgtcacggcgtaccggttgcgggtgtggcagtatctattgctattctgctaattggctcatgcctgaactacatcattcccaatccgcagcgtgtgtttgtttacgtctacagtgccagcgtgcttccggggatggtgccatggtttgtgatattgataagccagctgcgttttcgtcgtgcgcataaagcagcaattgccagccatccgttccgctcaatcctgttcccttgggccaactacgtaacaatggcattcctgatttgcgttttgatcggcatgtactttaatgaagatacgcgtatgtcgctgtttgtcggcatcatctttatgctggtggtgacggcgatttataaagtttttgggcttaatcgccacggtaaagcgcataaactggaggaataa

SEQ ID NO: 9344 - protein, 461 aa, Escherichia coli O6
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLVVTAIYKVFGLNRHGKAHKLEE

SEQ ID NO: 9345 - DNA, 1470 bp, Escherichia coli O6
  CDS (1)..(1470)
atgggttccgaaactaaaactacagaagcgccgggcttacgccgtgaattaaaggcgcgtcacctgacgatgattgccattggcggttccatcggtacaggtctttttgttgcctctggcgcaacgatttctcaggcaggtccgggcggggcattgctctcgtatatgctgattggcctgatggtttacttcctgatgaccagtctcggtgaattggctgcatatatgccggtttccggttcgtttgccacttacggtcagaactatgttgaagaaggctttggcttcgcgctgggctggaactactggtacaactgggcggtgactattgccgttgacctggttgcagcacagctggtcatgagctggtggttcccggatacaccgggctggatctggagtgcgttgttcctcggcgttatcttcctgttgaactacatctctgttcgcggctttggtgaagcggaatactggttctcactgatcaaagtcacgacagttattgtctttatcatcgttggtgtgctgatgattatcggtatcttcaaaggcgcgcagcctgcgggctggagcaactggacaatcggcgaagcgccgtttgctggtggttttgcggcgatgatcggcgtagctatgattgtcggcttctctttccagggaaccgagctgatcggtattgctgcaggcgagtccgaagatccggcgaaaaacattccacgcgcggtacgtcaggtattctggcgaatcctgttgttctatgtgttcgcgatcctgattatcagcctgattattccgtataccgatccgagcctgctgcgtaacgatgttaaagacatcagcgtcagtccgttcaccctggtgttccagcacgcgggtctgctctctgcggcggcggtgatgaacgcagttattctgacggcggtgctgtcagcaggtaactccggtatgtatgcgtctactcgtatgctgtacaccctggcgtgtgacggtaaagcgccgcgcattttcgctaaattgtcgcgtggtggcgtgccgcgtaatgcgctgtatgcgacgacggtgattgccggtttgtgcttcctgacctccatgtttggcaaccagacggtatacctgtggctgctgaacacctccgggatgacgggttttatcgcctggctggggattgccattagccactatcgcttccgtcgcggttacgtattgcagggacacgacattaacgatctgccgtaccgttcaggtttcttcccactggggccgatcttcgcattcattctgtgtctgattatcactttgggccagaactacgaagcgttcctgaaagataccattgactggggcggcgtagcggcaacgtatattggtatcccgctgttcctgattatttggttcggctacaagctgattaaaggaactcacttcgtacgctacagcgaaatgaagttcccgcagaacgataagaaataa

SEQ ID NO: 9346 - protein, 489 aa, Escherichia coli O6
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 9347 - DNA, 1551 bp, Escherichia coli O6
  CDS (1)..(1551)
atgttcatggcaacttatatgactttttcattaaagcaatcagggagagcaatgagtaaacacgacaccgacacttcagatcagcacgccgcgaaacgccgctggcttaatgcccacgaagaggggtatcacaaagcgatgggcaatcgccaggtacagatgatcgccattggcggcgcgattggtacgggtttgtttttaggcgcgggggcgcgactgcaaatggcggggcccgcactggcactggtctatttgatctgcggcctgttttcgttttttattctgcgtgcattgggtgagctggtgttacaccgcccttccagtggcagttttgtctcttatgcccgtgagtttttgggtgagaaggccgcttatgttgctggctggatgtacttcatcaactgggcgatgacggggattgttgatattaccgccgtcgctctgtatatgcattactggggcgcgtttggcggcgtgccgcagtgggtctttgcgctcgctgcactgaccatcgttggcaccatgaatatgatcggtgtgaaatggtttgcggagatggagttctggtttgcgcttattaaagtgctcgccattgtaacctttttggtcgtgggtacagtgttcctcggtagtggtcagccgctggatggcaacaccactggctttcatttaatcaccgataatggcggctttttcccccatggtttgctgcctgcgctggtgttgattcagggcgtagtgtttgcttttgcctccattgaaatggtgggtacagcggccggagaatgtaaagatccgcagaccatggtgcctaaagcgattaacagtgtgatttggcgtattggtctgttttacgtcggctccgtggtgttgctggttatgttattgccgtggagcgcgtatcaggcggggcaaagtccatttgtgacgtttttatctaaactgggtgtgccgtacatcggcagcattatgaacattgtggtgctgaccgctgccctctccagcctgaattcaggtctgtactgcaccgggcgtattctgcgctcgatggcgatgggcggttccgcaccgagttttatggcgaaaatgagtcgtcagcatgtgccgtatgccgggattctggcgacactggttgtgtatgtcgtcggcgtattcctcaactatctggtgccgtcacgcgtatttgagattgtgttgaacttcgcgtcgctgggaatcatcgcttcatgggcgtttatcatcgtttgccagatgcgcctgcgtaaagcaattaaagaaggcaaagcagcggatgtcagttttaaactgcctggcgcgcccttcacttcctggctgacattactgtttttactgagtgtcctggtgctgatggcgttcgattacccgaacgggacttataccatcgcggcgctgccgattatcggtattctgctggttataggttggtttggtgtgcgcaaacgcgttgctgaaattcacagcactgcgccagtcgtcgaggaagatgaagaaaaacaggaaattgtgtttaagcctgaaacatcgagttaa

SEQ ID NO: 9348 - protein, 516 aa, Escherichia coli O6
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFLSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETSS

SEQ ID NO: 9349 - DNA, 1419 bp, Escherichia coli O6
  CDS (1)..(1419)
atgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgctgggtggcgcaattggtactggtctgtttcttggcattggcccggcgattcagatggcgggtccggctgtattgctgggctacggcgtcgccgggatcatcgctttcctgattatgcgccagctcggcgagatggtggtcgaagagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgctgattaaagtgctggcgatcatcggtatgatcggctttggcctgtggctgctgttttctgggcacggcggtgagaaagccagtatcaataacctctggcgctacggcggtttctttgccaccggctggaatggattgattttgtcgctggcggtaattatgttctccttcggcggtctggagctgattgggattactgcggctgaagcgcgcgatccggaaaaaagcatccctaaagcagtgaatcaggtggtgtatcgcatcctgctgttttatatcggttcactggtggttttactggcgctctacccgtgggtggaagtgaaatccaacagtagcccgtttgtgatgattttccataatctcgacagcaacgtggtagcttctgcgctgaacttcgtcattctggtggcatcgctgtcggtgtataacagcggggtttactctaacagccgcatgctgtttggcctttctgtgcagggtaatgcgccaaagtttttgactcgcgtcagccgtcgcggcgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgcctggcgcatctgcgttttcgtgcagcgatgcgtcgtcaggggcgtgaaacacagtttaaggcgctgctctatccgttcggcaactatctttgcatcgccttcctcggcatgattttgctgctgatgtgcacgatggatgatatgcgcttgtcagcgattctgctgccggtgtggattgtgttcctgtttgtggcgtttaaaacattgcgtaggaaagtgaattaa

SEQ ID NO: 9350 - protein, 472 aa, Escherichia coli O6
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASINNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRKVN

SEQ ID NO: 9351 - DNA, 1398 bp, Corynebacterium efficiens
  CDS (1)..(1398)
atgaatgcctcccccaccgtgactgatcaactggtgcagaccagaaaattcaagggtctgcgtgctcgtcacatccacttcatcgcgctgggttccgccatcggcacgggcctgttctacggttccgccggcgccatccaggccgccggcccctcggtgctgctcgtctacctgctcggtggcgccgtggtgtacttcatgctccgggcactcggtgagatgtcggtgcgccacccggtccgcggctccttcgcggtgtacacccgcgcgcacctcggcggctgggccgggtacatcaccgggtggatgttcgccttcgagatgctcatcgtctgcctggcggatctcaccgccatcggcatctacatgaaattctggttcccggataccgcgcagtgggtctgggtggccgccacactgctcatcgtcggtggtgccaacctggcctcggtgcgctggttcggcgaactggagttcgtgttcaccctgatcaaggtcaccgcggtcatcgccatgatcgtcggtggcgccgcgatcctcgccttcggcctgggcaactccccggaggtctccgggatctccaacctatgggaacacggtgggttcttccccaacggcattgagggcatgatcgcagccttcatcctggtgctcttcgccttcggtggcaccgagatcatcggtgtggccggatcggaggccgaggatccggagaagtccatcccgaaggccgtcaacaccgtcccggcgcgcatcctgctgttctatgtgggtgccatcctggtcatcctggcactgaacccgtggcagacgatcaccggtgaggaatccccgtttgtgcagatcttctccaccctgggggtcaactgggccgccggtctgctcaacctcgtggtgatcaccgccgcgctgtccgccatcaatgccgacctcttcggcgcgggtcgcgtgctgacgggcctggccaaggagaacctggcaccgaagatcatgggcagggtggccggcaacggtgtgccgatcatgaccaccgtcatcatgatcatcgtcctgatcctgggcgtggtgctcaatgtgatcctgccggagcgcgtctttgagatcgtcgcctccctggccacgtttgccaccgtgtatgtgtggctgatgattctgctggcccaggtcgcctcccgccgccagatgagtgcgcaggaggttgccggtctgaaattcccggtgccgttctatcccttcggccagtacttcgccatcctcttcatcgccttcaccttcggcatcatggtctggtacgacaactaccacctggccctcggagtcggtgtcgggttcctcgtggtgatgaccatcctctactacgccaccggccggccgaaggcgatcgctccggcgcagtag

SEQ ID NO: 9352 - protein, 465 aa, Corynebacterium efficiens
MNASPTVTDQLVQTRKFKGLRARHIHFIALGSAIGTGLFYGSAGAIQAAGPSVLLVYLLGGAVVYFMLRALGEMSVRHPVRGSFAVYTRAHLGGWAGYITGWMFAFEMLIVCLADLTAIGIYMKFWFPDTAQWVWVAATLLIVGGANLASVRWFGELEFVFTLIKVTAVIAMIVGGAAILAFGLGNSPEVSGISNLWEHGGFFPNGIEGMIAAFILVLFAFGGTEIIGVAGSEAEDPEKSIPKAVNTVPARILLFYVGAILVILALNPWQTITGEESPFVQIFSTLGVNWAAGLLNLVVITAALSAINADLFGAGRVLTGLAKENLAPKIMGRVAGNGVPIMTTVIMIIVLILGVVLNVILPERVFEIVASLATFATVYVWLMILLAQVASRRQMSAQEVAGLKFPVPFYPFGQYFAILFIAFTFGIMVWYDNYHLALGVGVGFLVVMTILYYATGRPKAIAPAQ

SEQ ID NO: 9353 - DNA, 1461 bp, Corynebacterium efficiens
  CDS (1)..(1461)
atggcaatgagtgaagttcccgcggcagctcaacccggtgctgcccccggatcatctgagacaacatctgatccgaacagaagacaagaactgggcaccggtctgcggacccgacatctgaccatgatgggcctgggatccgccatcggtgccgggctcttcttgggcaccggtgtgggtatccgggccgccgggccggcggtgctgctggcctatatcgccgccggtgtgatcgtagtgcttgtcatgcagatgctcggtgagatggccgccgcccggccgcattcgggtagtttctccaaatacgccgaggatgccttcggacactgggcggggttctccctgggctggttgtactggttcatgctcatcatggtcatgggtgcggagatgaccggtgccgcggcgatcatgggggcgtggttcggggtggacccctggataccggccctggtgtgcgtggtgttcttcgcgatcgtgaacctggcggccgtccgcgggttcggtgagttcgagtactggttcgccttcatcaaggtcgctgtgatcgtggtgttcctcatcgtcggcgtcggcctgatcttcggtctgctgcccggttcgacctttgtgggcacgagcaacttcatcggggaccacgggttcatgcccaatgggctctccggtgtggccgcgggtctgctcgcggtggcattcgccttcggcggcattgagatcgtcaccatcgccgcggcggaatccgaccagccccggcgggcgatctccctggcggtgcgcgccgtgatctggcgtatctccctgttctacctggggtccgtcctggtgatcacgttcctgatgccgtatgagtccatcgataacgccgaaaccgcggcggagtcgcccttcacccggatcctggacatggccaacatcccgggtgccgtggggctgatggaggcggtgatcgtactggcgctgctgtcggccttcaatgcgcagatctacgccacctcccgtctggtgttcgcgatgtcccgcaaccaggatgccccgcgggtgttctcggtgttgagcaggagcggggtgcccaccgcggcggtgctgttgtcgatgttcttcgccttcgtctccgtggcgctgcagtacttcaatccggccggcctgctggatttcctgctcaatgccgtgggtggctgtctgctggtggtgtgggcgatgatcgccctgtcgcagctgaggctgcggcctaagctggagcacaacggtgagatctcgacggtgcggatgtggggccacccgtggctgggtatcctcaccctggtgctgctcgccgggctggtgctgctcatgctcggtaatgagggttcgcgctcgcaggtgttctccgtggcggtggtctacggtttcctggtggcgctgtccttcaccaccacccgcagccccctgcggggaaagcggactggactgatagaccgatag

SEQ ID NO: 9354 - protein, 486 aa, Corynebacterium efficiens
MAMSEVPAAAQPGAAPGSSETTSDPNRRQELGTGLRTRHLTMMGLGSAIGAGLFLGTGVGIRAAGPAVLLAYIAAGVIVVLVMQMLGEMAAARPHSGSFSKYAEDAFGHWAGFSLGWLYWFMLIMVMGAEMTGAAAIMGAWFGVDPWIPALVCVVFFAIVNLAAVRGFGEFEYWFAFIKVAVIVVFLIVGVGLIFGLLPGSTFVGTSNFIGDHGFMPNGLSGVAAGLLAVAFAFGGIEIVTIAAAESDQPRRAISLAVRAVIWRISLFYLGSVLVITFLMPYESIDNAETAAESPFTRILDMANIPGAVGLMEAVIVLALLSAFNAQIYATSRLVFAMSRNQDAPRVFSVLSRSGVPTAAVLLSMFFAFVSVALQYFNPAGLLDFLLNAVGGCLLVVWAMIALSQLRLRPKLEHNGEISTVRMWGHPWLGILTLVLLAGLVLLMLGNEGSRSQVFSVAVVYGFLVALSFTTTRSPLRGKRTGLIDR

SEQ ID NO: 9355 - DNA, 1341 bp, Corynebacterium efficiens
  CDS (1)..(1341)
atgttcatgggtgcgggcaagaccatctccctggcgggcccgtcggtgatcctggtctacgcgatcatcgggttcatgctcttcttcgtcatgcgggcgatgggtgagctgttgttgtccaaccttaactacaagtcactgcgcgatgccgtctccgacatcctgggccccggtgccgggtttgtcaccgggtggacgtactggttctgctggatcgtcacgggcatggctgacctggtggcgatcaccgggtatgtgcagtactggtggagcggggtgccgctgtggctaccgggtgccggtgccatcctgctgctgttcgtgctcaacctcgccgcggtgcgtctgttcggtgagatggagttctggttcgccatcatcaagattctcgccattgtggcgctgatcttcaccggtctggtcatggtggtcagccacttcgaatccccggatgggtcggtggcgcagttctccaacctggtggaccacggcgggttcttccccaatgggatcaccggtttcctcgccgggttccagattgcgatcttcgccttcgtcggcatcgagctggccggcaccgccgccgcagagaccgaggacccggtgcgcaccctgccgcgggccatcaactccatcccggtgcgcatcgtggtgttctatgtcctgtcgctggcggtgatcatgatggtcatcccctgggaccgtgtgcacaccgacagcagcccgtttgttcagatgtttgcgctggccggtctgccggccgcggcgggcatcatcaacttcgtggtgctcacctccgcggcatcatcagccaacagtggtatcttctccacctcccgcatgctcttcggcctctcactggagggggctgcaccgaggcggtgggcgaagctgtccgccaatcaggtgccggcacggggactgctgttttccatcgtgtgtctgatccccggtgtggccgtgatgtacgccgggtccagcatcatcgaggcctttacgctgatcaccacggtgtcctcggtgctgttcatggtggtctgggcctatatcctcgtcgcctacatcgtctaccgacgccgtaacccccagctgcatgcggcatcggtgttcaagatgcccggcggtgtcgccatggccgtggtggtcctggtgttcttcgtcggcatggtgggtgtgctcaccctggaaaacgacacccgctccgcactgctggccaccccggtgtggttcctgatcctcggcgcgggctggtggttcagcggtggtgcccggggcgcggcgagccgctcccagttgacggggccgaccacgccagtcacgccggccaccacggcctcctaa

SEQ ID NO: 9356 - protein, 446 aa, Corynebacterium efficiens
MFMGAGKTISLAGPSVILVYAIIGFMLFFVMRAMGELLLSNLNYKSLRDAVSDILGPGAGFVTGWTYWFCWIVTGMADLVAITGYVQYWWSGVPLWLPGAGAILLLFVLNLAAVRLFGEMEFWFAIIKILAIVALIFTGLVMVVSHFESPDGSVAQFSNLVDHGGFFPNGITGFLAGFQIAIFAFVGIELAGTAAAETEDPVRTLPRAINSIPVRIVVFYVLSLAVIMMVIPWDRVHTDSSPFVQMFALAGLPAAAGIINFVVLTSAASSANSGIFSTSRMLFGLSLEGAAPRRWAKLSANQVPARGLLFSIVCLIPGVAVMYAGSSIIEAFTLITTVSSVLFMVVWAYILVAYIVYRRRNPQLHAASVFKMPGGVAMAVVVLVFFVGMVGVLTLENDTRSALLATPVWFLILGAGWWFSGGARGAASRSQLTGPTTPVTPATTAS

SEQ ID NO: 9357 - DNA, 1575 bp, Bifidobacterium longum
  CDS (1)..(1575)
atgagtcagcccgacaccgacacggcggcacagtcgccgtcctcgcaacaggaaccgcagattcagacggatggccgtcgaagccattcggaacagatgaatcaaccagcgcaaaccagccagtccgagtcgtcacatgatggcaaagacgagcacgccctacataccaacctgaagcgcggcatggaatcccgccacctgcagatgatctcattaggcggcgtaatcggcaccggcctgttcctgagctccggatacaccatccagcaggcgggccccatcggcacgatcctggcatacagcatcggcgcgctgatcgtctatctggtcatgcttacgctcggcgaattgtccgtggccatgccggtgaccggctccttccacgtgtatgccgaaaagttcatcggccccggcaccggcttcgtgatcgcaatccagtattggctcacctggacggtggcgctcggctccgaattcaccgccgccggcctgctcatgcaacgctggttcccggacagccccacatgggtgtggagcgcggcgtgcatcattctcatcttcaccttaaacgccttgtcggtgcggctcttcgccgaagcggaattctggttcgcctcgatcaaggtgttcgctatctgcgcgttcatcgtcatcggcctgctcgccatattcggcgttattccgattgccggctaccagcatgctccgatgttcggcaacctcgttaaggacggcatcttccccaacgggttcatgccagtgttcgccacgattctgaccgtcaacttcgcgttctccggcaccgagctcatcggcgtgaccgccggcgagacgcgcgacccggaaaccaccgtgccgaaggccatccacaccacgctgtggcgcctggtgctgttcttcatcggctcgatcaccgtgatgtgcgcgctgatcccgtggcgccaggccggcgtgggcgaaagcccgttcgtgctcgtcttcaacagcatcggcatcccctatgcgggcgacatcatgaatttcgtggtgctgacggccgtgctttccgcctcgaattccggcctgtacgcctccacgcgcatggtgtggtcgatgggcaacgaaggcatgattccgcgctggttcgccaaaacgaaccgtcgcggcgtgccgatgctcgccttgtgcgccgcgatggccggtggcctgctggcgctcctgtcttccgtgatcgccgcctcgactgtgtacctggtgctggtggcgctttccggcctgtccgccgtggtggtgtggatcgccatcgcctactgccagatcgtgttccgtcgccgttggctggagtccggccattccaccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactga

SEQ ID NO: 9358 - protein, 524 aa, Bifidobacterium longum
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 9359 - DNA, 1401 bp, Bifidobacterium longum
  CDS (1)..(1401)
atggcggcagccggcacacccaaggacgataccggccttgaacggaagatggagtcgcgtcacctgacgatgatctccctgggcggcgtgatcggcaccggcctgttcgtcagctccggctacgcgattcatcaggcgggaccgttgggcgcgatcctcgcttacgcggccggctccctgctcgtctactgcgtgatggtgtcgttgggcgagctgtccgtggccatgccgtacgccggcagcttccacatgtatgcgaagcggttcatcggccccggcaccgcgttcaccatcgccatcctgtattggctgaactgggcggtggcgctcgcctccgaattcacggccgcagggctgttgatgcagcgatggttcccgcattcgccgtcctgggtgtggtcggccgtgttcattgtggtggtgttcgcgctcaacatcatgtccgtgcggctgtacggcgaggcggaattctggttcgcgtcaatcaaggtgttcgccatcatcgcgttcattgtgatcggcctgctggcgatcttcggcgccataccgattgccggtcatgattccgcgccgttgctgggcaacttcgtggccggcggctggttcccgagcggcatcgcgccgattttctcgactttgctgaccgtggtgttcgcgttctccggcaccgaagtggtgggcgtggcggccggcgaaaccaaggatccctcgcgtgcgattcccaaggccgtgcacaccacggtgctgcgcctggcgattttcttcatcggctcgattctggtgatggcggccttgatcccctggcatcaggccggcgtggatacgagcccgttcgtgctggtgttccagtcaatcggtatgccgttcgccggcgacatcatgaacttcgtggtgttgacggccgtgctttccgccgcgaactccggcctgtacgtgtgttcgcgcatggtgtggtcgctggccaaggagcggctgattcccgaacgttttgctaggacgaatttccgtggtgtgccggtgtgggccgtgctgttcagcatggcgggctcactgctggcgttgctgtcttccgtgatcgccgcctcgaccgtgtatctggtgttggtcgccgtgtcaggtttggcgacgctggtggtgtggttctccgtatgcgtgtgccatatccgtttccggcgcgaatgggcgcgggatgggcacagcgccgatgagctcggctatcgtgcgcccggtttcccggtgctgccgtggctggccatcgtgatgtgcatcggcgcgctggtgctcgtggtgctcgatgatacgcagcgttcgaccctgtattgcatgatcccgttcgtcgcctgctgctacgcggcttattacgcactcgaacggcagcgcaaacgcgaaaacaacgcctaa

SEQ ID NO: 9360 - protein, 466 aa, Bifidobacterium longum
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 9361 - DNA, 1527 bp, Bifidobacterium longum
  CDS (1)..(1527)
atggccgatacgaatgtgaatggtggtacacagcaggctacgggcaaactcaagtctgtcgaaagcctggaccaggccaacgagatggagcgtggcctgagcaatcgccacgtacagttcatcgccattggcggcaccatcggcaccggcttgttcctgggttcgggcaagtcgatttcgctaaccggcccctcgatcatcttcgtgtacattctggtcggtatcatcatgttcttcctgatgcgcgccatcggcgaaatgatgtaccgtgaccccagccagcacaccttcatcaacttcatcacccgctacctgggcaacggatgggggcacttcgctggctggacgtactgggctgcgctcgtgctgctcggcatgaccgagatcacggccgtctccacatacttcatcaccttcttcgacacgttcggcatcgacctgacccattggaaatggctgatcgaactgtgcttcctcgtggtgctggtctccatcaacctgattgccgtcaaggtgttcggcgaggtggaattctggttctcgatgatcaagatcacgctgatttgcgcgatgatcgccaccgccgtggtcatgatcgtgatcggctaccattacccagccgtgcagattcacggcgtggaccacgtgagcccggccggccacgccggattcgacaacctgttcgccaacttctcgttcgcgccgaacggctggatggccttcctcatgagcttccagatggtgttcttcgcctacgagatgatcgaattcgtgggcgtcaccgtttccgagaccaagaacccgcgcaaggtgctgcccaaggccatcaacgagattatcgtgcgcgtgctcatcttctacgttggcgcactgatggccattatgtgcattgtgccgtggacctcgttcaagccgaacaaggacggctcctttgcctccccgttcatcatggtgttccagtacgccgggctgaattgggcgtccgcgctggtgttcttcgtggtgattaccgccgcatcttccgcgctgaactcgctgctgtactcggctggccgccacctgtaccagctggccggggagtcgccgaacccgacgctcaacaagatcggtcaggtgtccgaccgcaaggtgccggctcgtgcgattctggtgtccgcggtgctgattctgctttcgccgattgtcaacgctattcccggtgtgtccggagcgttcgtgctgttctcgtccgccagctccgcagtgttcctgtttatctacattctgacgctgatggcacaccgcaagtaccgtcgctccgctgatttcattccggacggtttcgtcatgcccgcctggaaggtgctcaatacggtggcgattgcgttcttcgtgttcatttacctgacgctgttccttgcggacgatacgcgcaactccgcgattgccggcctggtgtggcttgtgggcttcggtgggttctcgatgctgcgcgagcgctaccgtagccgcgatttgaaggtcgcgctggaacacaaggagatttga

SEQ ID NO: 9362 - protein, 508 aa, Bifidobacterium longum
MADTNVNGGTQQATGKLKSVESLDQANEMERGLSNRHVQFIAIGGTIGTGLFLGSGKSISLTGPSIIFVYILVGIIMFFLMRAIGEMMYRDPSQHTFINFITRYLGNGWGHFAGWTYWAALVLLGMTEITAVSTYFITFFDTFGIDLTHWKWLIELCFLVVLVSINLIAVKVFGEVEFWFSMIKITLICAMIATAVVMIVIGYHYPAVQIHGVDHVSPAGHAGFDNLFANFSFAPNGWMAFLMSFQMVFFAYEMIEFVGVTVSETKNPRKVLPKAINEIIVRVLIFYVGALMAIMCIVPWTSFKPNKDGSFASPFIMVFQYAGLNWASALVFFVVITAASSALNSLLYSAGRHLYQLAGESPNPTLNKIGQVSDRKVPARAILVSAVLILLSPIVNAIPGVSGAFVLFSSASSAVFLFIYILTLMAHRKYRRSADFIPDGFVMPAWKVLNTVAIAFFVFIYLTLFLADDTRNSAIAGLVWLVGFGGFSMLRERYRSRDLKVALEHKEI

SEQ ID NO: 9363 - DNA, 1476 bp, Bifidobacterium longum
  CDS (1)..(1476)
atgagtactactgatgcgcctaagaagccgcgcgaaaccgacgacgtgccggtgccggccacgctgcgcaagtcattgaaaaaccgccacatccagctgattgcgctgggcggcgccatcggaaccggcctgttctatggttccagtgaatccatcgcgctggccggaccctcgattctgctcgcctacttggttggcggcctcgcgattttcgcgattgtgcgtgcactgtctgaaatgtccgttgaggatccgaaggcgggcgcgttcagctactatgccacccgctactggtccaagcgcgccggctttatttccggctggaactactggttcaactacatcctcgtctcgatggtggagctatcagtggtgggttcgtttgtgaactactggttcccggcgattccgacatgggtgtcggcggccgtgttcttggtgatcatctgcgccgccaacctgctgggcgtctctaaattcggtgagttcgagttctggttcgccatcatcaagattgtggccgtgatcgccatgattatcggcggcctggccgtcatcatctttgtcctgcccaccgcatccggcgtgcgcgcaagcttcgcgaactggttcaccgtgggtaacggcttcttcccgaacggcctgatggggcagaattccgacggttcctggaccggcctgctgatggcactggttgtggtgatgttcagcttcggcggcaccgagctcatcggcatcaccgccggcgaaaccgaggatccgaagaccacgattccgcgcgccaccaatgatattatttggcgaatcctcgtgttctacatcggcgctctgggtgtgatcatggccgtagtgccgtggaacaccatcgatggcaagtccagcccgttcgtgcagatcttcgattccgtgggcattcacgcggctgccggtattttgaacttcgtgtgcctgaccgctgtgatgagcgtctacaactccggcctgtacgccaactcccgcatgttgtactcgctggccaagcagggcaatgcgcccgcttacttgggcaagctcaactcgcgcggcgtgccagtggccggcgtgctgacgtccgccgcgatcaccgccatcgccgtggtcgtggtgttcgtgtggcctgagttcgcgttcaactacctgatgtcgattgccaccattgccggcatcatcaactggacgatgatcatgctcaccgaaatgaagttccgtaaggtggtcgccgcgggcggcgctcccgaggattccgagctggccggtctgagcggccaggaggcactggacgcgattcacttcaaactgccgtttgccaaggtgaccccgtgggtggtgctggcgttcctggcgctggtcgtggtgctgatgtgcttctccaccagctaccgcatcgccgtcatcgccggcgtgatctggctggccatcctcttcgccgcctaccagctcactcaggcgaagaagtaa

SEQ ID NO: 9364 - protein, 491 aa, Bifidobacterium longum
MSTTDAPKKPRETDDVPVPATLRKSLKNRHIQLIALGGAIGTGLFYGSSESIALAGPSILLAYLVGGLAIFAIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 9365 - DNA, 1798 bp, Hebeloma cylindrosporum
  CDS (15)..(1667)
ggcacgagcacacgatggaaaacgagaaaaccgagcatgagaaacgtgaaagttcctctaatcttgagaagggcgaccatgtcgtcgcacagacgaacccacagttccatttcgatgtccatgaccttgaccgcgtccaacggcgtctcaagcaacgtcatgttcaaatgatcgctatcgctggaaccattggtacagggctattcttaggttctggaggagcattggaagctgcagggcctttgggcgccctcattgcttatgcgctggttgggactgttgcatactcctccctttgcgctgtgggtgaaatgtcaacgtgggcaccgatatctggaactttcccccacttcgccgcacgctgggtcgaccctgcccttggctttgcgacgggatggaactatttttataccaatgctatctcgacacctgttgaaatcacggctgcagttatccttttgacattctgggaccataactcgaaacatatctctctctacacggctattctctgtgtgttggtctgcatgattaatatttttggtgtaagatatttcggagagtcggaatttatcttcgcgatcatcaaacttaccctcatcatcggtctactcttggtcggccttatcgtcgacctgggaggaggacctcaaggcgaccgcattggattcaggtattggaaaaacccgggcgccattgctggttctgggttggaccgaaacatatttggcctggatcgtttccttgcgatcctgagtgtcattgtccaagctgcgttttcattccagggaatggaattggtcgtcattgctgcctcggagactgaaagccctcgccggaacatcgcgaaggccgttcgacgagtgttctatcgcatcttggtcttctacattttgggcatccttatgattggcatgctcgttgcatacaacgacaaggatttgttgttcctccaaggtaacaacactgctgccaaatcgcccttcgttatcgcgatcaaccgcgctggaatcaaagttctccctcacatcgtcaatggggctatctttacgagtgcattttccgccggaaatagcttcctgttctgctcatcccgcgtcctttacggactggctcttcgtggtcaagctcccaaggtactcacgtactgcaccaagaaaggtctgccattatatgcggtgcttgtagcctccgcgttctcttttctctctttcatgagcgtatcgagtggctctaacagagtgttcggctggtttgttaatctgtcgaccacaggaggattcaccagttggttcgttatgaacgtgacctatatcttcttccgacgaggattgctcgctcagggatatgacccgaccacaaactcgtaccataaccgattccagccctacatcgcatattggggcgctggctggacgttgttcttcatcctcattaacgggttctctgtcttctggaaattcactgccgctgggttccttacagcttatatcaacatcccgatatttttggtcctgtactttgggtataaaatcgtctttcgcaccaagttctggaagccgctggaaatggacttcgtcactggcatcccgacattggaagagaccgagacaccggagaaacctccaaagaatctcggagaacgtattgccaatatcatcttctaagcacgaacctaggataatgaaccatggctaactacatatttttctcataagtgctcatactaataacatatttcgtggttagtcttgtaaaaaaaaaaaaaaaaaaaaaaaaaaaaaaaaaaaaaaaaaaa

SEQ ID NO: 9366 - protein, 550 aa, Hebeloma cylindrosporum
MENEKTEHEKRESSSNLEKGDHVVAQTNPQFHFDVHDLDRVQRRLKQRHVQMIAIAGTIGTGLFLGSGGALEAAGPLGALIAYALVGTVAYSSLCAVGEMSTWAPISGTFPHFAARWVDPALGFATGWNYFYTNAISTPVEITAAVILLTFWDHNSKHISLYTAILCVLVCMINIFGVRYFGESEFIFAIIKLTLIIGLLLVGLIVDLGGGPQGDRIGFRYWKNPGAIAGSGLDRNIFGLDRFLAILSVIVQAAFSFQGMELVVIAASETESPRRNIAKAVRRVFYRILVFYILGILMIGMLVAYNDKDLLFLQGNNTAAKSPFVIAINRAGIKVLPHIVNGAIFTSAFSAGNSFLFCSSRVLYGLALRGQAPKVLTYCTKKGLPLYAVLVASAFSFLSFMSVSSGSNRVFGWFVNLSTTGGFTSWFVMNVTYIFFRRGLLAQGYDPTTNSYHNRFQPYIAYWGAGWTLFFILINGFSVFWKFTAAGFLTAYINIPIFLVLYFGYKIVFRTKFWKPLEMDFVTGIPTLEETETPEKPPKNLGERIANIIF

SEQ ID NO: 9367 - DNA, 1629 bp, Aspergillus fumigatus
  CDS (1)..(1629)
atgatcgaagcaaagatgacaccctttgaattcaatcaacatgtcaacgccgacaggctcgctcgtaagctctccgcccgccaggtgcagatgatcgccatcggcggcacaattgggacgggactcttcctgggaacaggcaaagctctcgcgacaggtgggcctgcgtcgatgcttatttcgtatgccatatgtggtgggattgtgttcgtcacgatgttaagcctgggggagatggcggcgtttattcccattgcgggttcgttctgtactttcgcagggcgcttcgttgacgatgctcttggtttcgctctgacttggaattactggtttaatgacgctgtctcaacggcggcggatgtcattgcactgcaactattgctgcagtattggacggataacttcccaggctgggcgatcagcttaatctttctgatttttgttattttacttaatgtgatgtctgtgagaatctacggagagattgaatattggctcagcttactcaaggtcatcacgattataatcttcatcattctcgggattgttgtcaactgcgggggcaataaggaccacaaatacatcggtgacaagtacttctatgtcggcgatgcccccttcgtaggtggaatcggtggattcgcctccgtctttgtcacggcatcgtttgcttatggcggcacggaatccattgccatcacagcgggagaaaccaaagacccagctaaaaacctgccgcgagtcgtccgcaatgtcttctggcgcatcgtcctcttctacatcatctccatcattctcatcggtctcaatgttccctacaactaccccaacctgtcaaagaaaaccaccgccaccagcccgttcaccatcgtcttcatggaagctggcagcgccgtggcaggcagcttcatcaacgccgtgctaatgaccagcgtcatctccgccgccaaccatgccctcttcgcagggtcccggcttctctacacgctcgcggtagacggccacgcccctcatttctttggccacctcaaccgcttccagatcccctgggtcgccgtgctagccacatccctcgtcagcggtctctgcttcggagccagctacatcggagccggccagctctggacctggttgcaaaatgaaaccagcatcgtcggcgtctccaaccaaatctcgtgggtctgcatcggcatcgcctccctgcgcttccgcgccgccatccgccggcagaacctcgagcatctcctccccttcaagaactggacgtaccccgtcggccccatcatcgccgtcgggctgaatatcgtcctgatcctcgtgcagggctggtcctgcttcagcccgtccttccaggccgtcgactttgtgtcgttctacatcgagatccctatcatgattgtcatgtttttggcctggaagctggttaagcagacgaggttcgtgcatctggatgagatggacttggttactgatcggtatgatctgaatgcggagcatgctgaaagcgatggcaatgccgatggtgatagcccgtcgcgggtcgggaggattctgcatatcaaacagttgcagagtgaaaagggcgtgctcgggaagctgaagcgagttgggatgtggctgttcctatag

SEQ ID NO: 9368 - protein, 542 aa, Aspergillus fumigatus
MIEAKMTPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 9369 - DNA, 1407 bp, Corynebacterium glutamicum
  CDS (1)..(1407)
atgaatgcctcccctgccccaacccgatcttttaaaggattgcgggctcgacacattcacttcatcgcgctgggttccgcgatcggcaccggcttgttctacggttccgctggcgcaatccaagcagctggtccatctgtactcttggtctaccttctcggtggcgccgtcgtgtacttcatgctgcgcgcactcggcgagatggctgtgcatcacccagtccgtggttccttcgcggtctacacccgcgcacaccttggcggatgggcaggctacatcaccggctggatgttcgcgtttgagatgctcatcgtctgcctggctgacctcacagccatcggcatctatatgaacttctggttccccggcaccccacaatggacttgggtggtagccacccttcttattgtcggtggcgcaaacctcgcatcagtgcgttggttcggtgagctcgagttcatcttcaccatcattaaggtcaccgcagttgtcgccatgatcgtcggcggcgcagccatcctcgcattcggtctcggcgccaacgctgaagttgccggcgtatccaacctctgggagcacggcggattcttccccaacggtgttgaaggcatgatcgcagccttcatccttgttctcttcgcattcggtggcaccgaaatcatcggtgttgcaggctctgaagctgaagatcctgagaagtccatccccaaggctgttaatactgtcccagtacgcatcctcctcttctatgtgggtgccatcctggtgatccttgcccttaatccttggccttccatcaccggcgaagaatccccattcgtccagatcttcgacaccctcggcgtcaactgggctgctggtctcctcaacgccgtggtcatcaccgctgcactgtctgccatcaacgctgacctcttcggcgctggccgcgttctcactggtcttgcgaaggaaaacctcgcaccaaaggccatgggcaagatcgccaagaacggcgttccagtcatgaccaccaccatcatgatcatcgtcttgatcgtgggagtaatcctcaacgcagtgcttcccgagcgcgtcttcgagatcgtcgcttccctagcaaccttcgccacagtttacgtctggctgatgatcctgctcgcacaggtgggatcccgccgaaacatgcctgccgacgaggtcaagtccctgaagttccctgtccccttctaccccttcggacaatacttcgcgatcctatttatcgccttcaccttcggcatcatggtctggtacgacaactaccacctgccactcgccgtcggcgttggattccttgtcctgatgacaatcctttactacgccacaggccgaccaaaggcgatcgctccgatcgattatgaagagctagatccgcgacgcgattaa

SEQ ID NO: 9370 - protein, 468 aa, Corynebacterium glutamicum
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 9371 - DNA, 1380 bp, Xanthomonas campestris
  CDS (1)..(1380)
atgtccgacccgtccgcgcccgatcatctgcaacgcagtctgtccaaccgccacctgcaactgatcgcgatcggcggtgcgatcggcaccggcctgttcatgggctccggcagaacgatcagcctggccgggccgtcgatcctgttcgtgtacctgatcatcggcgtgatgctgttcttcgtgatgcgcgccatgggcgagctgctgttgtccaacctggactacaagtcgttcatcgacttctccaccgatctgctcgggccctgggcggggttcttctgcggctggacgtactggttctgctggatcatcaccgccattgccgatgtcatcgcgattgcagcgtacgcccagttctggtttcccgaactggcgccatgggtgccggcggtgctgtgcgtgctgctactgctggcgttgaacctggtcacggtgaagttgttcggcgagatggaattctggtttgcgctgatcaagatcatcgccatctgcgcgttgatcatcaccggtgcgggcctggtgatgtggggcttccggtcgccctccggccacgtggcatcgctgagcaatctgtggaacgacggcggcatgttcccgatgggaatcggcgggttctttgcagggtttcagatcgcggtattcgccttcgttggcatcgagctggtgggcaccaccgctgcggaaaccgccgacccgcagcgtaatctgcccaaggcgatcaactcgatcccggtgcgcatcctcatcttctacgtgctggcgctgatcgcgatcatggcggtgacgccgtggcggcaggtggtggccgacaagagcccgttcgtggagttgttcgtgctggccggtgtgccggcggcagccagcctgatcaatttcgtggtgctcacctcggccacttcatcggccaatagcggcatcttttccaccagccgcatgctttacggcctggccgaagaacgcaacgcgcccaggggctttgccaagctgacgcgggcggcggtgccggcgcgcggcctgctgttctcgtgcatctgcctgctgctgggcgcgatgctggtgtatctgattcccgatctggtcaccgcattcacgctggtcaccaccttgtcggccgtgctcttcatgttcgtgtggtcgttgatcctgtgcgcgtacatcgcgtaccggcgcaaacgcccggagcagcatgcggcttcggcgttcaagatgcccggtggcgtgttgatgtgctacgtgtgcctggcgttcttcgccttcatcatcgtgttgctgaccttgcagcccgacacactgcacgcactgctggtgagcccgctgtggtttctggtgctggcgattgcctattgggtgaggcgaaaccagtcgcccacagcccgctga

SEQ ID NO: 9372 - protein, 459 aa, Xanthomonas campestris
MSDPSAPDHLQRSLSNRHLQLIAIGGAIGTGLFMGSGRTISLAGPSILFVYLIIGVMLFFVMRAMGELLLSNLDYKSFIDFSTDLLGPWAGFFCGWTYWFCWIITAIADVIAIAAYAQFWFPELAPWVPAVLCVLLLLALNLVTVKLFGEMEFWFALIKIIAICALIITGAGLVMWGFRSPSGHVASLSNLWNDGGMFPMGIGGFFAGFQIAVFAFVGIELVGTTAAETADPQRNLPKAINSIPVRILIFYVLALIAIMAVTPWRQVVADKSPFVELFVLAGVPAAASLINFVVLTSATSSANSGIFSTSRMLYGLAEERNAPRGFAKLTRAAVPARGLLFSCICLLLGAMLVYLIPDLVTAFTLVTTLSAVLFMFVWSLILCAYIAYRRKRPEQHAASAFKMPGGVLMCYVCLAFFAFIIVLLTLQPDTLHALLVSPLWFLVLAIAYWVRRNQSPTAR

SEQ ID NO: 9373 - DNA, 1386 bp, Xanthomonas campestris
  CDS (1)..(1386)
atgccgcttccgaccgatcctgttgctgagactgcttcgtccgctgcgcctgcgctgcgtcatgcgctcaaaccccggcaattgatgatgatgggcctgggcacggcgatcggcgcaggcctgtttctcggctcgggggtcggcatccacgcggccggcccggccgtgctcgtgtcctatctgatcgccggcgcgctggtgatcatcgtgatgaacgcgctcggtgaaatggccgcggccaagccggccagcggcgcgttttcggtctacgcggccgatgccatggggccgaccgccggcgcaaccgtcggctggttatggtggctgcagatcgtggtggtgatcgccgccgaagcagtgggcgcggcaagcctgctggccacggtgtggccggccttgccggtgccgatgctggcgtcggtgttcatggccaccttcaccgtgatcaacctgctgggcgtgcgcaatttcggtgagttcgaattctggttcgccatcctcaaggtggtggcgatcctgatcttcctgatgattggcggtgcgctgctggccgggttgctgccgggcgtggcgtcgccggggctctccaatttcacccagcacggcgggttcgcgcccaagggcctggccggcatcggcaccgcactgctggtggtggtgttcgccttcggcggtaccgagatcgtggcggtggcggcagcggaaaccgccgaccccgggcgcagcctggcgcgcaccatccgcacggtggcctggcgcatcctggtgttctatatcggctcgatcagcgtcatcgtcgcggtggtgccctggaccagtgatgcactgagttcgccgtttgccgctgtgctggaagtcgcgcgcattcctggtgcggcaaccggcatcacgctggtggcggtggtggcgctgttgtcggcgctcaatgccaatctctatggtgcctcgcgcatgatcttctcgctggcccagcgcggtgaagcgccccgttggctgggcaacaccagccgccagcaggtgccgctggtggcggtgatcgccagcgtgttgttcggctttgccgccgcggtgctggagttgctgtatcccggcaaggtgctgccgatgctgctgaatatcgtcggtgccacctgtttgctggtgtggacgatctcgttgctgtcgcagttgatcctgcgtgcacgcgccgaccgcgccggcatcgccttgccgttccgcatgcgtggctacccggtactgacgctactggcgttggcgatcctggcggtgatcttcgtgctgctggcattgtcggccgacacccgcgcgcagttcctgtcgatggtggggctcaccgccggcatcgcgctggtgagcgagctggcgcggcggatgcgcaagcgctag

SEQ ID NO: 9374 - protein, 461 aa, Xanthomonas campestris
MPLPTDPVAETASSAAPALRHALKPRQLMMMGLGTAIGAGLFLGSGVGIHAAGPAVLVSYLIAGALVIIVMNALGEMAAAKPASGAFSVYAADAMGPTAGATVGWLWWLQIVVVIAAEAVGAASLLATVWPALPVPMLASVFMATFTVINLLGVRNFGEFEFWFAILKVVAILIFLMIGGALLAGLLPGVASPGLSNFTQHGGFAPKGLAGIGTALLVVVFAFGGTEIVAVAAAETADPGRSLARTIRTVAWRILVFYIGSISVIVAVVPWTSDALSSPFAAVLEVARIPGAATGITLVAVVALLSALNANLYGASRMIFSLAQRGEAPRWLGNTSRQQVPLVAVIASVLFGFAAAVLELLYPGKVLPMLLNIVGATCLLVWTISLLSQLILRARADRAGIALPFRMRGYPVLTLLALAILAVIFVLLALSADTRAQFLSMVGLTAGIALVSELARRMRKR

SEQ ID NO: 9375 - DNA, 1437 bp, Xanthomonas campestris
  CDS (1)..(1437)
atgcgtggcaggatggggcgccaccgatcaggaccacgcatgtccgagccctcgtccaccgacgcaccgcagttccagcgcagcatgcaggtgcgccatctggtgatgctgtccctgggcggcgtgatcggcacgggattgttcttcaacaccggctacatcatcgccagcaccggtgcgctgggtacggtgctggcgtacctgatcggcgcgctggtggtgtatctggtgatgcaatgcctgggcgagctggcggtggcgatgccgcagaccggcgcgtttcatgtgtatgcggcgcgctatctggggcctgccaccggctacgtggtggcctggttgtactggctcacctggacggtggcgttggggtcgagcctcaccgctgccgcgttctgcatgcagtactggtttccgcacagcccggcgtggccgtggtgcctgctgttctgcgtgctgattttcagtttgaacatggtgtcggcacgctggtttgccgaaggcgaattctggttttcgctgatcaatgtagtgaccattgtggtgttcatcgtgctgggcggcgcggcggtggtcggctggctgccgctggccgacggcagcccggcgccgggagtgcgccatctgcgcgccgatggctggtttgcgcacggcaccgtgccgatcctgatgacaatggtggcggtgaatttcgctttctccgggaccgagctgatcggcatcgcagccggcgaaactgcacagcctgcacgcgcaatcccgctggcgatccgcaccacgttgatccgtctggtggtgctgttcgtcggcaccgtgctggtgctggccgcgttgctgccggcgcacgcggcggcggtggagaccagcccgttcgtgcgcgccttcgagctgctgggcattccgtatgccgcaggtctgctcaacgcggtgatccttaccgcgatcctgtcggcggccaactccgggttgtatgcggcggcccgcatgctgtggtcgttggccaacgagggcaccttgcctgcccgctttgcgcggctgacccggcgtggcatcccgctgcctgcgctggtgctgagcatgcttggcgggctgctggcgctgctgaccggtgtgtacgcggccgacaccgtgttcgtggcgatttctgcagtctccgggtttgcggtggtggtggtgtggctgagcatctgtgcctcgcactattgtttccgccgccagctgctgcgtgacggcatcgcactggacagcctggcctaccgcgcgccgtggtatccgtggacgccgctgattggtggcgcgctgtgcgtgctggcctgcgctgggctggcgtttgacccgcagcagcgcatcgcgctgtggtgcgggattccgttcgtggcgctgtgctacggcgcccatgcagtgacccaaaggcttgcagcccggagagtgcgtccatga

SEQ ID NO: 9376 - protein, 478 aa, Xanthomonas campestris
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 9377 - DNA, 1389 bp, Xanthomonas axonopodis
  CDS (1)..(1389)
atgccgcttccgaccgattccgttgctgagaccgctgcgcccgccgcgcctgcattgcgccatgcgctgaagccgcggcaattgatgatgatgggcctgggcacggcgatcggcgccgggctgttcctgggttccggcgtgggcattcacgcggccgggccggcggtgctgatctcgtatctgatcgccggggcgttggtcatcattgtgatgaacgcgctgggcgaaatggccgccgccaagccggccagcggggcattctcggtgtatgccgccgatgcgatgggcccgacggccggcgctaccgtgggctggctgtggtggtttcagatagtggtggtgattgcggcagaagcggtaggcgcagccgggctgctggccacggtctggccggcgttgccggtgccgttgctctcgttgctgttcatggccacgttcactgcgatcaatctgctcggcgtgcgcaactttggcgagttcgagttctggttcgccatcctgaaagtgctggcgatcgtggtgttcctgctgatcggcgtggcgttgctggcgggctggttgcctggggtggcgtcgcccgggctgtccaatttcacccagaacggcggctttgcgccgaagggcctggccggtatcggctcggcgttgctggtggtggtgttcgccttcggcggcaccgaaatcgtcgcggtggccgcagcggaaaccgccgacccgggacgcagcctggcgcgcaccatccgcaccgtggcctggcgcatcctggtgttctacatcgggtcgatcagcgtgatcgtggcggtggtgccatggaccagcgccgcgctcagctcgccgtttgcggccgtgctggaggtggctcgcattcccggtgccgccacggcgatcaccctggtggcggtggtcgcactgctgtcggcgctcaacgccaatctgtacggcgcttcgcggatgatcttctcgctggcccagcgcggcgaagcgccgcggttgctggccaggaccagcggcgagcaggtgccgctggtggcggtgatcgctagcgtgttgttcggcttcgccgccgcagcgttggagttgttgtatccgaacaaggtgttgccaatgctgctcaacatcgtcggcgccacctgcctgctggtgtggacgatctcgctggtgtcacaactgatcttgcgcgcccgcgcggaccgtgccggccttgcgctgccgttccgcatgcgcggctatccgtttctgaccgtgctggcgctggtcatcctggccgtgatcttcgtgttgttggcctcttcggccgatacgcgcgcgcaattcctctcgatggtcgcgctgaccgcagtcatcgcagcggtcagcgaaatcgcgcgacgcgtgcgcgcgcggatgtga

SEQ ID NO: 9378 - protein, 462 aa, Xanthomonas axonopodis
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQIVVVIAAEAVGAAGLLATVWPALPVPLLSLLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLEVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILAVIFVLLASSADTRAQFLSMVALTAVIAAVSEIARRVRARM

SEQ ID NO: 9379 - DNA, 1398 bp, Xanthomonas axonopodis
  CDS (1)..(1398)
atgcccgagccgtcgtccgccaccgcaccgcagttccagcgcagcatgcaggtgcgccatctggtgatgctgtcgctgggcggggtgatcggcaccggcctgttcttcaacactgggtacatcattgccagcaccggcgcgctgggcacggtactggcgtatctgatcggcgcactggtggtgtacctggtgatgcaatgcctgggcgagctggcggtggcgatgccgcaaaccggtgcgtttcatgtgtatgccgcgcgctacctcggcccggcgaccggctatgtggtggcgtggttgtattggttgacctggacggtggcattgggttcgagcctgacggccgcagcgttctgcatgcagtactggtttccgcacagcctggcgtggccgtggtgtctgctgttctgcgcgctgatcttcggcctgaatacagtttcggcgcgctggtttgccgaaggcgagttctggttttcgttgatcaaggtgatcaccatcctggtgttcatcgtgcttggcggcgcggcggtgatcggtctgttgccactggccgacggttcgcccgcacccgggctgcgccatctgcgcgccaacggctggttcgcgcacggtacgctcccgatcttgatgacgatggtggcggtgaatttcgcattttccggcaccgagttgatcggcgtggcggccggcgaaaccgcacagcctgcacgcgcgattccgctggcaatccgcacaacgctggtgcggctggtggtgctgttcgtcggcacggtgctggtgctggcggcgctgctgcctgccagacgagcggccgtggaaaccagcccgttcgtgcgcgccttcgagctgttgggcattccatatgcagccgacatcttgaatgcggtgatcctcaccgcgatcctgtcggcggccaattccgggctgtatgcggccgcgcgcatgctgtggtcgttggccaatgaaggcacgttgccgagcggcctggcgcgcttgaccggccgcggcatcccgttgcgtgccgtgtcgctgagcatgctgggcggcttgctggcgctgctcaccggcgtgtatgcgcccgaaacggtgttcgttgcgatctcggcagtctcgggcttcgccgtcgtggtggtgtggctgagcatttgcgccgcgcattaccgcttccgtcgccaatggctgcgcgatggcgctgcgctggaaacgctggcgtatcgcgcgccgtggtacccgtggaccccgattctgggcttttcgctgtgtctgctcgcctgcatcgggttggcattcgatccgcagcagcgcattgcgttgtggtgcggtattccgttcgtcgcgctgtgctatggcgcctacgcacttacccaatggcttgcggcccggagactgtacgcatga

SEQ ID NO: 9380 - protein, 465 aa, Xanthomonas axonopodis
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 9381 - DNA, 1383 bp, Xanthomonas axonopodis
  CDS (1)..(1383)
atgcccatgtctgacccgtccgcgcccgatcatctgcaacgcagcctgtccaatcgccacctgcagttgatcgccattggcggggcgatcggtaccggcctgttcatgggctctggcaagacgatcagtctggccgggccgtcgatcctgttcgtctatctcatcattggcgcgatgctgttcttcgtcatgcgcgcaatgggcgaactgctgctctccaacctggaatacaagtcgttcatcgatttttccaccgacctgctcgggccgtgggccgggttcttctgtgggtggacgtactggttttgctggatcatcaccgccattgccgatgtcatcgcgattgcggcctatgcgcaattctggtttccagggttggcgccgtggattcccgcgatcttgtgcgtgttgttgctgctgggcctgaatctggtcacggtgaaattgttcggcgagatggaattctggttcgcgctgatcaagatcatcgccattgccgcgttgatcgtcactggcgccgggctggtggtgtggggctttcgctcgccgtcgggcaacgtggcctcgctgtcgaatctgtggaacgacggcggcatgttccccatgggtatcggcgggttctttgccggcttccagattgcggtgttcgccttcgtcggtatcgagttggtgggtaccacggctgcagaaacggccgatccgcgccgcaacctgcccaaggcgatcaactcgattccggtgcgcatcttgattttctacgtgcttgcgctgatcgccatcatggcggtgacgccgtggcggcaggtggtggccgacaagagcccgttcgtggagttgttcgtgctggccggcgtgccggcggcagccagcctgatcaacttcgtggtgctgacctcggccacctcgtcggccaatagcggcatcttttccaccagccgcatgctctacggcctggccgaagaacagcatgcgcccaagggcttcgccaagctgtcgcgtgcggcgataccggcgcgcggcctgctgttttcctgcctgtgcctgctgctgggcgcaatgctggtgtatctgattcccaacctggtcaccgcgtttacgctggtcaccacgctgtcggcggtgcttttcatgttcgtgtggtcgctgatcctgtgcgcctacatcgcctaccgccgcaagcgcccggagcaacacgccgcctcggcgttcaagatgcccggcggcgtgctgatgtgctacgtgtgcctggcattcttcgccttcgtcatcgtgctgctgaccctgcaggacgacacgcgtcaggcattgctggcaagcccggtgtggttcctgctcctggccattggctatgcagtcaaacgccgcgggaaccggcagcgctga

SEQ ID NO: 9382 - protein, 460 aa, Xanthomonas axonopodis
MPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 9383 - DNA, 1749 bp, Candida albicans
  CDS (1)..(1749)
atgctacataaaaaagaaactaacgatacatttgttcaattaaatagaagtccatctacgggagaacaaaaatcttccggcatttggtcatcaattaaagattcattcaaaccagccttaccacaagataaactcacgggtgtagatgatatccctgatagagaacttaccgatattgaaagaatcaacatcaatgctgccaattccaatttacaaagaaaattgaaaacaagacatttacaaatgatcgctattggatcatctataggaaccggtcttttcgttggtactggtggtgcattaagtactggtggaccagctgccattgttctagcatgggccataagtgctatatcggtatttatgacaatgcaaggattaggtgaattggccgttgcattcccagtttctggtggattcaatttatacgcaagtaaatttttagaaccaggtattggatttgctgttggttggaattatttcttacaattctttgtattattgccattagaattagttgctggtgctataactatcaaatattggaatgctagtataaattctgatgtgtttgttattatattttggtttgtggtgcttgtgatcaccatgttgggtgtaagatggtatggtgaagctgaacttgtattttgtaccatcaaagtcattgctgttattggatttatcattttagggattgtgttaatttgtggtggtggaccaaatcatgaatttattggaggtaaatattggagagaaccgggtccttttgctaattcttttaaaggttttgctagttcacttatcaccgctgcattctcttttggtggtacagaaatgattgccttaacagcaagtgaaagttcaaatgttagacatgcattacccaaagccattaaacaagtgttttggagaattgttatattttatttgggatcaattattatgattgcaactttagttccttataatgataaaagattacttggaagttcatctgttgatgtcactgcatctccattcactattgccattgttaacggtggaatcaaaggtttacctagtgtcatcaatgccgtgattttgatatcggtattatcagttggtaatgcttcagtatatgcaacttcaagaactttaaactcacttgctgaacaaggaatggcacctaaatggacaggatatattgatagagccggaagaccattatttgctattcttatcaccaatgtatttggattatttgccttaattgctgctgataatgagaaacaggtggttgctttcaattggttattggctctttctggtctttcatcaattttcacctggatgagtattaacttgagccatatacgttttagaagagccatgaaagttcaaaatcgttcattaacggaattaccatttgttgctcaaagtggggtttggggatcatattttgggttaactttaaacattttgtatttaattgctcaattttatattggattattccctgttggtggtaaaccaaatgcttatgatttctttttggcatatttgggtgttccagtgattttagcatcatggataggttataaaatttggaaaagagattggacattatttatcagagcaaaagatattgaccttgatactggtagaatcaatgttgatttagatttgttacaacaagaaatagctgaagaaaaagctcaattagctgaaaaaccattctatattagaatttatagattttggtgctaa

SEQ ID NO: 9384 - protein, 582 aa, Candida albicans
MLHKKETNDTFVQLNRSPSTGEQKSSGIWSSIKDSFKPALPQDKLTGVDDIPDRELTDIERININAANSNLQRKLKTRHLQMIAIGSSIGTGLFVGTGGALSTGGPAAIVLAWAISAISVFMTMQGLGELAVAFPVSGGFNLYASKFLEPGIGFAVGWNYFLQFFVLLPLELVAGAITIKYWNASINSDVFVIIFWFVVLVITMLGVRWYGEAELVFCTIKVIAVIGFIILGIVLICGGGPNHEFIGGKYWREPGPFANSFKGFASSLITAAFSFGGTEMIALTASESSNVRHALPKAIKQVFWRIVIFYLGSIIMIATLVPYNDKRLLGSSSVDVTASPFTIAIVNGGIKGLPSVINAVILISVLSVGNASVYATSRTLNSLAEQGMAPKWTGYIDRAGRPLFAILITNVFGLFALIAADNEKQVVAFNWLLALSGLSSIFTWMSINLSHIRFRRAMKVQNRSLTELPFVAQSGVWGSYFGLTLNILYLIAQFYIGLFPVGGKPNAYDFFLAYLGVPVILASWIGYKIWKRDWTLFIRAKDIDLDTGRINVDLDLLQQEIAEEKAQLAEKPFYIRIYRFWC

SEQ ID NO: 9385 - DNA, 1719 bp, Neurospora crassa
  CDS (1)..(1719)
atgtccgacatagaaaaagggtcagcgggctcccacgacaaggagacccgcgtcgacgcggccactcttcccgcctatgaggccggcagcgtcgccgaggcgcaacaggaggacttcatgacgcgcaacggtctcaacctcgcctccttcaagccccgccggttccacacgggcgacggcaccgagatcgagcgcaccatgaagtcccgccacctgcacatgatcgccattggcggctccatcggcgccggtttctttgtcgggtccggcaaggcgctgcacaacggcgggccggcgtcgctgctgattgatttcgccatcatcggcgtcatgatgttcaacgtcgtgtacgccctgggtgagctggctgtcatgtttcctgttaccggtggcttctacacctactcgactcgctttatcgatccgtcttggggtttcgccatgggttggaactatgttttccagtgggcgattgtcttgcctctggaacttaccgtttgcgggtttacggtcgggtactggaatcaggacataaccgtctggatcaccatcttcctcgtcgccatcatcatcatcaacgtcttcggcaccctcggctacgccgaagaggaattctgggcttcggcattcaagctcggcgccaccattgtcttcctcatcatctgcctcgtcatggtcctcggcggcggtcccaaaggcagccgctacgaccactacaccggtgccgccctgtggtactcccccggcgccttcgccaacggctttagggggttctgctcctgcttcgtcactgcggcttttgccttttcgggcaccgaactcgtcggtctcgctgctgccgaggccaaaaaccccgtcaagtcccttcccggcgccatcaagcaagtcttttggcgcatcaccctcttttacatcctcggtctcttcttcgtcggcttgctcatcccctatgacgacgagaacctgttgggcgctaacccgttcatcaacgtcaacgcctccccctttgtgctggtgggcaagtacgcgaacctgacgggcttcgactcgttcatgaatgtggttattctggtgtcggtcctctcgctcggtgtctcgtgcgtctatggtggctcgcgcaccttgactgccctcgctcagcaggggtacgcgcccaagatctttacgtacgttgatcgttccaaccgcccgctgttctcggtcctgctcattattgcgtttggccccctggcgtatgtcaacttggcggctgctggtccgaccgtgttcgattggttgctttcgctttccgggctggcggcgctgttcacgtggggatcgatttgcttgagccatattcgctttcgcaaggcgtgggcgctcaagggacatagtgtggaggagatcccgttccgggctgcgggcggtgtgtggggatcgtggctggggttggtgttggttgttttggtgttgattgctcagttctacgtagccatctgcccacccggcggcggcttcaacacggtcgagggcttcttcgtgcagtacctcgccttgcccgtcgtcatcgtcttctggatcggtggattcatctggaagcgcacgagctggctccgcgttgatcagatcgatgttgacacgggccgtcgcgaacatgattgggagtcgattaatgcgtaccaagctgagttggctgctatgcctgcttggaagaggtggttccataagttgtttgtctga

SEQ ID NO: 9386 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAIVLPLELTVCGFTVGYWNQDITVWITIFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEAKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 9387 - DNA, 1470 bp, Clostridium perfringens
  CDS (1)..(1470)
atgagtcaagaacaaaatactaatctaaaaagaggcttgaaatcaagacatcttagcatgattgccatgggtggtgccataggaactggtattttcttagccatgggagatacacttcatcaagccggtgtaggaggagcttttgtagcttacggaatcataggagtaatggtatatttcttgtgtacaagcttaggggagatggcaacatatatgccagaaacaggttcctttggagcttatgcaacaaaatttgttgatcctgctttaggatttgctctaggatggaattactggtataactgggctataacaatagcagcagaaatggttgcaggttctttattaatgaagttttggtttcctaatattccagcaatagtttggagcgcattattcttagtaattatattaactcttaatttattatctgccaaagcttatggagaatcagagttttggtttgcagctgtaaaagttgctactgttataatattcttaatcgtaggagttcttatgatttttggaatattaggtggagataatgtaggattcaaaaacttctatgaaaatggagggccatttattggaggagcaaaatcaattttcatgatctttttaatagctggtttctcatttcaaggaactgaattagtaggggttgctgctggagaaagtgaagatcctgaaaaaaatgtacctaaggctgttaatacaatattttggagaatcttattattttatttaggaacaattttagtaataggtgctttagtgccaaatgctcaagcaggagtagaaacaagtgcatttacaatagtatttgaaaaattaggattagctggagccgcttctattatgaatgctataatacttacatccgttttatcagctggtaactctggtatgtatgcatcgagtagaatgctttatgctatggctaaaaatggaatggcacctaagatttttgaaaaaactaattctagaggagtaccagttaatgctattataataacaacaataattgcaagtttatgtttcttaacaggtatttatgccgaaaatacagtttatgtatggcttgtagcagcctcaggattatcaggatttatagcttggcttggaatcgcaatatgtcattatagatttagaaaagcttatgtagctcaaggtaaagatatgagtagattagtttataaagctaaattattcccactagggcctataatagctttaatattatgtggaataatagttttaggtcaaggatatgcatacttagatgttagaaatggagtagactggggtggattaatttcatcttatattggattacctctattctttggattatttgcatattataaaattaaatataaaactaaaataatagacttaaaagatgttgacttaagtgtagagcatatagatactgatgagagtatagaagatgaagtattttcttactaa

SEQ ID NO: 9388 - protein, 489 aa, Clostridium perfringens
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 9389 - DNA, 1539 bp, Ralstonia solanacearum
  CDS (1)..(1539)
atgtcagaacacaccaccgcgtccgccgggacgccgggcttgcgccggactttgcgtgcgcgccacctcaccatgatcgccatcggcgggtcgatcggcaccgggctgttcgtcgcctcgggcgcgtcggtgtcgcaggccggccccggcggcgcgctggccgcctacgtgctgatcgggacgatggtctactttctgatgaccagcctcggcgagctcgccgcctacatgccggtgccgggctcgttcgccacctacggcgcgcgctacgtggacgaaggcttcggcttcgcgctgggctggaactactggtacaactgggcggtgacgatcgcggtggagctggccgccgcgcagctggtcatgcactactggtttcccgaggtgccgggcgtgctgtggagcgcgggcttcctggcggtgatgttcctgctcaacgcgatctccgtgcgcggcttcggcgaggcggaatactggttcgcgctcatcaaggtcgtcaccgtgctgtgcttcatcgcgatcggcctggcgatgatcttcggcatcatcaagggcgcgccggcatcgggcctgcacaacctgaccctcggcgaggcgccgttcgtgggcgggctgccggcgatgatcggcgtggcgatgatcgccgggttctcgttccagggcaccgagctgatcggcgtggcggcgggcgaatcggccgacccggcgcgcaccattccgcgcgcggtccggcaggtgttctggcgcatcctgctgttctatgtgctggcgatcttcatcatcggcgcgctggtgccgtacaccgatccgaacctgctgtcgacggaggtcgccaacatcggcgtgagcccgttcacgctggtcttccgccatgccggcctggcctttgccgccgggctgatgaacgcggtgatcctgacggcggtgctgtcggcgggcaattcgggcatgtatgcgtccacgcgcatgctctacaacctcgccaccgaaggccgcgcgccgcgcctgttcgcgcggctatcgaagaacggcgtgccgcgcaatgcgctgctggccaccaccgccgtgggcgcgctgtgcttcctgagctcgctgtacggcgacaagaccgtctacctgtggctgctcaacacctcgggcatgaccggcttcgtcgcgtggctgggcatcgcgatcagccattaccgcttccgcaagggcctggtgctgcagggccacgacccggcgctgctgccctaccgctcgccgttctttccgtacggcccgctgttcgcgttcgggttgtgcctggtcatcaccctgggccagaactaccaggccttcgccagcggccgggtcgactgggccgaggtgaccgccacctatatcggcatcccgatcttcttcgcggtctggctaggctaccggctggtgcgcggcggcggcatcatccgctaccaggacatgcgcttcccgcgcccgcccgtcacgcgcgacccgccgggcgaagcgcccgccgcccccgggctgccggccgccgcgacgagcccgcagcgttga

SEQ ID NO: 9390 - protein, 512 aa, Ralstonia solanacearum
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 9391 - DNA, 1530 bp, Ralstonia solanacearum
  CDS (1)..(1530)
atgcatacaccgatcacccccaccggcctcgagggccagtccgaactgcgccggcgcctgcgcgcgcgccacctgacgatgatcgccctcggcggcgccatcggcaccgggctgttcgtcgcctccggcgcctccatcgcgcaggccggcccgggcggcgccctgttcacctacacgctgatcggcgtgatggtctactgcctgatgacgagcctcggcgagctggcggtgcacctgccggtgtcgggctccttcgtcacgtacagccggctgtacgtggaggaagggttcggctttgcgctggggtggaattactggtttgcgctggcggtgtccgtggcggtggagctggcggcggcgcagctggtgatgaagtactggttccccggcgtctcgggcatggtctggagcgccgccttcctgctgctgatgttcgtgctcaacgcgttctcggtgcgcggcttcggtgaggcggaatactggttctcgatgatcaaggtggtgaccatcgtcgtgttcctgctgatcgggctggcgatgatcttcggcatcatgaaaggcgggccgcagtcgggctggcacaacttcacggtgggcgacgcgccgttcgtgggcggactgcctgcgatgatcggcgtggcgatgatcgccgggttctcgttccagggcgtcgagaccatcggcgtggccgccggcgaggcggagaaccccgcccgcaccattccgcgcggcatccgccagaccttctggcgcatcctgctgttctacgtgctggcgatcctgatcatcgccgtgctgctgccgtacaccgatccgaacctgctgcgcaacgaggccaccgacatcggcgtaagcccgttcgcgctggtgttccagcatgccggcctcgccttcgccgccggcatgatgaacgcggtggtgctgaccgcgctgctgtcgtccggcacctcgagcctgtatgtctcgacgcgcatcctctacgacctcgcgcttgaaggccaggcgccgcggtggttcgccagggtctcgggcaacggcgtgccgcaccgggcgctgctggccacctcggcggtgggcgcgctgtgcttcttcagctcgctcttcggcgaccaggtcgtgtacctgtggctgctcaatacctcggcggtgacgtgcttcatcgcctggttcggcatcgcgctggcgcactaccgcttccgcaagggctttctgcatcagggccacacggtcgatcagctcgaataccgctcgcccttcttcccgttcgggccgatcctggtggccgccctgtgcgtgatcatcatcctcgggcagaacaccaaggcgctgttcgcgccgatcgacaacttcggcgccttcgtcgccacgtattgcggggtgtttctgttcgtggcgatctggctggggtaccggtggcgctacaagacgcggtttgtgcggtacgagcagatgcagttcagcccgcggcacatccgggcggcgcaggccggggatggcggggccgcgctgccgggcgtggccgcggattag

SEQ ID NO: 9392 - protein, 509 aa, Ralstonia solanacearum
MHTPITPTGLEGQSELRRRLRARHLTMIALGGAIGTGLFVASGASIAQAGPGGALFTYTLIGVMVYCLMTSLGELAVHLPVSGSFVTYSRLYVEEGFGFALGWNYWFALAVSVAVELAAAQLVMKYWFPGVSGMVWSAAFLLLMFVLNAFSVRGFGEAEYWFSMIKVVTIVVFLLIGLAMIFGIMKGGPQSGWHNFTVGDAPFVGGLPAMIGVAMIAGFSFQGVETIGVAAGEAENPARTIPRGIRQTFWRILLFYVLAILIIAVLLPYTDPNLLRNEATDIGVSPFALVFQHAGLAFAAGMMNAVVLTALLSSGTSSLYVSTRILYDLALEGQAPRWFARVSGNGVPHRALLATSAVGALCFFSSLFGDQVVYLWLLNTSAVTCFIAWFGIALAHYRFRKGFLHQGHTVDQLEYRSPFFPFGPILVAALCVIIILGQNTKALFAPIDNFGAFVATYCGVFLFVAIWLGYRWRYKTRFVRYEQMQFSPRHIRAAQAGDGGAALPGVAAD

SEQ ID NO: 9393 - DNA, 1410 bp, Salmonella typhimurium
  CDS (1)..(1410)
atggtagatcaggtaaaagtcgcagccgacgaacaggctccggctgaacagtcgctacggcgcaatcttacaaaccgtcatatacagcttatcgctattggcggcgctattggtaccggtctgtttatgggatcgggtaaaacgatcagtctcgccggaccgtcgatcatttttgtgtatatgatcatcggttttatgctttttttcgtgatgcgcgccatgggggaattgctgctctcgaatctggaatataaatcgtttagcgattttgcttccgacctgcttggcccctgggcgggatatttcaccggctggacgtactggttttgctgggtagtgaccggtatggctgacgtggtggcgattaccgcctacgcgcagttctggtttcccggcctttccgattgggtcgcctcgctggcggtagtgatcctgctgctaagcctcaacctcgccaccgttaaaatgtttggtgaaatggaattttggtttgctatggtcaaaatcgtcgccattgtggcgttgattgtggtcgggctggtgatgattgcgatgcactttaaatcgccgacaggcgttgaagcgtctttcgcgcatctgtggaatgacggcggctggttcccgaaaggtattagcgggttctttgccggtttccagattgcagtgttcgctttcgtgggcattgagctggttggtactaccgccgcagaaactaaagatccggaaaaatcgctgccgcgcgcgattaactcaataccgatccgtatcatcatgttctacgtctttgcgctgattgtcattatgtcggtgacgccgtggagttccgtggtgccggataagagcccgtttgttgagctgtttgtactggtgggtctgcctgccgctgcgagcgtgatcaactttgtcgtgctgacctcggcggcgtcttccgccaacagcggcgtcttctcgaccagccgtatgctgtttggcctggcgcaagaaggcgtggcgccaaaagcgttcgctaagctatcgaaacgcgcggtaccggcgaaaggcctgaccttctcctgtatctgcctgctgggcggcgtggttatgctgatggtcaacccgagcgtgattggcgcattcaccatgatcactacggtttcggccatcctgtttatgtttgtctggaccatcattctgtgttcatacctggtgtaccgcaaaaagcgtccccacctgcatgaaaaatccatctataagatgccgctcggtaagctgatgtgctgggtctgcatggcgttctttgcattcgtgctggtattactgacgctggaagacgatacgcgccaggcgctaatcgtgacgccgctgtggtttatcgcgttgggtctgggctggctgttgataggtaagaaacggatggcgggaatgcgttaa

SEQ ID NO: 9394 - protein, 469 aa, Salmonella typhimurium
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVILLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLLIGKKRMAGMR

SEQ ID NO: 9395 - DNA, 1407 bp, Salmonella typhimurium
  CDS (1)..(1407)
atggataccctgcaacaatctccgccagcagagcctgaaggcggtctgcggcgtaacctgaagaagcggcacctgctgatgatgtcgctgggcggcacgattggcaccggcttatttatcggcattgccgaaccgttaagcagcgtcgggccggcgggaaccttactggcctatctgtttgccggaaccattatgctggcgacgatgatgtgtcttggcgaattatcatgcgcctttcctcactccggttcatttcaacattacgcgctgatgtttatgccgtcaccttgctggagctataccattggctggctttactggtttagctgggtcttttccctggcggccgacctcactgccgcagggtttattgctcaccagtttttccccgcggttccggtatatatgttctgcctggcgattctgctcatcctgacggccatcaatctcacctccgcaaaaagttttggcgaatgcgaatactggctttcggccattaaggttttcgcgatcgtgctgtttatttgcgcgggcggggttatgatctactcgctaatgggccatagtgactggcacccgacgttaaaaacagacggaatgtggtttccccacggttgggagcaaattgtggtttatatgacgatcgtgatttactccttccagggggtggaactggtaggaaatgcggcaggggagaccgaatcgccgcacattattttaccgaaagtgatcctggggatcggtctcagaatcattttgttttacggcctggcgattgcggtgctggcgctggtctatccgcatgaactgacgccaaatggacaaagtccctttgtatgggtattctcccacgcgggcattccgggggcggatacgctgatgacgctggtgatcttttccgccgcggtttctgccgctaactcggccatttacgccagttcgcgtatgctgtggtctatggcgggcgatcgctttgcgccagcctgctttggtaaaacgaacggcggcggcgtgccggtgtatgctattttaatcacggccttgttggcgttagtgtcgttgctgacccgctatattcccgcacagcaattttatttatatctgatcgccagtaccgggcaggtgggttgcctggcatggataaccatcggatggtgccagtatcgcttccgacaatcggtgcgtaatggaacgtacgccagcgatttgctacgctatcgatcgccgcttttcccctggacggcccgatttgtcattatcaccaattttgccattatggtcggcacctggtttagtgagcagggggtagtgataatgttggttgagctggcttttatgatagggattcttttgtcatggtatctcttcagacccactttgagccgattacgtaacacagtgggatga

SEQ ID NO: 9396 - protein, 468 aa, Salmonella typhimurium
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVYMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGTWFSEQGVVIMLVELAFMIGILLSWYLFRPTLSRLRNTVG

SEQ ID NO: 9397 - DNA, 1410 bp, Staphylococcus aureus
  CDS (1)..(1410)
atggcaagaaaattgcatagagagttgaataacagacacatccaattaatagcaattgggggcgcaattggaactgggttattcctaggatcaggtcaaacaatatctttaactggtccatcactgttattcacatacatgattattggggttgtactattcgcttttatgcgcgcattaggcgaattgttgttgagcaatacaagatttaattcatttgttgatattgcaaatgaatatttaggcccttttggtggctttgtcattggctggacttactggttatgttggattgtatcaagtatgtcagacctaactgcgatgggacaatactttgcattttggtatccacaagtcccaaattggattaccgtgctatttattgttttaatcttgattagcttcaacttattaggtgccagattatttggtgaactggagttttggttctcgattattaaagttgtcacaattattgcgatggttatcgttggtcttgtattaatctttttctcatttaaaacacattatggacatgcatcattcacaaacttaatcagtcacggtggcatgttccctggtggaacatttggtttcttaatgtcattccaaattgctgtatattcattcattggtattgaacttataggtgtaactgctggtgaaacgaaagatcctgaaaaaaccttaccgaaagcaattaataatgtacctatccgtattttattattctatatcggtggtctattagtaattatgtcagtcataccttggaatgatatcgatccaaatagtagccctttcgttaaactctttacattaatcggcgtaccatttgcagcaggtgtcgttaactttgtcgtgctaactgccgcggcctctgctacaaatagtggtatctattcgaatagtcgtatcttattcggactgtcacaacaagggttaggtcctaaagttttaaataaaacgaatagtcatggcgtgccttatttatcaatgttagtttcatcaattgcattacttatagcagccttgttaaactacattttccctaatgcaattcaactattcatatacgttacaacgttatcaactgtgttgtttttagttgtttgggcaatgattattgtcgcttatctaatgtatttgaaaaagcatcctgaggcacataaaaacagtaaatttaagttgattggtggtaagcctattgcttacattattctagcgttcttcttctttgtattcattttattattctttagtgacgaaacaagagcagctatttatatttcgccattctggtttatatttttatttttcttttataaaaaatacaaaacgaatgctgaaaagctcgcgtatgaacaacgacaaaatgacagcggtcatttcagatatgacaatcaatag

SEQ ID NO: 9398 - protein, 469 aa, Staphylococcus aureus
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNKTNSHGVPYLSMLVSSIALLIAALLNYIFPNAIQLFIYVTTLSTVLFLVVWAMIIVAYLMYLKKHPEAHKNSKFKLIGGKPIAYIILAFFFFVFILLFFSDETRAAIYISPFWFIFLFFFYKKYKTNAEKLAYEQRQNDSGHFRYDNQ

SEQ ID NO: 9399 - DNA, 1455 bp, Staphylococcus aureus
atggaagataataaaatgaaccgtagtcttaactcaagacacatttccatgattgctataggtggtgcaattgggactggtctatttgtagctactggtaatatcatttctcaagctggtcctggaggcgctatactcgcttatcttgttattggtgtcatgctatatttcttaatgtcatcaattggagagttggcaacattttatccagtatcaggttcattcagctcttattcaacacgctttattgactcatctcttggctttaccatgggatggttgtattgggcattgtggtcattagttacaagtgttgatgtcatagtagcgtcaaatgtgctttatttctgggacacatttaaatttttccaccccattacttggagcttaatctttattacaattttactattattaaacattttttctgtaaaatcatttggagaaactgagttttggttatcattgattaaagtgttaacaattatcgtattcgttatttttggctttttaatgattttcggtatcttaggtggtcatacatatggatttgaaaactatacaaaaggccaagcaccgtttgttggtggtatctctggtttcttaggcgtattattagtcgccggattttcggttggtggtacagaagtagtagcagtaactgctggtgaatcagatgaccctaaaaagtctatgcctaaggcaattaaacaagtattttggcgtattcttttattctatgtcttatcaattgcagtaattggtgcaattattccgtacacagatccatcattattaagagcaagtagttcaataagtcaaagcccatttacaattgtattcgatagagtaggcatagcctttgcagcatcagtaatcaacgcggttattttaacttcattattatccgctgcaaattcaggtgtttatacaacaggcagaatgttgtattccttaagttcagacaaaaaagcaccccaatttttaagtaaattaaacaagacaactaagttacctttaagagcattattaactacttatgcagtcgttgttattgttattatttatgcaaactttaattcaaatgccgtttttaatttacttgaaattattggttcaatgattatagttgtttggggatcaagcatttggtcacaaatacgattgcgacaagctattaaaaaacaaggtcaagaccctaataaggtcctaccatataaagcacctttttatccattaggaccaatcattgtcatcactacactattattcttgctatttggtggctcagttgaatatattttaaaagatcaatggttaaatgcttttaaaaactttttacctttaatcattctagcgttgatttactttattcataaaatcattcacaaaacaaaatttgtaaagctagaaacaattaatttaaaaccacacgattatgacaatcaaaactaa

SEQ ID NO: 9400 - protein, 484 aa, Staphylococcus aureus
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 9401 - DNA, 1659 bp, Uromyces fabae
  CDS (1)..(1659)
atgagctcggacgatgtgaaggctctgggaggcgacctggagaaggcgcactctatcatggatcaagaattcgtaactgaaaaaggcaatggtactatcactgaagacaagcaagatggtcagatgcaaagacatctaaaaccacgtcacatgtcgatgatagctattggcggtactatcgggacgggattgtttattggatccggacaaggtcttaaccaaggtggcccggtaggccttcttctaggttatagcaccatgggcatcgttgtctacagtgtgatggtttcacttggcgagatggtaacaatgtttccgattactggctccttcgtgcattacgcttcccgattcgttgacccagcattagggtttgctcttggatggaactattggtattgttatgccattactttacctactgaaatcaccgctgcagggattgtgattcaatattggacaaaaagtgtgaatgtggccgtatggataacaattttcctagtggcttcatgcggtgtaaatttatttggagtcagatggtacggggaggcagaattttggtgttccgctgtcaaagtaattgctatcgtttgcttgattatacttggcattatcattgatttaggtggcggtccaaatcatgatcgaattggatttagatactggatttctcctggcccattcaatcaattgaatggcattcctggttccactggtcgattcctcgccttctggtcggtctttattcaagcatctttttcatatcaaggcacggaaatcgtagctttggcagcaggggaagctctcaacccgagaaagaccatccccaaagccatcaacagggtcttttatcgtatcctattattttatgttggtggtgtgactgtgataggattgctggtgccctacaattcaccagatttgcttggtggtactggagatgccacttcatccccatttgtgattgccatcaagtctgcaggtatctcagtgctgccagatgtgctgaatgctgtcattttggcagttgtattttcagcagctaattcagatttgtatgctgcctcaagaatgacgtttggtttagctactgatggaatggcgccagcaatattctcccgttgtacaagcaacggtttacccatcgctggattgatcctcactattggatttggtttgctagcctacatgaatgttaattcttctaccggaacagttttccagtggctcgcaaatttctcttctgtgacaggacttctaacgtggtggtctatctctcttgcctacatcaggttttaccacggcttgatacatcacaaaatagaccgcaatacctttgcatacaaggctccttaccaaccatggctctcttacttttctattactatgtctactttaatcatcttcttcaacggttttgaggttttcatgagcggaagttggtcaacttcgaagtttgtatcggcatatctttctattccaatgtttatcgtcttctttataacatggaagatctatcacaagactgcttttgttaaaattgatcagatggactttgtaacgggaaaacgcgaattcgattcaatggaacaaattgagagcgagaaagaagttgagccagttggcaaatttgcacaatttcttgaatggttaatgtag

SEQ ID NO: 9402 - protein, 552 aa, Uromyces fabae
MSSDDVKALGGDLEKAHSIMDQEFVTEKGNGTITEDKQDGQMQRHLKPRHMSMIAIGGTIGTGLFIGSGQGLNQGGPVGLLLGYSTMGIVVYSVMVSLGEMVTMFPITGSFVHYASRFVDPALGFALGWNYWYCYAITLPTEITAAGIVIQYWTKSVNVAVWITIFLVASCGVNLFGVRWYGEAEFWCSAVKVIAIVCLIILGIIIDLGGGPNHDRIGFRYWISPGPFNQLNGIPGSTGRFLAFWSVFIQASFSYQGTEIVALAAGEALNPRKTIPKAINRVFYRILLFYVGGVTVIGLLVPYNSPDLLGGTGDATSSPFVIAIKSAGISVLPDVLNAVILAVVFSAANSDLYAASRMTFGLATDGMAPAIFSRCTSNGLPIAGLILTIGFGLLAYMNVNSSTGTVFQWLANFSSVTGLLTWWSISLAYIRFYHGLIHHKIDRNTFAYKAPYQPWLSYFSITMSTLIIFFNGFEVFMSGSWSTSKFVSAYLSIPMFIVFFITWKIYHKTAFVKIDQMDFVTGKREFDSMEQIESEKEVEPVGKFAQFLEWLM

SEQ ID NO: 9403 - DNA, 1758 bp, Schizosaccharomyces pombe
  CDS (1)..(1758)
atgaatgcttatgttagggattctgaatccgtatattcagaatcgtatcctcccgaaaacttcataagtaatgaacccgagaaatcaaaagataaagacaatttcaacggcgaagaagtcatttcttatgtcggtgaggtcgaaacagtccctgccaaagaagagaatgtatttcgacgattcattaatggatttaaaattgaaaaaaaccaacaagattctgccggacaaggactaaagcgtcggcttaagagtcgtcatattcaaatgatcggtattggtggagctattggtaccggtgtttgggtgggaagctctaaatctctttatagggggggagcagcgtcagttttaattgactactgtattgttggaactatggttttttgtactgtttatgctttaggagaattagctgttgcctttcctacgcggggaagttttgttacacatgctacgcgattcatcgatgaatcatggggctttgcacttagttggaattatgtattctcgttcattgttacgattccattagagttgacgacaggaacaatgatgatcaaatattggaccaatctaaacagtggtatatgggtgacagttttcatcgtgttcctattttttattaatatctttggagtaaaaggatatggtgaaatggagtttatcatgtctactatcaaagtggttgcaatgtgtggttttatcattcttggtatcattattgattgcggtggtgtaccaactgatcatcgaggctatatgggaacacatattttccgcgaaaatgcttttcgccacaaatttaaaggattttgcgctgtatttaccagtgctgcattttctttttccggtactgaatatgttggtgtcgcagcagctgaaacagagaaccccgcgaaggcctttccggttgcagtaagacaaacgctattcagaatagcaatattctacatactttcacttttcattgttagtttactcattagtggtgctgaccctcggttaacttcataccatggagttgatgcaagtccatttgtgctagctattaaagatgctaacatcaaagcgttaccttcaattctgaatgccattattttgatctccgtaatctcttctgctaatgctcagttgtacgctggaagtcgcgcaattcattccttagggtgtaatggctttgctcctaagtgttttacactggttgatcgtgaaggtcgacctctcgttgctcttcttattttgttcttgtttatgtttttaggttaccttgtcgaaacaggacaatatgacactgtatttgactggatgctgtcgatttctggtttgggtacattattttgctggggcagtatatgtctagcacatattcggtatagagccgctatgaaacatcaaaacaggagcctcaaagaggttggatttgtctctccatttaatgtttatgcttcctattatgcttttatactagtttgcttagtgttggctgcagaattttatgtctccattttccctgttggcggtaaaccagatgccagtgcattttttgaaaactatttatctgctcctgtaattctagttttttttatatgccacaagctttattacaaaaccaaacgaattactctttcaaatatggatttggaaactgattttgcatacaaaactccagtggaagaagaagaagaagaagagaagagtgctggttccctaagtatcaaacaaagaatgaaaaagctatctgatatgatgtgctaa

SEQ ID NO: 9404 - protein, 585 aa, Schizosaccharomyces pombe
MNAYVRDSESVYSESYPPENFISNEPEKSKDKDNFNGEEVISYVGEVETVPAKEENVFRRFINGFKIEKNQQDSAGQGLKRRLKSRHIQMIGIGGAIGTGVWVGSSKSLYRGGAASVLIDYCIVGTMVFCTVYALGELAVAFPTRGSFVTHATRFIDESWGFALSWNYVFSFIVTIPLELTTGTMMIKYWTNLNSGIWVTVFIVFLFFINIFGVKGYGEMEFIMSTIKVVAMCGFIILGIIIDCGGVPTDHRGYMGTHIFRENAFRHKFKGFCAVFTSAAFSFSGTEYVGVAAAETENPAKAFPVAVRQTLFRIAIFYILSLFIVSLLISGADPRLTSYHGVDASPFVLAIKDANIKALPSILNAIILISVISSANAQLYAGSRAIHSLGCNGFAPKCFTLVDREGRPLVALLILFLFMFLGYLVETGQYDTVFDWMLSISGLGTLFCWGSICLAHIRYRAAMKHQNRSLKEVGFVSPFNVYASYYAFILVCLVLAAEFYVSIFPVGGKPDASAFFENYLSAPVILVFFICHKLYYKTKRITLSNMDLETDFAYKTPVEEEEEEEKSAGSLSIKQRMKKLSDMMC

SEQ ID NO: 9405 - DNA, 1752 bp, Schizosaccharomyces pombe
  CDS (1)..(1752)
atgtcgtcgccagatcgctctattgacattgaccttgaaaaatatccttcaacggctaccaagtccgtctacggccaatcgaaggatgataaaaatgttttcgacattcatcccaccgaatccgaagtcatccccggtgaagtcgagtatgctgatactccttcccatcaaaatttcttgcaaaagttttttagcgacttcaaacccgttaaagccgaccgcgaggatggtgtcgcattaaagcgtcatctgaaaggtaggcatatgcaaatgattgccattggtggtgctattggtactggtttgtttgtgggttctggtagttcacttgctgatggtggaccggcttctgttattatcgattatactttgattggtattatgatgttctttactgtctatgctttaggtgaacttgctgtttcttatcctgtcgctggtggtttctataattacgcagttcgttttatcgatccagcctggggctttgccgttggttggaactatttcatgaattatttcgttacatttccactggagttaactacttgtgccatcactttccgctactggacagacattaatagttgtgcttggattacgattttcttggtatttgttatatgtatcaatcttttcggtgttagaggttatggtgaagttgaatttattctatctacgctcaaagttgttgccactactggttttattattttggctattattattaattgcggtggtgttcctactgatcctcgtggctacatcggtggtaaaattattaaaaacaaacctttccgtcatagctttaaaggtttttgttccgtgtttactactgccggtttctccttctcaggtactgaagttgttggtttagctgctgctgaagctgaagatcctcaaaagtctctccctcgtgctaccaaacaggtcttttggcgtattgctattttctacgtcgtatctttaattttaattggtctgcttgtttcaccagatgatcctcgtttgatgggtaatagcagcgatggtagtacctctcccttcgtgttggccattaaagaagcaaacatcagaggccttccttccgttttcaatgcagtaattatcatttctaccgtctctgttgcaaattcttgtactttcactgctagtcgtactcttcatgctatggccgctaaaggtgacgcacctcgcttctttgcatatactgatcgtcttggtcgtcccctcctcgctatggctgtttgtttgttgtttggattttttgcatatatcaatgccgccggtgatgttagtgacactgttttcgattggttattggctatttccggtatctcaaacttcttctcatggggcagtattaatctttgccatatcgtcttccgtcttgctatgaagaaacaaggccgttctttggatcaacttggatttgtatcacctatgggtatttggggttctgctattggattggctttcaacattttgtgtcttatggccgaattctatgtatctttgttccccatcggttcaaagccaaatgctaacgattttttccaaggatatcttgctgctccaattgtgattgctttctttattggctacaaaatttatgatagaagtcatattccctcattgagtaaacttgatttagacacgggacttcgtacctatcctccaaaagataaagaatctgagaaaattcgtgatgcgaagggtttctttaagtggatttggcaatctctttgctaa

SEQ ID NO: 9406 - protein, 583 aa, Schizosaccharomyces pombe
MSSPDRSIDIDLEKYPSTATKSVYGQSKDDKNVFDIHPTESEVIPGEVEYADTPSHQNFLQKFFSDFKPVKADREDGVALKRHLKGRHMQMIAIGGAIGTGLFVGSGSSLADGGPASVIIDYTLIGIMMFFTVYALGELAVSYPVAGGFYNYAVRFIDPAWGFAVGWNYFMNYFVTFPLELTTCAITFRYWTDINSCAWITIFLVFVICINLFGVRGYGEVEFILSTLKVVATTGFIILAIIINCGGVPTDPRGYIGGKIIKNKPFRHSFKGFCSVFTTAGFSFSGTEVVGLAAAEAEDPQKSLPRATKQVFWRIAIFYVVSLILIGLLVSPDDPRLMGNSSDGSTSPFVLAIKEANIRGLPSVFNAVIIISTVSVANSCTFTASRTLHAMAAKGDAPRFFAYTDRLGRPLLAMAVCLLFGFFAYINAAGDVSDTVFDWLLAISGISNFFSWGSINLCHIVFRLAMKKQGRSLDQLGFVSPMGIWGSAIGLAFNILCLMAEFYVSLFPIGSKPNANDFFQGYLAAPIVIAFFIGYKIYDRSHIPSLSKLDLDTGLRTYPPKDKESEKIRDAKGFFKWIWQSLC

SEQ ID NO: 9407 - DNA, 1473 bp, Rhizobium etli
  CDS (1)..(1473)
atgacagtcatggaatccaccagaaccgaggccgatggccaagttttcgccgaggaagaccttggttatcacaaggcgctgaagccgcggcagatccagatgatcgccatcggcggagccatcggcacggggctgttcctcggggccggcggccggcttgccgctgccggtccggcacttgtgctggtctatgccttgtgcggctttttcgccttcctcgttctgagagccctcggcgaactgatcgtccatcgcccgacctcgggctcgttcgtatcctatgcccgcgaattttacggcgaaaagctcgccttcgcagtcggctggatgtattggctgacctgggcgatgacggcggtcgccgacgtcaccgcggtcgccctctacatgaatttcttcaaggcctatgtcccgtggatcgcgatgatcgatcagtgggtgttcgcgttcgcggcgttggtcctcgtcctctcgatgaaccttttgtcggtgaaggtcttcggcgaactggaattctggttcagcctcgtcaaggttctcgccctcctcatcttcctgatcgtcggcgtctacttcgtcgtcaccggcacgccgatcgacggccatgtcccgggcctgaacacgatcaccgatttcggcggcatgttcccgaacagcgtcctgccggcgctggtggtgatacagggcgtggttttcgcctatgcctcgatcgagctgatcggcaccgccgccggggaaaccgaaaacgcccgcaaagtcatgccgcgggcgatccgcactgtcgtgctgcgcctggtcgtcttctatgttggctcggtcctgctgctgtcgctgctgctgccctacaccgcctataagggcggcgagagcccgttcgtcaccttcttcggcaagatcggcatccagggcgccgacgtcgtcatgaacctcgtcgtgctgaccgccgtcctctcgtcgctcaacgctggcctctattcgacgggccgcatcctgcattccatggccgtttccggctcggcgccggcggcgctggcgaagatgaaccggtcgggcgtgccctatggcgggattgcggtgacggctgtcgtgaccgccttcggcgtcgtgctgaacgccgtcgttccggcggaagccttcgagatcggcctgaatgtcgccgccctcggcatcatcgcggcatggggcgttatcgtcctgtgccagctcaagctttggcagctgtcgcggcagggcaagctggcgcggcctgaattccggatgttcggcgcgccttataccgggctgctgacgttgggcttccttgccatcgtcgtgatcctgatggccctcgattatccggtcggcacctatacggtcgcctccctgctgctgatcattccggcgctggtggtcggctggctactgatgcgtgagcgcatccacatgatagccgccgaacagggcgatgagcgcggcggtttcgatctggcctga

SEQ ID NO: 9408 - protein, 490 aa, Rhizobium etli
MTVMESTRTEADGQVFAEEDLGYHKALKPRQIQMIAIGGAIGTGLFLGAGGRLAAAGPALVLVYALCGFFAFLVLRALGELIVHRPTSGSFVSYAREFYGEKLAFAVGWMYWLTWAMTAVADVTAVALYMNFFKAYVPWIAMIDQWVFAFAALVLVLSMNLLSVKVFGELEFWFSLVKVLALLIFLIVGVYFVVTGTPIDGHVPGLNTITDFGGMFPNSVLPALVVIQGVVFAYASIELIGTAAGETENARKVMPRAIRTVVLRLVVFYVGSVLLLSLLLPYTAYKGGESPFVTFFGKIGIQGADVVMNLVVLTAVLSSLNAGLYSTGRILHSMAVSGSAPAALAKMNRSGVPYGGIAVTAVVTAFGVVLNAVVPAEAFEIGLNVAALGIIAAWGVIVLCQLKLWQLSRQGKLARPEFRMFGAPYTGLLTLGFLAIVVILMALDYPVGTYTVASLLLIIPALVVGWLLMRERIHMIAAEQGDERGGFDLA

SEQ ID NO: 9409 - DNA, 1788 bp, Saccharomyces cerevisiae
  CDS (1)..(1788)
atgtcgtcgtcgaagtctctatacgaactgaaagacttgaaaaatagctccacagaaatacatgccacggggcaggataatgaaattgaatatttcgaaacaggctccaatgaccgtccatcctcacaacctcatttaggttacgaacagcataacacttctgccgtgcgtaggtttttcgactcctttaaaagagcggatcagggtccacaggatgaagtagaagcaacacaaatgaacgatcttacgtcggctatctcaccttcttctagacaggctcaagaactagaaaaaaatgaaagttcggacaacataggcgctaatacaggtcataagtcggactcgctgaagaaaaccattcagcctagacatgttctgatgattgcgttgggtacgggtatcggtactgggttattggtcggtaacggtaccgcgttggttcatgcgggtccagctggactacttattggttacgctattatgggttctatcttgtactgtattattcaagcatgtggtgaaatggcgctagtgtatagtaacttgactggtggctacaatgcataccccagtttccttgtggatgatggttttgggtttgcagtcgcttgggtttattgtttgcaatggctgtgtgtgtgtcctctggaattggtgaccgcatccatgactatcaaatattggacgacatctgtgaacccggatgtgttcgtcattattttctatgttttggtgattactattaatattttcggtgctcgtggttatgcagaagctgagttcttcttcaactgttgcaaaattttgatgatgactgggttcttcattcttggtattatcatcgatgttggtggcgctggtaatgatggttttattggtggtaaatactggcacgatccgggcgctttcaatggtaaacatgccattgacagatttaaaggtgttgctgcaacattagtgactgctgcttttgcctttggtggttcagagtttattgccatcaccactgcagaacaatctaatccaagaaaggccattccaggtgcggccaaacaaatgatctacagaatcttattcctattcttggctaccattattctactgggtttcttggtgccatacaattccgatcaattattgggttctaccggtggtggtactaaagcctcgccatatgtcattgctgttgcatcccacggtgtccgtgtcgtcccacacttcattaacgccgttattctactttccgtgctgtccatggctaactcctccttctactccagtgctcgtttatttttaactctatccgagcaaggttacgctcctaaggttttctcctacatcgacagagccggtagaccattgattgccatgggtgtttctgcattgtttgccgttattgccttctgtgctgcatctcccaaggaagaacaagttttcacttggttattggccatttctggtttgtctcagcttttcacatggactgccatttgtttatcccatcttagatttagaagagccatgaaagtccaagggagatctcttggagaattgggtttcaaatctcaaactggtgtttggggatctgcctacgcttgcattatgatgattttaattcttattgcccaattttgggtcgctatcgcccccattggtgaaggtaagctggatgcacaagcctttttcgaaaactacttggctatgccaatcttgattgcactttatgtcggctacaaggtctggcacaaggattggaaactgttcatcagggagacaagatcgacctag

SEQ ID NO: 9410 - protein, 595 aa, Saccharomyces cerevisiae
MSSSKSLYELKDLKNSSTEIHATGQDNEIEYFETGSNDRPSSQPHLGYEQHNTSAVRRFFDSFKRADQGPQDEVEATQMNDLTSAISPSSRQAQELEKNESSDNIGANTGHKSDSLKKTIQPRHVLMIALGTGIGTGLLVGNGTALVHAGPAGLLIGYAIMGSILYCIIQACGEMALVYSNLTGGYNAYPSFLVDDGFGFAVAWVYCLQWLCVCPLELVTASMTIKYWTTSVNPDVFVIIFYVLVITINIFGARGYAEAEFFFNCCKILMMTGFFILGIIIDVGGAGNDGFIGGKYWHDPGAFNGKHAIDRFKGVAATLVTAAFAFGGSEFIAITTAEQSNPRKAIPGAAKQMIYRILFLFLATIILLGFLVPYNSDQLLGSTGGGTKASPYVIAVASHGVRVVPHFINAVILLSVLSMANSSFYSSARLFLTLSEQGYAPKVFSYIDRAGRPLIAMGVSALFAVIAFCAASPKEEQVFTWLLAISGLSQLFTWTAICLSHLRFRRAMKVQGRSLGELGFKSQTGVWGSAYACIMMILILIAQFWVAIAPIGEGKLDAQAFFENYLAMPILIALYVGYKVWHKDWKLFIRETRST

SEQ ID NO: 9411 - DNA, 1500 bp, Escherichia coli
  CDS (1)..(1500)
atgagtaaacacgacaccgacacttcagatcaacacgccgcgaaacgccgctggcttaatgcccacgaagaggggtatcacaaagcgatgggcaatcgccaggtgcagatgatcgccattggcggcgcgattggcaccggcttgtttttaggtgcaggagcccgactgcaaatggcggggcccgcactggcactggtttatttaatttgtggcttgttttcgttttttattctgcgtgcattgggtgagctggtgctacaccgcccttccagtggcagttttgtttcttatgcccgtgagtttttgggtgagaaagccgcttatgttgctggctggatgtacttcatcaactgggcgatgacggggattgttgatattaccgccgtcgctctgtatatgcattactggggtgcgtttggcggcgtgccgcagtgggtctttgcgctcgctgcacttaccatcgttggcaccatgaatatgatcggtgtgaaatggtttgcggagatggagttctggtttgcgcttattaaagtgctcgccattgtgacctttttggtcgtgggtacagtgttcctcggtagtggtcagccgctggatggcaacaccactggctttcatttaatcaccgataatggcggcttcttcccccacggtttgctgcctgcgctggtgttgattcagggcgtagtgtttgcttttgcctccattgaaatggtgggtacagctgccggagaatgtaaagatccgcagaccatggtgcctaaagccattaacagtgtgatttggcgtattggcctgttttacgtcggctccgtggtgttgctggttatgttattgccgtggagcgcgtatcaggcggggcaaagtccgttcgtgacgtttttctctaaactgggtgtgccatatatcggcagcattatgaacattgtggtgctgaccgctgccctctccagcctgaattcaggtctgtactgcaccggacgtattctgcgctcaatggcgatgggcggttccgcaccgagttttatggcgaaaatgagtcgtcagcatgtgccgtatgccgggattctggcgacactagttgtgtatgtcgtcggcgtattcctcaactatctggtgccgtcgcgcgtatttgagattgtgttgaacttcgcgtcgctgggaatcatcgcttcatgggcgtttatcatcgtgtgccagatgcgcctgcgtaaagcgattaaagaaggcaaagcagcggatgtcagttttaaactgcctggcgcgcccttcacttcctggctgacattactgtttttactgagtgtccttgtgctgatggcgttcgattacccgaacgggacttatactatcgcggcgctgccgattatcggtattttgctggttataggctggtttggtgtgcgcaaacgcgttgctgaaattcacagcactgcgccagtcgtcgaggaagatgaagaaaaacaggaaattgtgtttaagcctgaaacggcgagttaa

SEQ ID NO: 9412 - protein, 499 aa, Escherichia coli
MSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 9413 - DNA, 1374 bp, Salmonella typhimurium
  CDS (1)..(1374)
atgatggacagtcagcagcacggcgagcagctcaagcgcggcctgaaaaaccgccatattcagcttatcgcattgggcggcgcgatagggacaggcttgttcctgggaagcgcctccgttattcagtcggcggggccaggaattatcctgggctatgcgattgcaggctttattgcctttctgattatgcgccagctgggggagatggtggttgaagaaccggtcgccggctcttttagccacttcgcctataaatactggggcggctttgccggattcgcttccggctggaactactgggtgctgtacgtattagttgccatggcggaactgaccgcagtgggtaaatatatccagttctggtatccggagatccccacctgggcttctgcggcagccttctttgtgattatcaacgccatcaacctgaccaacgttaaagtgttcggtgagatggagttttggttcgccattattaaagtgatcgccgtcatcgctatgattctgttcggcgcgtggttactcttcagcgataccgctggtccgcaggccaccgtgcgcaacctgtgggaacagggcggctttctgccgcatggctggaccgggctggtgatgatgatggccattattatgttttcgttcggcggactggagctggtagggatcaccgccgctgaagccgataacccggaacagagcatccccaaagccactaatcaggttatctatcgcatcctgattttttatatcggctcgctggcggttctgctttcgctgctgccatggactcgcgtcaccgccgataccagcccatttgtccttatcttccatgagctgggcgatacgtttgtcgccaatgcgctgaatatcgtggttctcaccgccgcgctatcggtttataacagctgcgtttactgcaacagccgtatgctgttcggtctggcccagcagggaaatgcgccgaaagcgctgctgaacgtcgacaaacgcggcgtgccggtgagctccattttggtttccgccgtcgtgactgcgttgtgcgtgctgctcaactacctggccccagagtccgcattcggactgctgatggcgctggtggtctccgcgctggtcattaactgggcgatgattagccttgcccatatgatgttccgtcgcgcgaaacagcagcagggcgtgaaaacccgcttcccggccctgttttatccgttcggcaatgttctctgcctgctgtttatggcggcggtattgatcattatgctgatgacgccaggtatggcgatctccgtgtggctgattccggtatggctgctcatcctgggcgtcggctacctgtgtaaagaaaaaacggcaaaaacggtgaaagcccactga

SEQ ID NO: 9414 - protein, 457 aa, Salmonella typhimurium
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 9415 - DNA, 1404 bp, Escherichia coli
  CDS (1)..(1404)
atgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataa

SEQ ID NO: 9416 - protein, 467 aa, Escherichia coli
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 9417 - DNA, 1664 bp, Salmonella typhimurium
  CDS (157)..(1527)
gatgccaacggtggtgatggtgatcctggcgattatctgggatcgcgcggcgggtcggcaggtgacctccagcgctcactaaatcgctgacatatgtgtacaccacggggcttaacgcccccgtggttttttattgtgttgataggtcagaaattgatggaaagcaataataagctaaagcgtgggctgagcacccggcacattcgctttatggcattaggttcggcaatcggcaccggcctgttttacggctcggcggacgccatcaaaatggcggggccgagcgtgctgttggcctatattattggcggggtcgcggcatatatcattatgcgcgcattgggggaaatgtccgttcacaaccctgccgccagctcattttcgcgctatgcgcaggaaaacctcggcccgcttgcgggctacattaccggctggacctactgttttgagatcctgatcgtcgccattgccgacgtgaccgcgttcggcatttacatgggagtctggttccccgccgtgccgcactggatttgggtacttagcgtggtgctgatcatttgcgccatcaacctgatgagcgtcaaggtgttcggcgagctggagttttggttctccttcttcaaagtcgccaccattattatcatgattgtcgcgggtatcggcatcattgtgtggggaattggcaacggcgggcagccgaccggcattcataacctgtggagcaacggcggcttcttcagcaatggctggttgggaatgatcatgtcgctgcaaatggtgatgttcgcttacggcgggattgagattatcggtatcaccgccggggaagcgaaagacccggagaaatccattccgcgcgccattaactcagtaccgatgcgtatcctggtattttatgtcggcacgctgttcgtcattatgtctatctatccgtggaatcaggtcggcacaaacggcagtccatttgtgctgacgttccagcatatggggattacctttgccgccagcattctgaactttgtggtattgaccgcctcgctttccgctatcaactccgatgtgtttggcgtaggccgtatgctgcatggtatggcggagcaggggagcgcgccgaaagtctttgctaaaacgtcacgccgtggtattccgtgggtcactgtgctggtgatgacgattgcgctgctgtttgcggtttacctgaactacatcatgccggaaaacgtcttcctggtgattgcttcgctggcgacgtttgcgacggtatgggtatggattatgatcctgctgtcgcaaatcgccttccgtcgtcgtttaccgccggaagaggtaaaagcgctgaaatttaaggtgccgggcggtgtcgtaacgacgatagcgggtctgattttcctggtcttcattattgcgcttatcggctaccatccggatacccgcatctcactgtatgtgggcttcgcctggatagttctgctgttgattggctggatatttaaacgccgtcgcgaccgtcaattggcgcaggcgtagtcgtttttctctgccttatccggtctgcaggcaacggtagacgataagcggcggcttctcctcctggagcctctcctataacctggatgatgagttatcttaatctctgtgcagtgccattcagtagaggatacgag

SEQ ID NO: 9418 - protein, 456 aa, Salmonella typhimurium
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 9419 - DNA, 1653 bp, Emericella nidulans
  CDS (1)..(1653)
atgagtcccccgtcggccaagagcatggaggagggtcgcaccccgtccgtccagtacggatatggagaccccaagacattggagggagaaatagaagagcacacagcaactaagcgtggtctgtcatcacgacagctgcagctgctcgccatcggaggatgtattggcactggtctcttcgtcggtacttcgacagtgctgacccagacgggtcctgctcctttgctgatgagctacattgtcatggcctctattgtctggtttgtcatgaacgtcctgggcgagatgaccacctacctgcccattcgcggtgtctcagtaccgtacttgatcggccgcttcaccgaacccagcattgggtttgcttccggctataactactggtattcatttgctatgctgctggcctcggaagtcactgcctcggggttgatcattgaatactggaatccgcccgtcagtgtcggtctgtggatcgccattgtccttgttgtgatcctggccctgaacgtcttcgcggtcgagtggtacggagaatccgagttctggttcgctggtctgaaaatattggccatcatcggtctgattatcctgggcgttgtgctgtttttcggtggaggcccaaatcatgaccgcttagggttccgctactggcaagaccccggtgcattcaatccgtacctggttcccggggacactggcaaattcctggggttttggactgccctgatcaagtccggtttttcgttcattttctcgcccgaattgatcaccacagccgctggagaggtcgaggcaccgcgtcggaacatccccaaagccaccaagcggttcatctaccgtgttttcaccttctatatcctgggcagtttggttattggagtcactgtggcctacaacgaccctacccttgaggctggagtcgaaagcggcgggtcaggggccggcgcgagtccattcgtcgttgccatccaaaacgctggtattggagggctcaaccatgtcgtcaatgctgccatcctgatctctgcctggtcatccggtaacgcatggtgttacgctggatcgagaacgctgtactcgctcgccggtgagggccaggccccaaagatcttcacacgcaccaaccgcaccggcgttccctatgtggctgttcttgcgacatggacaatcggactgctatccttccttaatctgtctagctccggacagacggtcttctactggttcaccaatattactaccgttggcgggttcatcaactgggttctgatcggaatcgcctatctgcgcttccgcaaggccctgcaattccacggcatgctggacatgctaccattcaagaccccgctgcaaccatacggtacctactacgtgatgttcatcatctcgatcctgaccttgacgaacgggtacgcggtgttcttcccgggccgcttcactgcttcggacttcttggtctcgtacattgtttttgctatcttccttgcgctttatgctggacataagatctggtaccggacgccctggttgaccaaggtgtcagaggttgacatctttacgggcaaggatgagattgaccgtttgtgcgagaatgatatggagcgacagccccggaactggttggagcgagtctggtggtggattttttag

SEQ ID NO: 9420 - protein, 550 aa, Emericella nidulans
MSPPSAKSMEEGRTPSVQYGYGDPKTLEGEIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLASEVTASGLIIEYWNPPVSVGLWIAIVLVVILALNVFAVEWYGESEFWFAGLKILAIIGLIILGVVLFFGGGPNHDRLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIQNAGIGGLNHVVNAAILISAWSSGNAWCYAGSRTLYSLAGEGQAPKIFTRTNRTGVPYVAVLATWTIGLLSFLNLSSSGQTVFYWFTNITTVGGFINWVLIGIAYLRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 9421 - DNA, 1740 bp, Schizosaccharomyces pombe
  CDS (1)..(1740)
atgtcagctaaagattatgacttcgatattgaaagcgttttgcctgaagaaaaagctccacaagtctcagaggccaaaaaggattatatttcccaagaatcgacagttttgtctggccaagttgattttgtagaacctgagcataaagggttttttcaaaacttaatagatggctttaaaccagccagagaagctgacggtaatggaggtcccgcattaaaacgaggtttaagtacgaggcatatgcaattgatgtctattggcggtgctattggtagtggtttgtatgttggttcaggaagcgctttggccgacggtggtccagcttcagtgatcattaattatattttaattggtattatgatgtttttcgttatttatgctctgggtgagatggctgtcgcgtatccagttgccggcagttttaatacttatgcaacgcgcttcattgatcctgcctggggatttgctgttagctggaattatttttttaattattttgttacattcccatttgagttaacgacttgcgcaattacgtttacgttttggacagatgtcaattgtgcggtttggattagtatttttttggttgtcgttattggtattaaccttttcggtgtccgtgtttttggagaagtggagtttgtattagctctgattaaagtggtcgctaccgtcggtttcattattttagccattattattaactgtggaggtgtaccaaccgaccaccgaggatatatcggtggcagtatcattaaacaaaaaccatttcgacatggatttaaaggattttgttctgtgtataccactgctgctttctccttttctggaactgaaatcgttggactggcagcggctgaagtcggcgatccaagaaaaacactacctggtgcagtgaagcaagtcttctggcgagtagctatattttatattgtttccctaatcttgatcggattgctcattagtcctgatgatcccaaattaatgggcaacggatcagcaagcgtttcacctttcgttcttgctattcaagaagctaacattaaaggtcttccttctgtttttaacgctgttattattatttccgtaatatccgtgacaaattcaagtacgtatacagctggtcgtaccctccatggtatggcgaatttaaagcaggcacctgcatttttcaagtacaccgaccgtctgggtcgtcctttaatagcaatgattgtggtcctttcatttggattcttcgcttatattaatgaagccaataataatggaaacgatatcagtgacacagtgttcgactggttactagcaatttccggtctttccaacttcttcacttggggaagtatatgtttatctcatattatgttccgtttagcatttaagaagcaaggtcattccttaaaggagttgggatttgtgtctcccatgggaatctggggttcagtcattggattgggtttcaacatattatgtttgatggctgagttttatgtatctctgttccccataggtggtagtccgaatgctaatgatttctttcaaggatatctagctgcctgcattactcttgttttcttcattggttacaagatttacgacagatcgcatattccctctttggataaactggatatcaccactggtttaaaaacatatgaatatgaagaaacgaaagattcttctgataccgggagattccgttttttcaaaaaaataattaataccgtttgctaa

SEQ ID NO: 9422 - protein, 579 aa, Schizosaccharomyces pombe
MSAKDYDFDIESVLPEEKAPQVSEAKKDYISQESTVLSGQVDFVEPEHKGFFQNLIDGFKPAREADGNGGPALKRGLSTRHMQLMSIGGAIGSGLYVGSGSALADGGPASVIINYILIGIMMFFVIYALGEMAVAYPVAGSFNTYATRFIDPAWGFAVSWNYFFNYFVTFPFELTTCAITFTFWTDVNCAVWISIFLVVVIGINLFGVRVFGEVEFVLALIKVVATVGFIILAIIINCGGVPTDHRGYIGGSIIKQKPFRHGFKGFCSVYTTAAFSFSGTEIVGLAAAEVGDPRKTLPGAVKQVFWRVAIFYIVSLILIGLLISPDDPKLMGNGSASVSPFVLAIQEANIKGLPSVFNAVIIISVISVTNSSTYTAGRTLHGMANLKQAPAFFKYTDRLGRPLIAMIVVLSFGFFAYINEANNNGNDISDTVFDWLLAISGLSNFFTWGSICLSHIMFRLAFKKQGHSLKELGFVSPMGIWGSVIGLGFNILCLMAEFYVSLFPIGGSPNANDFFQGYLAACITLVFFIGYKIYDRSHIPSLDKLDITTGLKTYEYEETKDSSDTGRFRFFKKIINTVC

SEQ ID NO: 9423 - DNA, 1518 bp, Schizosaccharomyces pombe
  CDS (1)..(1518)
atggatgcaagtgtaagtctccttccagaaggagaatctcttcatcgctctttatcggccagccagattcaaatgttagcatttgggggcattattggaactggtctttttttaggaattggctctagtttggcggaatcgggtcctgcttccctactgatttcattctctgtacttggtgtaagcgtttattgtaccatgctagcgcttggcgaaatgtccgtctatatgccagtggctggctctttttgtacatatgtaggccgatatgtagatgaggccctgagcttttcccttacttggaattactggctgaatgatacgattgctttagcaagccatgttttagcaactcgattggtagttgatttttggttaatacctactgagggtgatcctgtaagtgcatctctctccttgcctccttggaaagaggccgtccgaatcattacgccgatcacttcgttgtctgcaaatatcattcttaatatgcttcccgttggcggttttggcgagatcgagtactggctttccagcatcaaggtattcacggtggctgcatttattgttaatggcattttatgcaacctcggagttaacaatgagaaaaaattcattggatttcgctattggaaagatccaggagccttcaataatggtattattggtgtcataagtagtttcgtcaatgctgcttttgcctatgctggcactgagtcaatcgctctcaccgctggtgaagccaagtctccaattaccacattacccaaagcaattcgctttacagcacatcgtgttttgttgctctatataattagtgtcttggttgttggtattaatctgccttataatactcccggtctcgacggcgactctgtacgcatgtccccgttcacttttgttttcaaaaaattcggcgttcccggtgcggcgagtataatgaatttggttatattgtcatcagcattatcagcaggaaaccactctttatacgctggaactcgtctgctgtattccttggccaaatctggtcatgcgcctaaagtgttttccaaatgtaacaagcatggaattccttggctgtcagtgcttgctaccagtgcaactgcaattttgtgtctcatgtcttcacaagctggaaagacatggggctttttactaaacgtcattgccgtctccaaccagatttcatggatattcattgccgtttcaagtttacgatttcgcaaagctttacgagttcagggaaaaacccatagactgtattttcccaactggacctatcccgtaggcccttatattattatcttattaaatggcgtatttcttttcctacaaggctacaagagtctctatccttttcgtctttcgcttttcgttagttattacatggagatacccattgtgcttggattatatctaatttggaagatttataagaagaccaaattggtcagttcaagtgaagctgatttggaaacagattggaaatccttagaggacactgactctgcatga

SEQ ID NO: 9424 - protein, 505 aa, Schizosaccharomyces pombe
MDASVSLLPEGESLHRSLSASQIQMLAFGGIIGTGLFLGIGSSLAESGPASLLISFSVLGVSVYCTMLALGEMSVYMPVAGSFCTYVGRYVDEALSFSLTWNYWLNDTIALASHVLATRLVVDFWLIPTEGDPVSASLSLPPWKEAVRIITPITSLSANIILNMLPVGGFGEIEYWLSSIKVFTVAAFIVNGILCNLGVNNEKKFIGFRYWKDPGAFNNGIIGVISSFVNAAFAYAGTESIALTAGEAKSPITTLPKAIRFTAHRVLLLYIISVLVVGINLPYNTPGLDGDSVRMSPFTFVFKKFGVPGAASIMNLVILSSALSAGNHSLYAGTRLLYSLAKSGHAPKVFSKCNKHGIPWLSVLATSATAILCLMSSQAGKTWGFLLNVIAVSNQISWIFIAVSSLRFRKALRVQGKTHRLYFPNWTYPVGPYIIILLNGVFLFLQGYKSLYPFRLSLFVSYYMEIPIVLGLYLIWKIYKKTKLVSSSEADLETDWKSLEDTDSA

SEQ ID NO: 9425 - DNA, 1374 bp, Alcaligenes faecalis
  CDS (1)..(1374)
atgagccgatttgaacagattcaatcgcgcgaggccggactgcacaagaggctgaatgcccgtcagatgagcatgattgcgatcgggggggccattggtaccggcctgttcctgggcagcaagtttgctattggctttgcgggacccggggtggtgctgagctacgtcattggtggttttattgccctggtgctgatggggtgcctggcagagatgacggtagagcatcctacctcgggctcctttggcgcgtatgccgagttttatattcatccgctggccggttttctggtgcgctacagctattgggcctgcattgtgctggctgtcggcactgaggtgacggcggtggccgactacatgaagttctggtttccggaggtatcgccgtggatctggatcgtctttttctcggccgtgctgattgcggtcaatgcctatagtgttaaagcattcggctcggtggagtattggtttgccctgatcaaggtatttgccattattgcttttatcgtcttggccattggcatgttgacgggttattaccagcccgcacaggtgcaggaaaacctgttgggccagggtggcttcatgcccaatggctggtatggagtctgggtgggcgtgattatttccatcttcagttatctgagtatcgagatgattgcggttgcggcgggcgaggcagaaaaccctgagcaggcggtacgccaggcgttcaaggcaaccatctggcgcttgatcattttctacctcttgtctctgtccctgattgtgatgctggtgccgtggcaggtgctgattgcagatggcacaagcagccccttcattacggtgatgcagtcggtgggcattccttatgcagacagcattttgaatttcatcgtgattattgctgctttgtcggccatgaacagcatgctctacatttctacacgcatgatgttcagcctgtcgcgtgcgggggatgcgccactggtactgggtaaggtggcacgcaatggagtgccgttaaatgccctggctttgtcggccagcggggtgggtgtggcggccgtggtgtatgcctacaatccggaaacggcgttcccggtgatgattgccttgtccatgttcggtgccctgtttacctggggcatgattttcctgacccatttgtttttccgccgccgcgtggcgcaggaaggggtgcagctgcgtttccggatgccggcctatcccatcggcaccttgctgggtctgatcggtattgtggcgattctgattaccacctggttcatcaatatcttccattacacccttttgtttggtgtgccgttcttgctgaccttgatcgtgatttattttgtacgctcaaaaagccgggtcgcgtaa

SEQ ID NO: 9426 - protein, 457 aa, Alcaligenes faecalis
MSRFEQIQSREAGLHKRLNARQMSMIAIGGAIGTGLFLGSKFAIGFAGPGVVLSYVIGGFIALVLMGCLAEMTVEHPTSGSFGAYAEFYIHPLAGFLVRYSYWACIVLAVGTEVTAVADYMKFWFPEVSPWIWIVFFSAVLIAVNAYSVKAFGSVEYWFALIKVFAIIAFIVLAIGMLTGYYQPAQVQENLLGQGGFMPNGWYGVWVGVIISIFSYLSIEMIAVAAGEAENPEQAVRQAFKATIWRLIIFYLLSLSLIVMLVPWQVLIADGTSSPFITVMQSVGIPYADSILNFIVIIAALSAMNSMLYISTRMMFSLSRAGDAPLVLGKVARNGVPLNALALSASGVGVAAVVYAYNPETAFPVMIALSMFGALFTWGMIFLTHLFFRRRVAQEGVQLRFRMPAYPIGTLLGLIGIVAILITTWFINIFHYTLLFGVPFLLTLIVIYFVRSKSRVA

SEQ ID NO: 9427 - DNA, 1356 bp, Lactobacillus johnsonii
  CDS (1)..(1356)
atggatgaaaaggagaagctaaagttaaaaagatcacttaagagtcgtcatgtaacaatgattgcaattggtggagccatcggtactggattatttttagggtctggtacagctattcaaagtgctggtccatcaattatcttatcttatttgatcgttggtattattagcttttttatgatgagggccttaggagaattaattttagcggatcctgagcaacactcatttattgaatcagtgaaaaaatatcttggaaatagaatggaatttgttgcaggctggacttactggctatgctggcttagtttagctatggctgacttaactgcaacgggaatttatttgaaatattggtttaaaaatctgcctcaatgggtcggaccattagtgattgtcattttgttaatgctagttaacatggttaatgtgggcctatttggagagcttgagagttggttttcaatgattaaagttttagctatcttagctttgatcattacgggactaattcttttaattatgcatactaaaatcgattctagaactgtttcactaagtaacttggtaaactatggtggctttttcccaacaggatcctggggctttctgaagtcatttcagatggtagtttttgcatttgtaggaattgaaattgtgggactgacagctggtgaaacagctaatcctgacaaagatattcccaaggcaataaatactttgccagttagaattggattgttttatgttggctcgatgattgctattatggcagtttatccatggaataagattgttactacaaccagtccttttgtacaagtttttggagcaattggtattccagcagctgccggaattttaaactttgttgttttaacagcagcaatgtcagcgacaaatagtgcaattttttcaactagtagatccttatatgctttatctcgaggcaataatgcacctaagagattcggcaagttaagtaaaaaggctgttccgaataatgccttaacattttcatctttgattctattcattgtagtaattcttaactatattatgccggctcaagtttttgatattatttctagtgtttcaacaattaactttattatggtttggataattattatgtggactcacttgaagtatcgagcagaaaataaggaacaacttggcaagtttagaatgcctggttttccaataacgagctggattacaataattttttatttagtaattttagtaatattagctttaattccagcaactagactaccattaattatttcaattatttttattttagctttagccttaagctatactcttttagagagaagaaaaagtaaatag

SEQ ID NO: 9428 - protein, 451 aa, Lactobacillus johnsonii
MDEKEKLKLKRSLKSRHVTMIAIGGAIGTGLFLGSGTAIQSAGPSIILSYLIVGIISFFMMRALGELILADPEQHSFIESVKKYLGNRMEFVAGWTYWLCWLSLAMADLTATGIYLKYWFKNLPQWVGPLVIVILLMLVNMVNVGLFGELESWFSMIKVLAILALIITGLILLIMHTKIDSRTVSLSNLVNYGGFFPTGSWGFLKSFQMVVFAFVGIEIVGLTAGETANPDKDIPKAINTLPVRIGLFYVGSMIAIMAVYPWNKIVTTTSPFVQVFGAIGIPAAAGILNFVVLTAAMSATNSAIFSTSRSLYALSRGNNAPKRFGKLSKKAVPNNALTFSSLILFIVVILNYIMPAQVFDIISSVSTINFIMVWIIIMWTHLKYRAENKEQLGKFRMPGFPITSWITIIFYLVILVILALIPATRLPLIISIIFILALALSYTLLERRKSK

SEQ ID NO: 9429 - DNA, 1374 bp, Lactobacillus johnsonii
  CDS (1)..(1374)
atgtcaaaaaatagctcagaatcatctgaggttaaaactatgaaacggagtttgacaaatgcccatattcaactaattgcattagggggaacaattggaacaggactatttctaggagttggaaatagtattgagctagctggtcctgcagtaattttcatctattgcttagttggattctttctttttctgttaatgagagcactcggagaactgatactttcagatattaagaaaaatacctatattgattttatttcagaatacttaggaaaaagtattggaacaacaacaggatatttatattggttcagttggttgactctcgctatggcagaaattactgccctaggaatttattttcaatattggtggcccaacctgcaaagttggattcccggattaattactttattagtactattaggtattaatctaatttcagcacgggtatttggaaacttagaatttagttttgcaattattaaaattgtaacaattattgcatttgttattcttgtcttctacctattaattacaaattcttcaacaaagtatgggcatgttagctggaataacatgatgattgatggcggtattttcgccaaaggtcctaaaggttttttattaggttttcaaatggtaatctttagtttcatcggtgttgagttaattggtttaactgctgctgaagcaaaagaaccaaagaaaactattacacgggctattgaccaactgcctgttcgaattattttattttatgtgcttgcaattctaagtatcttattagcaattccttggacaaaggtttcaacttcaagttcaccattcgttcaagcattaggtgcaacaggaattaaaaatgcaggttcaataattaattttgttgttataagtgcagccatttcatcaactaatagctttatctatagtgcgggccgtctattattttcaataaattacaatggtaaaaacaaaatcagtaagcatttaggtaagttggatcatcgacaattacctaaaaatgctttagtattctcaacagttttaattgcattagcacctcttttaaatctctttttaaaggatgcttttacctttatttctgccactgcaacgagtatgtttttattaatttggtcaattatgatcgtgactcatatgacttaccgtaaaaagacaccaaagaatgaacttccaacatttagaatgccgttatatccaatatcagatatagcagtactaatattttttatagcaatgattattgtgttactaatatttccaaattatcgaattccaatgataagtgcaggaataatttttacagttttagtatgtctaactcactttatacagaaaaaaagtaattaa

SEQ ID NO: 9430 - protein, 457 aa, Lactobacillus johnsonii
MSKNSSESSEVKTMKRSLTNAHIQLIALGGTIGTGLFLGVGNSIELAGPAVIFIYCLVGFFLFLLMRALGELILSDIKKNTYIDFISEYLGKSIGTTTGYLYWFSWLTLAMAEITALGIYFQYWWPNLQSWIPGLITLLVLLGINLISARVFGNLEFSFAIIKIVTIIAFVILVFYLLITNSSTKYGHVSWNNMMIDGGIFAKGPKGFLLGFQMVIFSFIGVELIGLTAAEAKEPKKTITRAIDQLPVRIILFYVLAILSILLAIPWTKVSTSSSPFVQALGATGIKNAGSIINFVVISAAISSTNSFIYSAGRLLFSINYNGKNKISKHLGKLDHRQLPKNALVFSTVLIALAPLLNLFLKDAFTFISATATSMFLLIWSIMIVTHMTYRKKTPKNELPTFRMPLYPISDIAVLIFFIAMIIVLLIFPNYRIPMISAGIIFTVLVCLTHFIQKKSN

SEQ ID NO: 9431 - DNA, 1383 bp, Lactobacillus johnsonii
  CDS (1)..(1383)
atggagaataaacagaatcatcctcctaaattaaagcgatcgatgactgctggacaaatggagatgatctctctaggtggagccattggtgttggattattcatgggatctacatcaactattaaatggacggggccatcagttttattagcctatatgtttgtaggactaattttatacatcgtaatgcgagcattgggagagatgctctatgttagtcctggaacaggatcatttgcagattatgcaacagagtatatttcaccattagcgggatatttagctgagtgggctaatgtctttcaatatattgttgttggtatttcagaagttgtggccgcaacagagtatttaaagttttggtggcctgaagttagtgttttttggtctggaataataattattgctttcttattactggcaaacttggctagtgctaaagcttatggaacactagagttttggtttgcgatgattaaggtagtaacaattgtaataatgattattttaggtttgctggtgattttactcggcgtaggaaatcacggaaaaccaatcggctttagtaatctatggtcacatggtggctttttcactggtggagtaaaaggattctttttctcaatggcaattattgccggttcatatgagggcatagaattaattggtatttctgctggagaagtagccaacccacaagaggcaattgtaaaaagcgtaaaatcagttttatggcgtatcttgattttctacgttggggcaatctttgtgatcgttacaatttatccttggaatcaattaagtaatattggctctccatttgtagagacctttactaaggtagggatcacagcagctgctgggattattaacttcgtagttttaaccgcagccttgtcaggtgcgaattccggtatttattcatctagtagaatgctatttaaattggcacatgagggagaagcgccaaaggcctttggaaaactatcgaagcgtattgttcctgacagagctatcgttggaattacctcaggtattttaatcggctttattttgaatttgataatgtcaaccatgaataagtcaatgggagaattgttcgttgttgtctatagttcttctgttttaccaggaatggtagcatggtttgtaattttgattgctgaattgaaattcagaaaaaataattcacatttaatggctgaacatccatttaagttacctctctacccatattcaaattattttgcatttgcaatgttattagtgattgttgtatttatgtttatcaatccagagacaagaatttctgtaggtgtgggtgctggagttttagtgttagcaagccttgtgtatatgcttaaacatcgtaataaaaagtaa

SEQ ID NO: 9432 - protein, 460 aa, Lactobacillus johnsonii
MENKQNHPPKLKRSMTAGQMEMISLGGAIGVGLFMGSTSTIKWTGPSVLLAYMFVGLILYIVMRALGEMLYVSPGTGSFADYATEYISPLAGYLAEWANVFQYIVVGISEVVAATEYLKFWWPEVSVFWSGIIIIAFLLLANLASAKAYGTLEFWFAMIKVVTIVIMIILGLLVILLGVGNHGKPIGFSNLWSHGGFFTGGVKGFFFSMAIIAGSYEGIELIGISAGEVANPQEAIVKSVKSVLWRILIFYVGAIFVIVTIYPWNQLSNIGSPFVETFTKVGITAAAGIINFVVLTAALSGANSGIYSSSRMLFKLAHEGEAPKAFGKLSKRIVPDRAIVGITSGILIGFILNLIMSTMNKSMGELFVVVYSSSVLPGMVAWFVILIAELKFRKNNSHLMAEHPFKLPLYPYSNYFAFAMLLVIVVFMFINPETRISVGVGAGVLVLASLVYMLKHRNKK

SEQ ID NO: 9433 - DNA, 1395 bp, Lactobacillus johnsonii
  CDS (1)..(1395)
atggaaaataaaaagtcaatgcccaaattgaaacgttccatgacagctggtcaaatggaaatgatatctttaggtggggcaattggtgttggattattcatgggatctacatccactattaaatggaccgggccttcggttttactcgcttatatgtttgttggattaattttgtacattgtaatgcgagccttgggagaaatgttatatgttaatccaggaacaggatcatttgcagattatgcaactgaatatgtccatccattagcgggatatttagctgagtgggctaatgtatttgagtatatagttgttggaatgtctgaagtagttgcagcaactgaatatttaaagttttggtggccaaaagtgaatgtgttttggtcaggaattattattattttgtttttagtgttagcaaatttagctagtgccaaagcatatgcttccctagagttttggtttgcaatgattaaagttgtaactattatcttaatgattattttaggattcattgtaattttctttggagtagggaacggcggaaagccaactgggtttagcaatctatggtcacatggtggctttttcactggtggagtaaaaggcttcttcttctcaatgtcaattattgttggttcatatgagggaatcgagttactaggcatatctgctggtgaggtagcaaatcctaaaaaagccattgttaaaagtgttaaatcggttttgtggcgtatcttaattttctatgttggagcaatttttgttattgttacgatctatccatggaatgaattaagtaatattggctctccatttgtaactacatttgcaaaggtaggaattacagcagcggcaagtattatcaactttgtggttttaacggcagccttgtcaggagcaaactctggaatttattcatctagtagaatgctttttaaattagctcatgatggggatgctcctaaaacctttggacatatttctaaacgaattgttcctaatcatgcaattttagggatttccgggggaatattaattggatttattattaatatgattgcagctacaattaataaatctactcaagatttattcgttgtcgttttctcgtcttcagtcttaccaggtatgattccatggtttgtaatcttacttgctgaactaaaatttagacgcaataatcaagatttactagtagaccatcctttcaagttaccgttataccctatttccaattactttgcatttttgatgctgattgttatagttatctttatgcttattaaccctgaaactagagtttctgtattagtgggagctgctgttttacttatagctacaattgtttatctatttcgacataaaaaggatggtgtaaataatggagaataa

SEQ ID NO: 9434 - protein, 464 aa, Lactobacillus johnsonii
MENKKSMPKLKRSMTAGQMEMISLGGAIGVGLFMGSTSTIKWTGPSVLLAYMFVGLILYIVMRALGEMLYVNPGTGSFADYATEYVHPLAGYLAEWANVFEYIVVGMSEVVAATEYLKFWWPKVNVFWSGIIIILFLVLANLASAKAYASLEFWFAMIKVVTIILMIILGFIVIFFGVGNGGKPTGFSNLWSHGGFFTGGVKGFFFSMSIIVGSYEGIELLGISAGEVANPKKAIVKSVKSVLWRILIFYVGAIFVIVTIYPWNELSNIGSPFVTTFAKVGITAAASIINFVVLTAALSGANSGIYSSSRMLFKLAHDGDAPKTFGHISKRIVPNHAILGISGGILIGFIINMIAATINKSTQDLFVVVFSSSVLPGMIPWFVILLAELKFRRNNQDLLVDHPFKLPLYPISNYFAFLMLIVIVIFMLINPETRVSVLVGAAVLLIATIVYLFRHKKDGVNNGE

SEQ ID NO: 9435 - DNA, 1680 bp, Penicillium chrysogenum
  CDS (1)..(1680)
atgggtcaccccgacgagattaacgctctcgaggcgcagcccggctacgttgacaacttgggagatttcaaggaaagtgagcaggatgagccagttcaacttcacagagagctcaaggctcgtcacatttctatgattgccattggtggtgccattggtactggattggtcgttggtactggtagcgccctgacagccggacctggatctttgtttattgcctactgctttatgggtttcgtcgtttggactgtcatgtgtggactgggtgaaatggctgcttggctaccattgtcctccggtttcactggttacgctggccgtttctgtgaccctgctctcggatttaccctcggatggtgctactacctcaaatatatcattctaccacctacacaactcacggccgctgctctagtcattacctattggccgagaacgtcagcagagaacgtcaatccaggtgtttggattgccatcttcatggtggctatcatcgtgataaactacttcggcgtgaagatcttcggtgaattggagttttggctctcatctttcaaggtgattgtcattctcggactcattctgtgctctttgctcttcgcactcggcggtggtccagaccacgacaggagaggcttccgatactggaataagcccggcgccttcgccactaaatatactgatggtgcccttggcaaattccttgctttctggtcgaccatggtgcaagccacctttgcattcctcggtaccgaacttattggtgtgaccgtcggagaagcccagaacccccggaagaccatccccaaagctatcaagctcaccttctggcgaatcatcgtgttctatattctcagtgtactcttcctcggtatgctcgtcccctacgactccaaggaactggctttcgcaaccgaggccgagagctctgctgccgcatcaccttttgtggtggcaatggggcaagtcgccgctcttcctcacatcatcaacggctgtatcctggtgttcgtgttttctgccgccaactctgatctatacattgcgactcgaactctgtacggtcttgcccgtgagaagaaggctcctaaaatctttgctcgcactaacagagctggtgtcccaatctattctctggcactgtcagcttctttctgcttgctcgcctttatgagtgtgtccagtacctccaaggaagtattcggatacttcaccgacatggtgtcaatcttcggattgttgacatgggtctccctcttgattacccacatcttcttcattcgtgcgcgacgtgcacagggagtcgaccaggcaacactggcctacaaagctcctctgggaatcatcggttcctgcattgcgctcttcttctgtgttttggtgctcttcactcgcagcttcggcgtgtttatccacgacccggaaacatacggcaactttgactacaagacttttatcacttcatacatcggaatccccctctatgttgccgcattcgctgggtggaagatctggaacaagaccgagattatcaagccccataatgcggatatctggaccggcaaggccgaaattgaccgcgaagaggcggaatatgtggctatggtggccattcaggaccaaaacttgtctggctggaacaaggtttacaggaagagtctcgcgtggctcttctga

SEQ ID NO: 9436 - protein, 559 aa, Penicillium chrysogenum
MGHPDEINALEAQPGYVDNLGDFKESEQDEPVQLHRELKARHISMIAIGGAIGTGLVVGTGSALTAGPGSLFIAYCFMGFVVWTVMCGLGEMAAWLPLSSGFTGYAGRFCDPALGFTLGWCYYLKYIILPPTQLTAAALVITYWPRTSAENVNPGVWIAIFMVAIIVINYFGVKIFGELEFWLSSFKVIVILGLILCSLLFALGGGPDHDRRGFRYWNKPGAFATKYTDGALGKFLAFWSTMVQATFAFLGTELIGVTVGEAQNPRKTIPKAIKLTFWRIIVFYILSVLFLGMLVPYDSKELAFATEAESSAAASPFVVAMGQVAALPHIINGCILVFVFSAANSDLYIATRTLYGLAREKKAPKIFARTNRAGVPIYSLALSASFCLLAFMSVSSTSKEVFGYFTDMVSIFGLLTWVSLLITHIFFIRARRAQGVDQATLAYKAPLGIIGSCIALFFCVLVLFTRSFGVFIHDPETYGNFDYKTFITSYIGIPLYVAAFAGWKIWNKTEIIKPHNADIWTGKAEIDREEAEYVAMVAIQDQNLSGWNKVYRKSLAWLF

SEQ ID NO: 9437 - DNA, 1746 bp, Penicillium chrysogenum
  CDS (1)..(1746)
atggaggagaagaagtttgaggccgtccaaactggcgcggaggcccccccagcttatggcgactcatctccaacgcggggaggcataggccaacgaatctttgacagtttcaagagagaccccaatcatacagtcaccggtcatgttggagctgatggctctggattcgacgctgagactgccgcccataacactgctcactccccgttgcagcgtcgcttgaagggtcgtcatctgcagatgattgctatcggtggttctatcggtactggtcttttcgttggttccggatctgttttggccaccggtggtccagcctcagtattgattgcctatatcttgatcggatgcatgctttattgtacagttcatgcattgggtgaaatggcagttctcttccccgttgccggttctttcgcccattattcaactcgtttcgtcgatcctgcttggggttttgccatgggctggaactacgctcttcagtggcttatcgtcttacccttggagatcgtcgctgcttctatcacggtcgattattggaacccaggggtttcaaatgccgcctgggtaactattttctgggttatgattgtctcaatcaacttattcggtgtgcgaggatatggtgaagctgaatttgtcttctccctcattaaggtcattgccgttattggtttcattatacttggaatcatcctcaactgcggtggtggaccccaaggtggatacatcggcgccaggtactggtacgacccaggtgcatttaggaacggtttcaagggtctctgcagtgtctttgtcaatgccgcatttgcctttgctggaaccgaacttgttggtcttgctgccgccgaaaccaccaatcctcgcaagtcccttccgacagccgttaagcaagtcttctggcgtattgctctcttctacatagtttcccttacccttgtcggcctcctagtgagatatgacgacgagagacttatcagcggtagctcttccgccgatgccaaggcctctcccttcgtcattgctattgagaacgcaggaattaaggctttgccttcgatcatgaatgtcgtgattatgattgcggtcctgtctgtcggcaattcctccgtctatggatcctcacgtactcttgctgcccttgccgagcagggccaagcccccaagttcctagcatacattgaccgcaagggacgtcctctacccgccattatcattgcatctatattgggtctgctttcctacctcgccgcctctgacgtgcagactaccgccttcgaatggatgatggccatctcgggtctgtcatctattttcaccggggttccgtgtgtccgtgcccacatcctcttccgtcgcgcatggaaaaaacagggccacagcctggacgaactggctttccgttcccaacccggcgtcattggctcgtgggtcggtttcattttcaactgtctcgtgctggttgcccagttctgggttgggttcgcccccattggttacgcagacatgacctctcaggagattgcctacaaattcttctctgtctacttggccgcccccgtggttctgatttgctacatcggttataagatcatgtacaagaccaagtttgttcgcacgtccgaggtggatttggtcaccggtcgtcgcgaccttgatatccagcatttaattgagcaggagatggccgagcaaagagaatggcccaagtggaagaaggtttataagttcttctgttaa

SEQ ID NO: 9438 - protein, 581 aa, Penicillium chrysogenum
MEEKKFEAVQTGAEAPPAYGDSSPTRGGIGQRIFDSFKRDPNHTVTGHVGADGSGFDAETAAHNTAHSPLQRRLKGRHLQMIAIGGSIGTGLFVGSGSVLATGGPASVLIAYILIGCMLYCTVHALGEMAVLFPVAGSFAHYSTRFVDPAWGFAMGWNYALQWLIVLPLEIVAASITVDYWNPGVSNAAWVTIFWVMIVSINLFGVRGYGEAEFVFSLIKVIAVIGFIILGIILNCGGGPQGGYIGARYWYDPGAFRNGFKGLCSVFVNAAFAFAGTELVGLAAAETTNPRKSLPTAVKQVFWRIALFYIVSLTLVGLLVRYDDERLISGSSSADAKASPFVIAIENAGIKALPSIMNVVIMIAVLSVGNSSVYGSSRTLAALAEQGQAPKFLAYIDRKGRPLPAIIIASILGLLSYLAASDVQTTAFEWMMAISGLSSIFTGVPCVRAHILFRRAWKKQGHSLDELAFRSQPGVIGSWVGFIFNCLVLVAQFWVGFAPIGYADMTSQEIAYKFFSVYLAAPVVLICYIGYKIMYKTKFVRTSEVDLVTGRRDLDIQHLIEQEMAEQREWPKWKKVYKFFC

SEQ ID NO: 9439 - DNA, 1422 bp, Bacillus cereus
  CDS (1)..(1422)
atgatggatcaaaaccaaggattaaaaagggaattgaaaagcagacacatatttatgattgcacttggaggagttattggtaccggactttttttaggatcggggtatacaattcatgaagctgggcctggaggagcgattgtagcttatcttgttggaggatttgttatgtatttaacgatgctctgtctcggagaattagctgttgcgatgcctgacgcaggatcttatcaaacgtatgctacgaagcatatttcccctgcagcgggttatgtagtcggatggatgtcgtggctaaactggtcggctacaataggtattgaactcattgcagttagtattttaatgaaacgatggtttcctgatgtaccgtcttggatttggtgcgtagtgtttgcggtactactttttgctattaacgcgttatcttcaagaagttttgcagaagttgaattttggtttgcaagtattaaagtcattacaatcattgcatttattattttgggcggggcagcaatgtttggttttctagatatgaaaggaaatgaaccagcaccaatgttttctagctttactgattatggtgggttatttccaaatggattatccgctattttaattacgatgattgctgttaatttttccttccaaggaacagagctagttggtattgcagctggagagagtgaaaatccagaaaagacaatcccgaaggcaattaataatacagtttggcgtatacttgtgttctttgtattatctattttcattcttgcaggattattcccatggcaacaagcaggagtgatagaaagtccattcgtagttgtatttgataaaattggtattccttatgcagctgatattatcaatttcgttatcattacagcagtattatccgttgcgaattcagggctatatgcaacttctcgtatgctatggtctatgtctaatcaaggaatgattagtccgatttttagtaagttatctaaaagcggcgttccaatttatgcattgattgtaagtacaattgtaggttgtctctcattactatcaggtatttatgcggaagatacagtttatttatggttgctttctattgctggatttggagcaatactagtttgggcatctattgctctatctaacttattagctagaagggcgtatataaagcagggcggggatgtgaaagacttgaaatttaaaacaccgctatatccattcgtaccacttcttgcattagtattaaatgtaacagtaattgttgctatggcctttattccagaacaaagaatggcattgtattgtggtattccctttatgattgtttgtttactgttttaccgtgcgacaagaaataaggggagtaacttagagcatattgaaaagacaaagacaacagaaatagagagtttataa

SEQ ID NO: 9440 - protein, 473 aa, Bacillus cereus
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFSKLSKSGVPIYALIVSTIVGCLSLLSGIYAEDTVYLWLLSIAGFGAILVWASIALSNLLARRAYIKQGGDVKDLKFKTPLYPFVPLLALVLNVTVIVAMAFIPEQRMALYCGIPFMIVCLLFYRATRNKGSNLEHIEKTKTTEIESL

SEQ ID NO: 9441 - DNA, 1392 bp, Bacillus cereus
  CDS (1)..(1392): k means g or t/u, w means a or t/u, m means a or c
atgcagcacacaaacaaatctggaactttaaaccgcggtttaaaagaacgacatattactttaatgtcactcggttcagctattggcgttggactatttttaggatctgcttctgctattaaactagctggcccttctattttactaggctatatgattgctggactcgttatttttttcattatgcgagcactcggagaaatggcaattgaacaacctgttgctggctcttttagtaaatatgcatatgattatcttggaccactagctggctatattactggttggaactactggttcttatgggttgttacttgcatggctgaaattacggctgctggcatttacatgcagtactggttcccagatattccgcgctggacttgggctttactcgctctattattaatgagtgctttcaactttttatctgtaaaagtatttggagaacttgaattttggtttgctctcattaaaattgtcacaattatctgtatgatagtagttggggctggtattattttatttggcttcggaaacggtggtatcgctactggcatttcaaacctttggtcacatggtggctggttcccaaatggtttttctgggttactcctctccatgcaaatggtgctattcgcttatttaggcgttgaattaatcggcgttacagcgggtgaagcgcaaaacccgaaaaaaacactcgcaaaagcaatcgataacgtatttkggagaatattactgttctacgttggggctctattcgttatgatggcaawttatccatggaacgaacttggtgagaaaggaagtccatttgtattamcatttcagcaaatcggtatcgcaaaagcagcaggaattattaactttgtcgtattaacagcagctctttcttcttgtaatggtggtttatttagtacaggccgtatgctgtatacattagctcagcagaaaaaagctcctgaaagattcggtcgtttaaataaaaatggcattccaagtcaaggaattgtagcaacagcaatcgttttactcgttggtgttatattaaactatcttgtgcccgcaaaagtatttacatggctcactagtatttcaactttcggggcaatttggacttggggtattatattagtcgctcaaattaagttccgtaaaagtttgccgacgcaaaacaaacaaaagttatcgtataaaatgcctttatacccattaagttcatatttctcacttgctttccttgcactcgtattatgtataatggcgtattcagaagatacaaggattgcattaattgttggaccaatttggcttatcggtttagctgtcgtgtattacatgaaaggttttcataaaattgatgaaacacctaattcaaaaattagttaa

SEQ ID NO: 9442 - protein, 463 aa, Bacillus cereus
  misc_feature (244)..(244): Xaa can be Gly or Trp
  misc_feature (260)..(260): xaa can be Asn or Ile
  misc_feature (276)..(276): xaa can be Thr or Pro
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFXRILLFYVGALFVMMAXYPWNELGEKGSPFVLXFQQIGIAKAAGIINFVVLTAALSSCNGGLFSTGRMLYTLAQQKKAPERFGRLNKNGIPSQGIVATAIVLLVGVILNYLVPAKVFTWLTSISTFGAIWTWGIILVAQIKFRKSLPTQNKQKLSYKMPLYPLSSYFSLAFLALVLCIMAYSEDTRIALIVGPIWLIGLAVVYYMKGFHKIDETPNSKIS

SEQ ID NO: 9443 - DNA, 1416 bp, Bacillus cereus
  CDS (1)..(1416)
atgaatcaacaagtagaacaaacagatttaaaacgtacaatgaaaagtagacacctatttatgattgcacttggtggtgttatcggaactggcctatttatgggatctggtcaaatcgtccataacgccggccctggtggtgctattcttgcatttttagtcggtggatttgttatgtatttaacgatgttatgtcttggtgaattatctgttgctatgccagaagcaggttcattccaaagctatgcaagcaaatttatttcacctggttttggttttgttgtcggttggatgtattggttaaattgggctgttacagttggagtagagttaacaactgtaagtattttaatgaaacgctggtttccagatgtttcttcgtggatttggtgtgttacatttgcagcagcactctttcttgtaaacgccctatcagcaaaagcatatgcagaagcagaattttggttcgctagtgtaaaagtcgcaaccatcgttattttcatcgtactcggtggtgcagttatgttcggtctactagactttaacggaaaaccagctccaatgcttcacaatttcactgaaaatggcggattatttccgaatggtgcattggctgttcttcttacgatgattacagtgaattattctttccaaggaacagaattaatcggaatcgcttcaggagaaagtgagaatcctgaaaaaacaattccaaaagcaatcaaaaataccatttggcgaacgctattcttcttcgtcctagccatatcagttgttgtaggtttactcccgtggcaagaggctaatctagtcgaaagtccatttgtacttgtatttgatgtagctggtattccatatgcagcagacattatgaactttgttattattacagctgtattatccgtagccaattctggtctatacgcaaattcacgtatgctttgggcaatggcaaaacaaggaatggcaagtccagcatttacgaagctaacgaaaaaaggtgtaccattaaacgcattgattttcagtctaatctttgcaagtttatccctattaacaagtatatttgcagcagatactgtctttttagttttaacatctatcgcagcaatggctgccgttgtcgtttggatgtcaattgcggcttcacagtttttcttccgtagaaacttcgtgaaaaacggtggtgacatcaatgatttaaaatatcgcacaccactttatccgctcgttccaatcgtagcattctcactcaatttcattacatttgtaagtttagctttcattccagatcagagaatcgctctttattgcggtattccatttatggttatttgttacattttatatcaagtgaaatataaaaaaattgtcacatttgaacaacaaataagtctaaaaaaagaagtaaactaa

SEQ ID NO: 9444 - protein, 471 aa, Bacillus cereus
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGIPYAADIMNFVIITAVLSVANSGLYANSRMLWAMAKQGMASPAFTKLTKKGVPLNALIFSLIFASLSLLTSIFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQISLKKEVN

SEQ ID NO: 9445 - DNA, 1542 bp, Bacillus cereus
  CDS (1)..(1542)
atgacttttctttttaattatctgaaaattataacaagatttcacatcacggaatatattccacaatacggaaaaacatcaaactttattctatcaactacgaaagtgaggaaaacaatggcgcaagtaaataatacaaacaatgaattaaaacgtacgatgaaaagtagacacttattcatgattgcactcggtggtgtgattggaacggggttatttaacggatctggctttattataagtcaagctggacctggtggatccgtacttgcctttatggccggtggattattaatgtatttcgttatgctatgtcttggtgagctcgctgtagccatgcctgtttcaggctctttccaggaatatgccactaagtttattaatcctgcaactggctttacaatcggatggttgtattggttaagctgggcaaatacaaccggccttgaatttacaactgccggcattacaatgcagcgctggtttcctgatattcctgtttgggtttggtgtttaatatttggcgttacaatcttcacaattaacgcattatctgctcgtagttatgcagaaacagaattttggttttcaagtataaaagtatctgccattatcgcttttattattcttggcggcgccgctatgttcggttttatcgatttaaaaggcgacgaaccagcaccgctattatcaaatttcgtgaatcatggtggtttatttccaaatggacttgcagctatcctattaacaatggttacagtcaattattccttccaaggtacagaacttgtcggaatcgcagcaggtgaaagtgaagatccagcaaaaactttacctcgttctattagaaatattatatggcgcacgatgtttttcttcgtcttagcaatctttgttctcgttgctttaattccttgggaagaagcaggattaacaaaaagtccgttcgttgctgtatttgataatatcggtattccatatgccgctgatattatgaactttgttattcttactgctgttctttcggtcgccaattcaggattgtacgcagcaactcgcatgctttggtcattatccaaaaatgaaatggctccagcctttttaaagaaattatcatcacgaggaatacctttgaatgctttaattatgacaattgctatttctgctttttctcttttaacaagcgttgtagctgctgaaacggtttacttatggctcatttccatttctggcgtcataacaatcattgtttggatgtcaatttgtgtctctcaattctttttccgtaaacattatttagcagacggcggaaaattagaggacttaaagttcaaaactccactttatccacttgtaccaatacttggttttggattgtacggcattatattaatcagtctaatctttatcccagaacaacgacttggaatctattgcactgtaccatttattatcttttgctacacttattatcacttaaaagttaagaaaagaatttctactaacactaatagtgagactaaaattagcgagacgatgtaa

SEQ ID NO: 9446 - protein, 513 aa, Bacillus cereus
MTFLFNYLKIITRFHITEYIPQYGKTSNFILSTTKVRKTMAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHLKVKKRISTNTNSETKISETM

SEQ ID NO: 9447 - DNA, 1419 bp, Bacillus cereus
  CDS (1)..(1419)
atgaatcatctaagagggggaagtgaagtggcaaacaaagaattgaaaagaggtttagaagcacggcatattcaaatgattgctttaggcggaacaattggtgttggtttgtttatggggtcagccagcacgattaaatggacaggtccgtcggttatgcttgcttatgcaattgcaggtatttttatcttcttcatcatgcgtgcaatgggagaaatgttgtatatggagccaagtacagggtcatttgcaacgttcggtcataagtatattcacccgttagctggttatatgacagcgtggagtaactggttccagtgggttatcgttgggatgtcagagattatcgcggttggagcgtatatgcaatattggttcccagatttaccagcttggataccaggtgtaattgcaatggttattcttggcgcagctaacttaatttctgttaagtcatttggtgaatttgaattttggtttgcgatgattaaaattgttacgattctattaatgattattgcgggatttggacttattttctttggaattggtaacggcggagaagcgattggtatatcaaatctttggtcaaatggcggtttctttacaggtggtttctcaggattcttctttgctttatcacttgtagttggagcatatcaaggtgtagaattaatcggtattactgctggtgaagcgaaggatccgaagaagacacttacaagagcgattcaaagtacaatttggcgtattttaattttttacatcggtgctattttcgttattgtaactgtgtatccgtgggatcaattaagtacaattggtagtccgttcgtagcaacttttgcgaaggttggtattacggcagcagctggacttattaatttcgtagttattacagcggcaatgtctggttgtaatagtggtatttatagtgcgggtcgtatgctatatacgttaggtgtaaatggacaagcaccaaaatatttcacgaaactttctggaaatggtgtacctttattcggtacagttggcgtaattatcggtttagcgattggtgttgtattaagttatatcgcaccgaaaaatttattcgtatatgtatatagtgcgagtgtacttcctggtatggtaccatggtttgtcattctaattagtcaaattaattttagaaaagaaaaaggggcagagatgaaagatcatcctttcaaaatgccatttgctcctgttacaaactatttaacaattgcctttttaattatggtattaatcggaatgtggtttaacgatgatacgcgcatttcattaattgtaggtatcattttcttagctatcgttacaattagtttctatgctttcggaataggaaagcgaactccgttagacgttcaaaatgatcaagagatttcaagtaaataa

SEQ ID NO: 9448 - protein, 472 aa, Bacillus cereus
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAIGVVLSYIAPKNLFVYVYSASVLPGMVPWFVILISQINFRKEKGAEMKDHPFKMPFAPVTNYLTIAFLIMVLIGMWFNDDTRISLIVGIIFLAIVTISFYAFGIGKRTPLDVQNDQEISSK

SEQ ID NO: 9449 - DNA, 1464 bp, Bacillus cereus
  CDS (1)..(1464)
atgggggtcttactgcccgttaatgcggggcaaatttcaaaattacgtttggaaggggatgtacaagagttggaaaaaaatcttaagaaagacctcaaaatacgccatattacaatgatttcaattggtggcgtaataggagctggtttgtttgttggaagtggggcggttgtacattcagccggaccaggttctatcatttcatatgcattagcaggacttctagttattttcgttatgagaatgcttggagaaatggcagctattaacccgacaagtgggtcatttgcaacatatgcaagagaagcaattggtccatgggccggttatacaattgggtggctatattggtttttctgggtaattgttattgcaatagaagccacagcaggtgctggtattattcaatactggattccagaaatcccactttggttattaagcctaatattaacgattttattaacattgacgaatgttttttcggtgaaatcatttggagagtttgaatattggttttcttttattaaagtaataagtatcgttttgttcctttgtcttggactagctgttattttaggatttgtaccaggaacggaagcacctggcacttcgaatttagtaggacaaggaggatttatgccaaacggtataagttcggtgctacttggaattactgtcgttatattttcatttatgggatctgagattgttgcagtagctgctggagaatctgctgaacctgtaaaagcagtaaaaacagcaacaaatagtgtaatttggcgtattctcgtatttttcattggatcgattgctgtagttgttacacttcttccatggaattcagcgaacatactaaaaagtccgtttgtagcggtactggaacatataggggtaccagcggcagcacaaattatgaattttatcgttttaacagctgtactttcttgtttaaattctggtttatatacgaactcaagaatgcttttttcgatggcagaaagaggagatgctccaaaggcgtttttgaaattgaacaatagtggtgttccagttcgggcagttttattcggaacgttcttcgcttatattggagttgtttttagttatatatctccagataaagtctttttatttttagtgaatgcatctggcgggattgcgttgctcgtttatctcgttatagctgtttcgcatttaaagatccgtaaaaaaatggggaaagtagaacaacaaaatttgaaagtgaaaatgtggtttttcccgtatgtaacgtatgttacaattgccgctattatagcagttttagttgcgatgcttgcaattgaatctttacgttcacaagcacttttgacgatgcttgttactgttcttataatactttcttattttatttttaatagaaataaaaatagtacagtatcgaatactacaagtaagaatgaggaatctgttcgattctaa

SEQ ID NO: 9450 - protein, 487 aa, Bacillus cereus
MGVLLPVNAGQISKLRLEGDVQELEKNLKKDLKIRHITMISIGGVIGAGLFVGSGAVVHSAGPGSIISYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGVPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLKIRKKMGKVEQQNLKVKMWFFPYVTYVTIAAIIAVLVAMLAIESLRSQALLTMLVTVLIILSYFIFNRNKNSTVSNTTSKNEESVRF

SEQ ID NO: 9451 - DNA, 1767 bp, Ashbya gossypii
  CDS (1)..(1767)
atggcggaagagaagttcgcacaggcatcagaggcgtccacgctggacgagttgaaaggccccaagctggccgccgctggtgagggccgcggtctgcggcatacccacagcagcacagaccaggaggcgcagtccgtagactggaactacgatggcaagcacgagggcatccggctcaagaaggacctgcaggcacgtcatgtgtcgatgatagccatcggcgggtcgctagggaccgggctgctgatcggcacgggcagctcgctgatgcgagcgggaccggggtcgatcctgattgcgtacagcatcatggggtgggtggtgttcacagtgatgtcgtgcctgggggagatggcggcgtacattccgctggacgggttcacgtcttacgccacccggtacgcggaccctgcgctgggctttgccgtggggtgggcgtatctgttcaaatacctggtgctcactcccaatcagctgacggcaggcgcgctagtgatacagttctggatacccgccgcacgggtcagcccgggcgtgtggataacggtggtgctggcggtcattgtcgtgattaacacggtgggggtgcgtttcttcggggaattcgagttctggctgtctagtttcaaggtgctggtcatgctgtgtgtgatgatcctgctgctcgtgctcgccctcggtggggggccgacccatgatcggctgggattccgctactggagtgaccctggagcattcaaagagtattcgaagaaagacacgcacattaagggcggcctcggcaagtttgtggccttcttgtcggtgttcgtgtatgccctctttgcctacctgggtaccgaactgtgcggtattgtcgctgcggagtgcaaagacccgcgccgcaacgtgccccgcgccatcaaactaacgctgtaccgtatcgtggtgttctacctcgtcaccatcttcctccttggcatgtgcgtcgcttataatgatccccttttgatgcaggcatctagtgccgaagtgtccgcggctgcatctccatacgtggtggcgatcgagaatgctgtcattcctgtccttccaaatctgttcaatgcctgtgtgctaacctttgtgttcagtgcctgcaattcggacctgtatgttggaagcagatccctttacggcctggcgatcgacgggaaggctcctaagctctttgccagaacgaacaaatggggtgttccgtacaacgcccttgcatgctgcacactgttctgctgccttgcatacatgagtgtctcgaagtctgccaggactgcatttggctacttcgtgaatgtcacatccatcttcgggctaatgtcgtgggtgtcgattctaatcacatacatttgttttgacagggctttccgtgcacaggggataccgaagtcgacactctcatacgtggcaccatgccaaccatatgcaggctgggtcgccctgattttctgcatcttcgtggccttgattaagaattttgatgccttcataggcaaggaggtagacgttccgaccttcatcacgggctacattgggcttccaatttacatattctgctttattggatacaaaatagtgcacaagacgaagtggataccgtcaaaggaagtggatctcttcacatttaaagaagctattgacttggaggaagaggagtgcatcagagagcgcgcattaatgaaggagcagcttgctaagggtgggttgtcatggaaaaagatatatgacaacgtgttaggatggatcttctga

SEQ ID NO: 9452 - protein, 588 aa, Ashbya gossypii
MAEEKFAQASEASTLDELKGPKLAAAGEGRGLRHTHSSTDQEAQSVDWNYDGKHEGIRLKKDLQARHVSMIAIGGSLGTGLLIGTGSSLMRAGPGSILIAYSIMGWVVFTVMSCLGEMAAYIPLDGFTSYATRYADPALGFAVGWAYLFKYLVLTPNQLTAGALVIQFWIPAARVSPGVWITVVLAVIVVINTVGVRFFGEFEFWLSSFKVLVMLCVMILLLVLALGGGPTHDRLGFRYWSDPGAFKEYSKKDTHIKGGLGKFVAFLSVFVYALFAYLGTELCGIVAAECKDPRRNVPRAIKLTLYRIVVFYLVTIFLLGMCVAYNDPLLMQASSAEVSAAASPYVVAIENAVIPVLPNLFNACVLTFVFSACNSDLYVGSRSLYGLAIDGKAPKLFARTNKWGVPYNALACCTLFCCLAYMSVSKSARTAFGYFVNVTSIFGLMSWVSILITYICFDRAFRAQGIPKSTLSYVAPCQPYAGWVALIFCIFVALIKNFDAFIGKEVDVPTFITGYIGLPIYIFCFIGYKIVHKTKWIPSKEVDLFTFKEAIDLEEEECIRERALMKEQLAKGGLSWKKIYDNVLGWIF

SEQ ID NO: 9453 - DNA, 2220 bp, Ashbya gossypii
  CDS (1)..(2220)
atgcctgcgacagacacggaatgtcgttgcgcagatagtgctcccgcaccaccttggtcgcgccgccgttgcgcgagcgcacaaacaccttctgcgtcacactcagtccctcagataggcgctttctacctgtcgtcatgctctgtccctgtgcttttacggttgaatgcctatagttctgcacctcatctctcatttccgctctcttcgctacaaaatttacttccgtatgccacgatgcgatgctttcccgggacttacgagaggcaaatcaggtgctcgaacgtatctttctcgtctgtcgctcgctatccctcgactgcggcaggcctatcttcgcaggcacggcctcgaggctcgagcacctcgagcctcgaaaaaacccagacaaaccttgaagaaaaattagagactatattagtagaggaccgtttgagagttacaatgctggacacggacgtacgaggcaagatgatacatcaaaaggacgtcgaaaaggcggccagtgaactgtcgaatacctcagctgtgcagcgagtgttaaaaaaacggagcagtgtgctcgaggaatctcgactgttggaagagagcaggacaaataagcgaggtttagtgcgcagatgcatcgactcgttcaaaccgcccgtggatgggtcgttcgacccggataatctgaagcggacgcttaagtcgcggcacttgatcatgattgcgatcgggggctcgattgggaccgggctgttcattgggtcgggtaaagcactggcaacgggcgggccgcttgccgtgctgattgggtggacgctggcggggacgcagatggtggggacgatacacgggctgggagaggtcacggtgcggtttccggttgtgggggcctttgccaactactcgacacggtttctggacccgagcgtgagcttcgtggtgtcctccatttacgtgctgcagtggttcttcgtgctgccgctggagatcattgccagtgccatcacgatggagttctggacgacgtcggtggacccggtggtgtgggtagcggtcttctacacgctgatcatctcgattaacctgttcggcgtgcgctggttcggcaagccgaagtttgtgttctcggtgatcaaaatggtgcccatatgtgggttcatcatcctgtgcctggtgctgatcctgggcggcggcccgacgcacgagttcatcggcgcgcggtactggcacgacccgggcgccctggcgaacggcttcaagggcgtggctgccgtgatggtgacagcgtcctactcgctgggtggctctgagatgacatgtctcgcatccggcgagaccgatccaaaggagattccgcacgctatcaaacagatattctggcgcatcatcttcttcttcctggtttcgctgaccctggtgggcttcctcgtgccgtacacgaacgaccagctgctggggggctccaacgtcaacaactcgccttttgtgattgcaatcaagatgcacaacatccgcgtgctgccgcacataatcaatggtgtgatcctggtcagcatcctcagcgtcgggaattcgtgcatctttgcgtccagtaggacgctgtgctccatggcacaccagggcctgctgccccgcatattcggctacgttgatcgcgccggcaggcctctgacaggcatcctgaccaactcgcttttcggtcttttggccttcctggtgaagtccagctctacgggcaccgttttcacttggctcatggccgtggccgggctggccaccgctgtcgtctggctcagcattaacgtttctcacatccgcttccgtcttgccatgaaggcccagggaaagtctctcgacgagctggagtttgtgagcgccgtcggcatgtggggctccgtatactccggtgtcatgaacgttgtcgtcctggttgcgcagttctacgtctccttatggcctatcgagggctggaaagacccacgcgggcgcacggaggccttcttccagaactacctctgcgccctgatcctgctgttcatgtttgtcgcccacaagatctactaccgctctacgaccggccagtggtggaagatcctgccgctcgcagaaattgacctagaaagtggcagaaagaacatagacatcgaggtggtgaagcacgaggtcgctgctcggaaaaagtacatcagcgagcagcgctggtacattagatactaccattactggtgctag

SEQ ID NO: 9454 - protein, 739 aa, Ashbya gossypii
MPATDTECRCADSAPAPPWSRRRCASAQTPSASHSVPQIGAFYLSSCSVPVLLRLNAYSSAPHLSFPLSSLQNLLPYATMRCFPGTYERQIRCSNVSFSSVARYPSTAAGLSSQARPRGSSTSSLEKTQTNLEEKLETILVEDRLRVTMLDTDVRGKMIHQKDVEKAASELSNTSAVQRVLKKRSSVLEESRLLEESRTNKRGLVRRCIDSFKPPVDGSFDPDNLKRTLKSRHLIMIAIGGSIGTGLFIGSGKALATGGPLAVLIGWTLAGTQMVGTIHGLGEVTVRFPVVGAFANYSTRFLDPSVSFVVSSIYVLQWFFVLPLEIIASAITMEFWTTSVDPVVWVAVFYTLIISINLFGVRWFGKPKFVFSVIKMVPICGFIILCLVLILGGGPTHEFIGARYWHDPGALANGFKGVAAVMVTASYSLGGSEMTCLASGETDPKEIPHAIKQIFWRIIFFFLVSLTLVGFLVPYTNDQLLGGSNVNNSPFVIAIKMHNIRVLPHIINGVILVSILSVGNSCIFASSRTLCSMAHQGLLPRIFGYVDRAGRPLTGILTNSLFGLLAFLVKSSSTGTVFTWLMAVAGLATAVVWLSINVSHIRFRLAMKAQGKSLDELEFVSAVGMWGSVYSGVMNVVVLVAQFYVSLWPIEGWKDPRGRTEAFFQNYLCALILLFMFVAHKIYYRSTTGQWWKILPLAEIDLESGRKNIDIEVVKHEVAARKKYISEQRWYIRYYHYWC

SEQ ID NO: 9455 - DNA, 1494 bp, Ashbya gossypii
  CDS (1)..(1494)
atgatatccattggtgggaccctaggtacaggtctattcatcggcattggccagtctttgcagagcggcccgggtacccttctgatcggttttctgattgtgggtgtgtccatcttctgtgtgattcagtcggcagcagagctgtcgtgccaatatccggtgtcgggctcgttttcctcccatgtgtcgcgtttcatcgagccatcgctgggcttcaccgtgtcttgtgcgtatgcgctatcgtggctgatatcttttccaaacgagctggtgggattagctatgaccattggttactggaatgaggatataccgcctgctgtatgggtgttgatcggctatctactggttattggtcttaaccttttcgctgtacgtggctttgcggagtcggagttctggctttctatcatcaaagttttggcgatcattatattccttatcattggcattgtgatcatctgcggcggagggcccaataacaaagaaggttatctgggagggaagtactggcacgacccaggtgcgttccggcctccgttcttcagcagcctgtgccagacatttgtgtctgcagcattcacattcggcggcgccgagttggttttgctaacagccaacgaatcacgcaagattgagtccatctccagagcagccaagggcactttctggagaatcgccatcttctacatttccaccgtcattgttatcggatgtctggtaccgtacacgtctcctgccttggatggcgaaagcattagagcatcacctttcgtgattgcgctatcgaacactggctcctttggcactaatgtgagccacttcatgaacgcggtgattgttgcagcagtgctctctgtctgtaactcgtgcgtgtatgctgcatctcgtgtgattcagtcactcggtgcttgtggccagcttcctgaaatatttggctatattgacaagaaaggaagaccgctcgtcggcatcggtgtgtgtgcagtattcgggttactggcttttctggtagagactaccaaggtgaaggacgtgttcaactggctcttcgccctctgttccattgctgcattcttcgtctggttctgcatttgcgtctcgcagctgagatacagacgtgctctaaaggtacaggggttccctactgaggaaatagcctaccagtccatgcttggtaagtggtccggagtcatcgggaccctgctaaacttcctcctgatatgtggagaaatatacgtctctgtaaaagatggtgatgtggagaccttctttcagaattgcatgtccattccgctgttgataatattctacttctgccacagactatacagacgtgattggaaaacgtggctgatcccagcgcgcgacttggatctcaacacagggaggaagccagaggacctcgaaatgatgaagcacgaactgatagtttctagggccaggattgcgtcaagcccctggtactacagggcatatagattttggtgctag

SEQ ID NO: 9456 - protein, 497 aa, Ashbya gossypii
MISIGGTLGTGLFIGIGQSLQSGPGTLLIGFLIVGVSIFCVIQSAAELSCQYPVSGSFSSHVSRFIEPSLGFTVSCAYALSWLISFPNELVGLAMTIGYWNEDIPPAVWVLIGYLLVIGLNLFAVRGFAESEFWLSIIKVLAIIIFLIIGIVIICGGGPNNKEGYLGGKYWHDPGAFRPPFFSSLCQTFVSAAFTFGGAELVLLTANESRKIESISRAAKGTFWRIAIFYISTVIVIGCLVPYTSPALDGESIRASPFVIALSNTGSFGTNVSHFMNAVIVAAVLSVCNSCVYAASRVIQSLGACGQLPEIFGYIDKKGRPLVGIGVCAVFGLLAFLVETTKVKDVFNWLFALCSIAAFFVWFCICVSQLRYRRALKVQGFPTEEIAYQSMLGKWSGVIGTLLNFLLICGEIYVSVKDGDVETFFQNCMSIPLLIIFYFCHRLYRRDWKTWLIPARDLDLNTGRKPEDLEMMKHELIVSRARIASSPWYYRAYRFWC

SEQ ID NO: 9457 - DNA, 1677 bp, Ashbya gossypii
  CDS (1)..(1677)
atggctgacagagcttctagcgcaagtattgagaaggcagataatggcgggtatatgcataaagtgaaaacgcctcactcgcgcacatcgcttgaggagctggagacgcagagtgcaggatccgagtacaatactttacacaagggcctacagagcagacatatccagctgattgctcttggaggctgtattggtaccgggttgttcgtggggacgtcatggacactacataactgcggcgctgcgccgcttctgctgtctttcatactgatttcgacgatagtgtaccccatcatgtgctcgctggcggaaatgatctgctacctaccacagcaggggtcggtgccagagcttgtgtcgcgttatgtggacccgagtctcggttttgccaccggttggaactatgcatatgcatacgcgatattagttgccgctgaactgtctgcggctgcgtcggtcgtcagctactgggacaaccccgtccccatggccgcctggattaccatcttcctggttgttgtggtgggcctgaactttaccgcggtcaagtactacggcgaagcagagttttggtttgcctcgatcaagctgatatgtattctcgggctactggtcgtatccgtggtaatcttcttcggcggcgctcccaaccacgaccgtactggcttccgctactggaagaacccggggccctttgcgatgagcctcgcgccaggaagcacgggccgtttcttggacgtgtggcgcgccgtgatcaagtcggccttcgccttcatcctatcaccagaacttataggcattgcatgcgtcgaggcgcaggacacccggcggaacactgagaaggcatcgagacgtttcatataccgtattatctttttctatgtgagctgcgcgctcatgatcggcgtcatcttatcaagaactgatccgaaactcatagaggcgctggagacaggcgcgccaggcgctgcctcttctccgttcgtgcaggggattgccaacgcagggattcccgtgctcgaccacgtcatcaacgtcgcgatcttgtcttctgcgtggtcggcaggcaactccttcatgtatgcatccacgcgcatggtgctagcgcttgcgcgcgagggaaatgcgccaaagttcctcaccaagatcaacagatatggtgtgccctacaacgcggtcatcgtctgcacgctcgtcgcctgtctggcctacctgaacgtcaagacgacatccgcaaatgtgttccagtggctgtcgaacatatgcaccatctccggcttcatcggctggttcgccatgggcatcgcgtttatccgtttccggcgcggtatcgtgttcaacaacctccaaagccgtatcccataccagggtccactgcagccatatatcgcctactacttcacattcatgactgttgtcgtgtgtctgacgaatggtttccacgtcttcctcaaggggcgctggaatgtcgtcgacttcgtcgccgcctacgttaccttgcccatctacctggtgctctacctaggccacaagctatggttccgcacgcggtggtacattcctgttgaacaaatcgacgtcataaccggtctcgtggaggcagaggaggaaagcaagatgacccctcctcgcataccaaagaatctatgggagaagttcctctactggcttctgtaa

SEQ ID NO: 9458 - protein, 558 aa, Ashbya gossypii
MADRASSASIEKADNGGYMHKVKTPHSRTSLEELETQSAGSEYNTLHKGLQSRHIQLIALGGCIGTGLFVGTSWTLHNCGAAPLLLSFILISTIVYPIMCSLAEMICYLPQQGSVPELVSRYVDPSLGFATGWNYAYAYAILVAAELSAAASVVSYWDNPVPMAAWITIFLVVVVGLNFTAVKYYGEAEFWFASIKLICILGLLVVSVVIFFGGAPNHDRTGFRYWKNPGPFAMSLAPGSTGRFLDVWRAVIKSAFAFILSPELIGIACVEAQDTRRNTEKASRRFIYRIIFFYVSCALMIGVILSRTDPKLIEALETGAPGAASSPFVQGIANAGIPVLDHVINVAILSSAWSAGNSFMYASTRMVLALAREGNAPKFLTKINRYGVPYNAVIVCTLVACLAYLNVKTTSANVFQWLSNICTISGFIGWFAMGIAFIRFRRGIVFNNLQSRIPYQGPLQPYIAYYFTFMTVVVCLTNGFHVFLKGRWNVVDFVAAYVTLPIYLVLYLGHKLWFRTRWYIPVEQIDVITGLVEAEEESKMTPPRIPKNLWEKFLYWLL

SEQ ID NO: 9459 - DNA, 1815 bp, Ashbya gossypii
  CDS (1)..(1815)
atggcgaaacaggcaggaacgccggacgacgacgtcgaggacatagagaaaagcttctatgtaagtggaaaagagcaagcgcgcgtgagtacagacttggcggtggatgagccaatttctgtacagccggagcctcggaaagggtggaacggttttgtcgacacgttcaggcgggcagagatgcccgtcatagatcccaacctgtctgaggctgagaagctggccatccggactgcggccgcgccgctgagtaggcgtctgaaaaaccggcacctgcagatgattgcgatcgggggcgcaatcggggtgggtctgttcgtcgggtcaggaaaggcgctcgccacggcggggccggcaggggtgctgatcggctggggtctaacggcaacgatgatcttgatcatgtgtctgtcgttgggagagcttgcggtgacgtttccggtgtccggggggtacattacgtatgcagcgcggttcattgacgagtcgtggggctttgccaacaacttcaactacatgatgcaggctatggtggttatgccactggagattgtagctgcttcagtgactgtgggctactgggatacagatccaaagtacaagttggcgtttgtggccttgttttgggtggtcatcgtctccatcaaccttttcggtgtgagggggtttggtgaggctgaaagcatcttttccctaattaaggtaatcacgatcatcggcttcataataatgggcgttgttcttatatcaggcggtggaccagatcacgaggtgataggtggtaagtactggaatgatcctgggccctttgtcggtaatgcgcctagtgataagttcaagggcgtgtgcagtgtgtttgtcacagcggcattctcgttcgcgggatcagaacttattggtctagctgctgcagaaacgcgggagcccagaaaatcaattcccaaggctgcaaagcaggtgttctggaggatcacattattctacattctgagtttgctgattgtgggcctgttagtcccatccaacaacgagcacctactagctcctcaacagatcgatgctgcacattcgccattcgtgattgcgatggacatgcatcgtattcgcgtcctgccatcaattattaacgtcgttatactgactgccgttatctctgtcggtaactcgtccgtgtatagctcttccaggaccatgtgtgccctggctgaacatggattcttgccaaagatctttggctatattgacaggaaaggcaggcccctgtttgcgatatgctttacttccctttttggtttgctctgtttcgtagcgggcgcgaaggaggagggtgagatatttgactggctattggcgatatccgggttgtcatccttcttcacgtggctcacaattaacctggctcatatgcggttccggatggcgttaaaagcccaaggaagaactaccaatgaactctcatttacaagtcctactggatttattggatcctgttatgctgtcggtctgatttgcgttgttttggttgctcaattttgggttgcactctaccctccatctccagatggaaccagcgcaaagccttcgcccatcttgttctttaagcaatatctttcgttcgctgtcgcaatagttatgtaccttgcacacaagatatggtcaaggaattggaagttttttattaaagccaaggagatggacatcgataccggtcggagagagctcgatttggagcttttcaaagaggagcttgctcaagaaagggcacttcttgctcagaagccctttattattagagtgtttaacttctggtgttag

SEQ ID NO: 9460 - protein, 604 aa, Ashbya gossypii
MAKQAGTPDDDVEDIEKSFYVSGKEQARVSTDLAVDEPISVQPEPRKGWNGFVDTFRRAEMPVIDPNLSEAEKLAIRTAAAPLSRRLKNRHLQMIAIGGAIGVGLFVGSGKALATAGPAGVLIGWGLTATMILIMCLSLGELAVTFPVSGGYITYAARFIDESWGFANNFNYMMQAMVVMPLEIVAASVTVGYWDTDPKYKLAFVALFWVVIVSINLFGVRGFGEAESIFSLIKVITIIGFIIMGVVLISGGGPDHEVIGGKYWNDPGPFVGNAPSDKFKGVCSVFVTAAFSFAGSELIGLAAAETREPRKSIPKAAKQVFWRITLFYILSLLIVGLLVPSNNEHLLAPQQIDAAHSPFVIAMDMHRIRVLPSIINVVILTAVISVGNSSVYSSSRTMCALAEHGFLPKIFGYIDRKGRPLFAICFTSLFGLLCFVAGAKEEGEIFDWLLAISGLSSFFTWLTINLAHMRFRMALKAQGRTTNELSFTSPTGFIGSCYAVGLICVVLVAQFWVALYPPSPDGTSAKPSPILFFKQYLSFAVAIVMYLAHKIWSRNWKFFIKAKEMDIDTGRRELDLELFKEELAQERALLAQKPFIIRVFNFWC

SEQ ID NO: 9461 - DNA, 1692 bp, Ashbya gossypii
  CDS (1)..(1692)
atggcgccaaaggatacggcggtgtcggagacctctacgcggtctcgctatatcaaaaagggcaagactttagagaatgacattgagctacagtcggtgacgccagccaccggggagttccccgaggaccacacggaagagggcgactaccaggagacggaggtcaagagggcgctgaaggcgcggcacatctcgatgatcgcgctgggcgggacgataggcacaggcctgttcattgtgattgcatccccgctgcggacagcggggccagtggggtcgctgttggcgtacatcttcatcggtacggtggtgtactcgatcacgcagtcgctgggggagatggcgacgttcattcctgtgacgtcgtcggtgacggtattttcaaagcggtttctgtcgcctgcgtttggcgtggcaaacgggtatatgtactggttcaactgggcgatcacgtttgctgtcgagctttctgtggttggccagatcatacagtactggacggaccgcgtgccaatcgcggcgtggattgtgattttctgggtcctggtgacgctagttaacttcttcccggtgcgcttctacggtgagatagagttctggattgcgtcggtcaaggtgctgaccattgtgggctatcttatttacgcgttcattattgtctgtggcggctccaagcagggcccaatcgggcttcccgccactggcgggatccccgcccgtggggcaagggcgtcatctcgcacaaccagaaagaggcacggcttcctcggctgggtctcgtcgctgatcaaggctgcgtttacgtaccaggggacagagcttgtcggtatcactgcaggtgagtccacgaacccaagaaagaacgtccccaaggccatcaacaaggtcttcttccggattctattcttctacattggctcactgctattcgttggcctgctggtgccctacgatgaccctcggttaaacagcgagtctagcacggacgtcaatgcctcaccatttgtgatctccattaagaatgcaggtacaaagattttgcccgacatctttaacgctgtcgtgctgatcaccgtcatttccgcagcgaactccaacgtttacattggctctcgtgttgcatactctctggcgctcgctggcaacgctcccaagcagcttgccttcgtcaccaagcagggtgtgccctacttcggcgttctgatcacgtcgctaatgggcctgatgtccttcctcgtgctcaaccacaacgccagcaccgcattcgactggctggttaacatttccacccttgcaggcttgtgcgcctggcttttcatctcgctcgcccacatccgcttcatgcagtgcctcaagcatcgcggcatttcgcgcgacgacctgccgttcaaggccaagttcatgccctgggccgcatactacgcaaccttctttgtcacggtcatcatcttcatccagggctacactgccttcactccgaagttcgacgttaccaccttcttcacctcctacatctctctatttttgatgctgctggtgttcatcggctgccagatctactacaagtgtcgctttctgtgggcggttgaggacatcgacatcgacagcgaccgccgcgagatcgacgccatcgtctgggaagaggatgaacccaagaacatttgggacaagttttggtctgctgtggcctag

SEQ ID NO: 9462 - protein, 563 aa, Ashbya gossypii
MAPKDTAVSETSTRSRYIKKGKTLENDIELQSVTPATGEFPEDHTEEGDYQETEVKRALKARHISMIALGGTIGTGLFIVIASPLRTAGPVGSLLAYIFIGTVVYSITQSLGEMATFIPVTSSVTVFSKRFLSPAFGVANGYMYWFNWAITFAVELSVVGQIIQYWTDRVPIAAWIVIFWVLVTLVNFFPVRFYGEIEFWIASVKVLTIVGYLIYAFIIVCGGSKQGPIGLPATGGIPARGARASSRTTRKRHGFLGWVSSLIKAAFTYQGTELVGITAGESTNPRKNVPKAINKVFFRILFFYIGSLLFVGLLVPYDDPRLNSESSTDVNASPFVISIKNAGTKILPDIFNAVVLITVISAANSNVYIGSRVAYSLALAGNAPKQLAFVTKQGVPYFGVLITSLMGLMSFLVLNHNASTAFDWLVNISTLAGLCAWLFISLAHIRFMQCLKHRGISRDDLPFKAKFMPWAAYYATFFVTVIIFIQGYTAFTPKFDVTTFFTSYISLFLMLLVFIGCQIYYKCRFLWAVEDIDIDSDRREIDAIVWEEDEPKNIWDKFWSAVA

SEQ ID NO: 9463 - DNA, 1671 bp, Ashbya gossypii
  CDS (1)..(1671)
atgactaacataatatatgagcccaagggcgatggatcgtcgagctcgaccatcacggccaagcctggcgcgatcaaggccgaggtgctgaaccataataccagcgaggtcgagtcgctttgcgaaaagccgaaccagtccgatgtgaagcgggagttgaagccaaggcacgtaacgatgatctcgttgggcgggactatcggaactggtctcttcatcggtattgcctcgcccatcaggaatgctggcccagttggttcgttgcttgcatacatctttgtcgctacgatggcctactgtgtaacgcagtcgctcggtgagatggcaactttcataccggtaacgtcgtcattcaccgtttttgcatctcgttttgtgtcacctgcattgggtgctgcgaacggctacctgtactggctatcgtggtgcatcacgtttgcacttgagatctctgtcatcgggcgacttatcctctactggtcggacgcagtcccgatcacagcttggatggccatcttctgggttctcctcacagcaattaacttaattcctgtgaagttctacggtgaattcgagttctggattgcatcgctcaaggtgatagccatcttgtgcttccttttttacggcctagtcgtcgtgtgcggtggatccaagctgggccgaatcggcttccgctactggaaggaccccggcccgtggggcgtgggcatcgtatcccaggaaattcacacagcgcagtttctgggttgggtgtcctcgctaatcaaagcggcatttacattccagggcaccgagttggtgggtgtcaccgcaggcgagaccaagaaccccagacggacggtccccaaggccatcaacacggtcttcttccggatcctactcttctacattgggtcccttctcgtcatcggactcttggtacggtacgacgatcctcagcttatccaggacgggtccactacaaacgccaatgcatctccattcgtcgtcgcaatcaacgctgcaggcaccaaagtgttaccggacatcatgaatggtgtcatcatggtgaccatcatctccgcaggcaactccaacatctacgtcggctcgcgtgtcctctacggcctgggccgcagcggcttagcgcccgccttcatcagccgcaccacctcaaggggcgtcccatacgtcgccgtgctcgccacttccatgttcggcgcgctcggctatctcaacgtcagcagcaaatcgggcagcgtctttgactggttgctcagcattaccgctgtctcaggcttcttcacatggctcctcatcagtgtctcccacatccgctttatgcagtgccttaagaagcgcggcatctcgcgtgacgacctaccgtttaaggccaagttcatgccttacggcgcctattacgccgccttcttcgtcatcgtcatcatcctcgttcagggttttaccgccttcacccccttcagtgccgttgacttcgtcgcctactacatctcggccttcatctttgtcgttatctggttgctcttccagtttctcttcaagggccgctggttccatactgtcgacgagatcgacatcgacaccgaccgccgcgacatcgacgcaattatctgggacgacgacaagcctaccaccctgtgggggaagatctggtaccatctctcgtga

SEQ ID NO: 9464 - protein, 556 aa, Ashbya gossypii
MTNIIYEPKGDGSSSSTITAKPGAIKAEVLNHNTSEVESLCEKPNQSDVKRELKPRHVTMISLGGTIGTGLFIGIASPIRNAGPVGSLLAYIFVATMAYCVTQSLGEMATFIPVTSSFTVFASRFVSPALGAANGYLYWLSWCITFALEISVIGRLILYWSDAVPITAWMAIFWVLLTAINLIPVKFYGEFEFWIASLKVIAILCFLFYGLVVVCGGSKLGRIGFRYWKDPGPWGVGIVSQEIHTAQFLGWVSSLIKAAFTFQGTELVGVTAGETKNPRRTVPKAINTVFFRILLFYIGSLLVIGLLVRYDDPQLIQDGSTTNANASPFVVAINAAGTKVLPDIMNGVIMVTIISAGNSNIYVGSRVLYGLGRSGLAPAFISRTTSRGVPYVAVLATSMFGALGYLNVSSKSGSVFDWLLSITAVSGFFTWLLISVSHIRFMQCLKKRGISRDDLPFKAKFMPYGAYYAAFFVIVIILVQGFTAFTPFSAVDFVAYYISAFIFVVIWLLFQFLFKGRWFHTVDEIDIDTDRRDIDAIIWDDDKPTTLWGKIWYHLS

SEQ ID NO: 9465 - DNA, 1830 bp, Ashbya gossypii
  CDS (1)..(1830)
atgccgagagacactggtctaccgtcagggtcctcgactggagccgtcctggttgacggggagctgaaagacatcaagtctggaaaggttgtgacgacggagacaacggaattctttgaaaaaacctccgctcaaaagagtgactttgaatacctagaaggagatgatacccggtttaagcgcttcctgagctctttcaaacgggctcatgggtccggtgggactgatactgagggcggcggtggacaaaatgccaaacatgagaacctgaagcaaacgatcaagtcgaggcatatgattatgatttcgcttggcaccggtatcggtactggtttgttggttggtagtggtactgccctgcacgacggtggtcctgcaggttctgccattggtttcttaattatgggtctgtgcgtctactgtgtcatccaagccgctggcgagctagccgtgtgctacacatcattggcaggtggatttaacgcctacccgtcatttctaattgatcctgcgctcggtttcgcaactgcatgggtttactgtttacagtggctctgtgtcttcccactagagttagtcactgcatccatcaccatcaagttctggcctgggtctcggtcagtgaatccagatatttatgttgccatcttctatgttctcattatcgttatcaactttttcggggccagggggtacgcagaagccgagttcttcttcaatagctgtaaggtgcttatgatgatcgggtttttcattgtcggcattctcatcaacaccggcgctgttggtacctcgggctacatcggaggcaagtactggagagatccgggctctttgggcggtcgtacacatttcgatcatttcaaaggtatcgttgctaccctagtcaacgcagcattctctctcggttgctctgaatttgtagctctgacggctgcagaacaggctaaccccaggaagtcgattcctgctgctgcaaagaagatgatctacaagatttttgttgttttcttgggctcagtaattcttattggtttcttggtgcccaaggactcgcatgagcttatgggctctaatgattccgatttgcatgtttcaccatacgtcattgctgtcagaatgcacggtgttaacgtcgtccccagttttattaacgcagtcatccttctctccgtgctttcagtcggtaactcagcattttactcttcctcccgtctgctacactcgctggcggaacagaactatgcgccaaaaatctttaagtacatcgatcgcgcaggaagacctctcatggccatgatcatctcgattcttttcggtaccatatgttttgttgctgcatctccaaaagaagaggaggtcttcaagtggctattggccatctctggcctctctcagctcttcacatggtcgactatctgcctatcacacatccgcttccgccgcgcgcttgctgtgcagggctattctacagatgagctcggatttaaggcgcagacaggtatcattggctcgtacgtatccgctatcatgatggtgctcgctctgatcgggcagttctgggtgtcgctcgtgcctatgggcgcgacagaaccagatgccgagtctttcttcacaggctaccttgccatgccaatgttcctgctattctactttggctacaagatctggaacaaggactggcgcctctttatccgggctgaccaaattgacctggtctcgcaccgtcgcatcttcgacgcagacgtgctcaaacaagaagacatcgagtaccgcgcaaagctacgcaactccagcatctggcacaggatcgccaatttttggtgctaa

SEQ ID NO: 9466 - protein, 609 aa, Ashbya gossypii
MPRDTGLPSGSSTGAVLVDGELKDIKSGKVVTTETTEFFEKTSAQKSDFEYLEGDDTRFKRFLSSFKRAHGSGGTDTEGGGGQNAKHENLKQTIKSRHMIMISLGTGIGTGLLVGSGTALHDGGPAGSAIGFLIMGLCVYCVIQAAGELAVCYTSLAGGFNAYPSFLIDPALGFATAWVYCLQWLCVFPLELVTASITIKFWPGSRSVNPDIYVAIFYVLIIVINFFGARGYAEAEFFFNSCKVLMMIGFFIVGILINTGAVGTSGYIGGKYWRDPGSLGGRTHFDHFKGIVATLVNAAFSLGCSEFVALTAAEQANPRKSIPAAAKKMIYKIFVVFLGSVILIGFLVPKDSHELMGSNDSDLHVSPYVIAVRMHGVNVVPSFINAVILLSVLSVGNSAFYSSSRLLHSLAEQNYAPKIFKYIDRAGRPLMAMIISILFGTICFVAASPKEEEVFKWLLAISGLSQLFTWSTICLSHIRFRRALAVQGYSTDELGFKAQTGIIGSYVSAIMMVLALIGQFWVSLVPMGATEPDAESFFTGYLAMPMFLLFYFGYKIWNKDWRLFIRADQIDLVSHRRIFDADVLKQEDIEYRAKLRNSSIWHRIANFWC

SEQ ID NO: 9467 - DNA, 1722 bp, Ashbya gossypii
  CDS (1)..(1722)
atgcaagatatgacctcctcgatatcttcttccaagaaggacgagagctacgtgaaggtcagccccaataccgtggggtctggcgatgagcggcgcaccggcataatgcggggtttcatagactcgttccgccgcgggcgcgatgttgacttaatgtgcaaggctgacgcggaggatggcacgaccgcgaaaatgaagaagacgattaagaccaggcatctattgatgattacacttggaacgggtatcggaacgggtttgcttgtgggcaatggttctgctctagcaaaggctgggcctgcgggtttgattctaggatacgtagtgtcctctgcgatgttgtacttgattgtcgaggccgctggtgagctaggtatttgctactctgggatgactggtaactacactgcatactcgtcgcttctcgtggaccccgctatgggattctccgtctcatgggtttactgtattcagtggatgacagtcttcccgctacagttggttaccgctgctatgatcattcaatactggacggacataaatcctgatatctttgttgcgattatctatgcagtcatcgtgttcatcaatttgttcggtgcgaaaggatatgcggaagcagagttcttcttcaacttgtgcaaagttctgatgattattggtttcgtgatcctaggtgtcgtcattaactgtggcggtgccggtacctccggatacatcggtgacaagtactggcacgaacctcgtccgtttatgaacggtttcaagggtttatgctttgtcttttgctacgctgcatttgcatacggtggtattgaagtgatggttctaagtgcatctgaacaagagaaccctaggaaatccatctccagtgcgtgcaaaaaagtcatctaccgtattgtcctcatctacctattgaccactgtaattgtgtgctttttggtgcctgcagaccatccaagtttggcgtctgagggcagtcgcgcttctccattagtcattgccgtctccttccatggtgtgaagattgttccacatattatcaatgctgtcatcttaattgctgtcgtctctgttggaaactcctctctatactccgcaccaagactattgctttctttggcggagcagggctacgctccaaagatattcacatacatcgacaggcaaggtagaccattgccagccttctttgttgccatggtattcggtcttttggccttcttggccgcttcgccagctcaggacgacgtcttcggatggttgttggctatctctggtctttcgcagatgtttatctggatgtcgatctgtatctcgcacattcgcttccgtgatgccatgaaggcacaggggcgttccatgggtgaggttggttacaaggccagaactggctactggggctcgtggatagctgtcgtcactgctttcctcatcctaatcgcccagttctgggtcgccatctctcctgtcgagacgaaaggcgtcgacgctcgctccttcttccagagctacctagcgttccccattctactattggcctacttcggttacaaaatctaccataaagactggcgtatctgcattccagcttcggaggtcgacttaatttcgcacagacaagtcttcgatgaggacgagctaaagcaagaagacctagagtggaaactaaaactaaagagctcgccaatttgggttagaatataccacttctggtgttga

SEQ ID NO: 9468 - protein, 573 aa, Ashbya gossypii
MQDMTSSISSSKKDESYVKVSPNTVGSGDERRTGIMRGFIDSFRRGRDVDLMCKADAEDGTTAKMKKTIKTRHLLMITLGTGIGTGLLVGNGSALAKAGPAGLILGYVVSSAMLYLIVEAAGELGICYSGMTGNYTAYSSLLVDPAMGFSVSWVYCIQWMTVFPLQLVTAAMIIQYWTDINPDIFVAIIYAVIVFINLFGAKGYAEAEFFFNLCKVLMIIGFVILGVVINCGGAGTSGYIGDKYWHEPRPFMNGFKGLCFVFCYAAFAYGGIEVMVLSASEQENPRKSISSACKKVIYRIVLIYLLTTVIVCFLVPADHPSLASEGSRASPLVIAVSFHGVKIVPHIINAVILIAVVSVGNSSLYSAPRLLLSLAEQGYAPKIFTYIDRQGRPLPAFFVAMVFGLLAFLAASPAQDDVFGWLLAISGLSQMFIWMSICISHIRFRDAMKAQGRSMGEVGYKARTGYWGSWIAVVTAFLILIAQFWVAISPVETKGVDARSFFQSYLAFPILLLAYFGYKIYHKDWRICIPASEVDLISHRQVFDEDELKQEDLEWKLKLKSSPIWVRIYHFWC

SEQ ID NO: 9469 - DNA, 1881 bp, Ashbya gossypii
  CDS (1)..(1881)
atggacagtggcatgtgtcacgtgctagtgaccaaattcgctgacacctctacaaagcaagagatgagtaacagtcgatcttacttgacaacgacagctcaccaatccctcagttcagaagcgctcagcatgggttcactcgatgcgcgcagtcctcagaaggacgtgtggtatactagactgctcaacgatttcaagcgggctgacgaaggagaaaccacccggtccgttgcggactcggatatggaggtggacgggaagcgctacaaggagatgactgacgtggagcgcgccgtgtgcgacgccgcgcgaaactcctcgcagctcagcaaaaatctgtcgatccgacacctgctgacactggcagtgggtggtgctatcggcacgggtctgttcgtgaactcaggcgcgtcgctgaacaccggcggcccgggctccattctaatcgcatggacgctaatttctacatgtttgtttaccatcgtcaactcgctcggtgaacttgcctctgcgttcccggttgtaggcggtttcaacgtgtacatcacacgcttcgtggagccctcttttggcttcgccgtcaacatcagttaccttgcccagtgggcagtgctcctgccactggagctggcagctgcatccattaccatcaaatactggaacaataaaatcaactcggacgcctgggttgccatcttctacgtctgcatagcgctcgccaatatgctggatgttaaatcgtttggcgaaacagagtttgtgctttcgatggtcaagattctggccatctttggctttgccatcctaggtacggtgctcatctgcggcggtgggcctgttggaggtttcattggtgccaagtactggcatgatcctggcgccttcgtcggagacaccccgggagcccagtttaagggtctctgctctgttttcgtgactgcggcgttcagttacagtggcaccgagctcgtcggcgtgtcagctgccgaatcgataaacccgcgctacaccattccgcgcgcatccaagagatctttctggctcattacctcctcatacctcctggtgctcaccatcgcaggctgcctcgtccccagcaacgaccccagactgttgaatggtatgtcatcggtcgacgtcgcggcgtcgccactcgttatcgccatcgaaaacggcggtattaggggcgtgccatcgttgatgaatgcaatcatcctgatcgccatcatctcggtcgcgaacagctcggtgtatgcatgctcgaggtgcatggtatcgatggcgcaggtcggaaatctgcccaaggtcttcaactacatcgacaggaagggacgcccgctcgtcgccatcctggccaccctagtgtttgggctgctgtccttcgtcgccgccagtgacaagcaggaggcaatcttcacctggctgagcgcgctgtccggcctctcgaccctcttctgctggttcgccatcaacatctcacatatccgtttccggcgtgcgatgtgcgcgcagcagcgctcgcttgacgaacttccctacctctcgctcacgggcgtcctaggctcgtggtacggcgctgcagtgctgttgttcgtcctcgtcctctccttctggacttcgctgttccccccgggcagctccgggccctctgcagagtcgttctttgagggctacctgtccttccctatcttcctgatttgctacatcagccataagctctacaagagggactggcgcctcttcatacctgctggacagatcgacgtggacagcggcagacgcgcgctcgatatcgaggagctgaaagagcagaagctccgtgagcaggcagagaccgccaagaagccgttttacgtcagatggtggattttctggtgttga

SEQ ID NO: 9470 - protein, 626 aa, Ashbya gossypii
MDSGMCHVLVTKFADTSTKQEMSNSRSYLTTTAHQSLSSEALSMGSLDARSPQKDVWYTRLLNDFKRADEGETTRSVADSDMEVDGKRYKEMTDVERAVCDAARNSSQLSKNLSIRHLLTLAVGGAIGTGLFVNSGASLNTGGPGSILIAWTLISTCLFTIVNSLGELASAFPVVGGFNVYITRFVEPSFGFAVNISYLAQWAVLLPLELAAASITIKYWNNKINSDAWVAIFYVCIALANMLDVKSFGETEFVLSMVKILAIFGFAILGTVLICGGGPVGGFIGAKYWHDPGAFVGDTPGAQFKGLCSVFVTAAFSYSGTELVGVSAAESINPRYTIPRASKRSFWLITSSYLLVLTIAGCLVPSNDPRLLNGMSSVDVAASPLVIAIENGGIRGVPSLMNAIILIAIISVANSSVYACSRCMVSMAQVGNLPKVFNYIDRKGRPLVAILATLVFGLLSFVAASDKQEAIFTWLSALSGLSTLFCWFAINISHIRFRRAMCAQQRSLDELPYLSLTGVLGSWYGAAVLLFVLVLSFWTSLFPPGSSGPSAESFFEGYLSFPIFLICYISHKLYKRDWRLFIPAGQIDVDSGRRALDIEELKEQKLREQAETAKKPFYVRWWIFWC

SEQ ID NO: 9471 - DNA, 1413 bp, Corynebacterium diphtheriae
  CDS (1)..(1413)
atgaccgaacacaccgccccaaccctcacaaaagggctcaaagtccgccatctgaccatgatgggactcggctccaccatcggcgccggcctcttcctcggcaccggcgtaggaatcaaagcagcaggacccgccgtactcatcgcctacatcatcgccggattcatcgccgtcatgatcatgcgcatgctcggcgaaatgggatccgtcgtccccgcctccggctccttctccgaatacgccgacgcaggcatcggccactgggccggattcatccaaggctgggtctactggctcgccaccgtcgcagtcctcggcgcagaaatcaccggagcctccggattcgtcgcctcatggctcggcgtctcaccatggataccagcgctcgtcttcgtcgcattcttcggactcgtcaacctcatgcgcgtccgcgccttcggcgaattcgaattctggttcgccttcatcaaagtggcagtactcgtcgttttcttgatcatcggctccctcctagtactcggcctcctaccaaatcacgacttcgttgggctcagcaatgttcgcgccgaaggattcgcgcccaccggactaggaggaatcgcagccgccctcctagccgtcgccttcggcttcggcggcatcgaagtcgtcgccatcgcctcggcagaatccgaagatccacaaaaatcgctcgtcaacgccgtgcgcaccaccatcacgcgtatcagcatcttctacctcggctcagtagccatcatcgtattgctcttgccttactcgtctcttggtaaggcgaaaagcgcagcagaaagccccttctcccaagtacttgccatggcaaacatcccaggagtagtaggcgtcatcgaagtcgtcattgtgctcgcactgctctccgcattcaacgcccagatctacgccagctcacgcatgatgatgtccctcgcggaacgtcgacaagcaccaaacatcttcgcacgcgtcgacaaccgcggagtcccactgcccgccatcgtgctctccgtcgtactcagcgtcatcatggtgatcctcaactacgtcgacaccggctggctcctcaccttcctactcaacgccgcaggcgcctccctcctcaccgtctggaccttcatcgccgtctcccaactcaaactccgacgacgcctcgaagcactccaaggcaacctagccgtacgcatgtgggccttcccaggactcaccatcgccaccctcgccatcctcttcggactcgccatcctcatgcttagcgacgccggcgcacgcatcgaactactctccgccatcgccatggtcgccatcctcttcgcgatcagccttatagcagtaaaacagccctttgacaaggccctcctgccaagagaggcgagttatccacagaactccccctcctag

SEQ ID NO: 9472 - protein, 470 aa, Corynebacterium diphtheriae
MTEHTAPTLTKGLKVRHLTMMGLGSTIGAGLFLGTGVGIKAAGPAVLIAYIIAGFIAVMIMRMLGEMGSVVPASGSFSEYADAGIGHWAGFIQGWVYWLATVAVLGAEITGASGFVASWLGVSPWIPALVFVAFFGLVNLMRVRAFGEFEFWFAFIKVAVLVVFLIIGSLLVLGLLPNHDFVGLSNVRAEGFAPTGLGGIAAALLAVAFGFGGIEVVAIASAESEDPQKSLVNAVRTTITRISIFYLGSVAIIVLLLPYSSLGKAKSAAESPFSQVLAMANIPGVVGVIEVVIVLALLSAFNAQIYASSRMMMSLAERRQAPNIFARVDNRGVPLPAIVLSVVLSVIMVILNYVDTGWLLTFLLNAAGASLLTVWTFIAVSQLKLRRRLEALQGNLAVRMWAFPGLTIATLAILFGLAILMLSDAGARIELLSAIAMVAILFAISLIAVKQPFDKALLPREASYPQNSPS

SEQ ID NO: 9473 - DNA, 1365 bp, Corynebacterium diphtheriae
  CDS (1)..(1365)
atgacacaagcaaccactgagaccgagcttggcacaggcctaaaaactcggcacctaacaatgatgggactcggctccgccatcggagccggcctcttcctcggaaccggcgttggaattgcagcagcaggacccgccgttctcatcgcctacgtcctcgcaggcatcttcgtcgtattcgtgatgcaaatgctcggagagctcgcggcagcccgcccagcctccggatccttctccgtctacgccgagcaggcattcggccactgggccggcttcagcctcggctggctttactggttcatgctcacgatggtcctcggtgccgaaatgaccggcgccgcagccatcatgggtcaatggttcggcatcgcgccatggatcccagctctcatctgcgttatcttcttcgcagtcgtcaacctcgcacgtgtcagcggctttggcgaattcgaattctggtttgcttttatcaaggttgccgtcattattctcttcctcgtcatcggcgtactgctcatcttcgggctactacccaactatgacttcgtaggaacccagcacttcctcggcgacggatttatgcctaatggtatctcaggcgtagccaccggcctcctagccgtcgccttcgctttcggtggtatcgagatcgtcaccatcgccgcagcggaatccgaagatcccaagactgccatcgccacagccgtgcgctccgtgatctggcgtatctccttgttctacctgggctctgtccttgtgatctgcttcctcatcccattctccagcatcggaggcgccaagagcgcagcagactcccccttcaccatcatccttggcatggccaacattcctggtgtggtcggattcatggaagccgtgatcgtcctcgcactcctttcagcattcaacgcccagatctacgccacctcacgcatcgtccactccttcgcagaacgtggcgacgcccccaagatcttcgcagccaccaacccctccggcgtccccatgccagccgtactcctcagcatgttcttcgcattcgtttccgtaggactgcagtactggaaccccgcaggcctcctcaacttcctcctcaacgctgtaggcggatgcctgatcgtcatctgggtcatcatcgccttcgcataccttaaactgcacccagaactcgtccgcaacggagaaatcaccaccgtgcgtatgtggggcttcccatggctcggctgggtcaccatcgcaggattcctcggactgaccgtcctcatgctgactgacgacgcctcccgcagccagatcacctccgttacggtcgtattcctcctactcatagtcgtgtcattcttcaccaagaaaaagagtaagtag

SEQ ID NO: 9474 - protein, 454 aa, Corynebacterium diphtheriae
MTQATTETELGTGLKTRHLTMMGLGSAIGAGLFLGTGVGIAAAGPAVLIAYVLAGIFVVFVMQMLGELAAARPASGSFSVYAEQAFGHWAGFSLGWLYWFMLTMVLGAEMTGAAAIMGQWFGIAPWIPALICVIFFAVVNLARVSGFGEFEFWFAFIKVAVIILFLVIGVLLIFGLLPNYDFVGTQHFLGDGFMPNGISGVATGLLAVAFAFGGIEIVTIAAAESEDPKTAIATAVRSVIWRISLFYLGSVLVICFLIPFSSIGGAKSAADSPFTIILGMANIPGVVGFMEAVIVLALLSAFNAQIYATSRIVHSFAERGDAPKIFAATNPSGVPMPAVLLSMFFAFVSVGLQYWNPAGLLNFLLNAVGGCLIVIWVIIAFAYLKLHPELVRNGEITTVRMWGFPWLGWVTIAGFLGLTVLMLTDDASRSQITSVTVVFLLLIVVSFFTKKKSK

SEQ ID NO: 9475 - DNA, 24 bp, Primer
ttaatgcgcttttacggctttggc

SEQ ID NO: 9476 - DNA, 22 bp, Primer
atgatggaaggtcaacagcacg

SEQ ID NO: 9477 - DNA, 1224 bp, Escherichia coli; identical to SEQ ID NO: 1403
  CDS (285)..(1166)

SEQ ID NO: 9478 - protein, 293 aa, Escherichia coli; identical to SEQ ID NO: 514

SEQ ID NO: 9479 - DNA, 882 bp, Yersinia pestis; identical to SEQ ID NO: 525
  CDS (1)..(882)

SEQ ID NO: 9480 - protein, 293 aa, Yersinia pestis; identical to SEQ ID NO: 526

SEQ ID NO: 9481 - DNA, 882 bp, Salmonella typhimurium; identical to SEQ ID NO: 1407
  CDS (1)..(882)

SEQ ID NO: 9482 - protein, 293 aa, Salmonella typhimurium; identical to SEQ ID NO: 524

SEQ ID NO: 9483 - DNA, 882 bp, Escherichia coli; identical to SEQ ID NO: 519
  CDS (1)..(882)

SEQ ID NO: 9484 - protein, 293 aa, Escherichia coli; identical to SEQ ID NO: 520

SEQ ID NO: 9485 - DNA, 864 bp, Vibrio cholerae; identical to SEQ ID NO: 531
  CDS (1)..(864)

SEQ ID NO: 9486 - protein, 287 aa, Vibrio cholerae; identical to SEQ ID NO: 532

SEQ ID NO: 9487 - DNA, 879 bp, Buchnera aphidicola str. APS (Acyrthosiphon pisum); identical to SEQ ID NO: 1413
  CDS (1)..(879)

SEQ ID NO: 9488 - protein, 292 aa, Buchnera aphidicola str. APS (Acyrthosiphon pisum); identical to SEQ ID NO: 528

SEQ ID NO: 9489 - DNA, 852 bp, Haemophilus influenzae; identical to SEQ ID NO: 533
  CDS (1)..(852)

SEQ ID NO: 9490 - protein, 283 aa, Haemophilus influenzae; identical to SEQ ID NO: 534

SEQ ID NO: 9491 - DNA, 879 bp, Buchnera aphidicola str. Sg (Schizaphis graminum); identical to SEQ ID NO: 537
  CDS (1)..(879)

SEQ ID NO: 9492 - protein, 292 aa, Buchnera aphidicola str. Sg (Schizaphis graminum); identical to SEQ ID NO: 538

SEQ ID NO: 9493 - DNA, 861 bp, Pasteurella multocida; identical to SEQ ID NO: 535
  CDS (1)..(861)

SEQ ID NO: 9494 - protein, 286 aa, Pasteurella multocida; identical to SEQ ID NO: 536

SEQ ID NO: 9495 - DNA, 882 bp, Escherichia coli; identical to SEQ ID NO: 1421
  CDS (1)..(882): r means g or a

SEQ ID NO: 9496 - protein, 293 aa, Escherichia coli; identical to SEQ ID NO: 1422
  misc_feature (288)..(288): Xaa can be Ala or Thr

SEQ ID NO: 9497 - DNA, 870 bp, Haemophilus ducreyi; identical to SEQ ID NO: 539
  CDS (1)..(870)

SEQ ID NO: 9498 - protein, 289 aa, Haemophilus ducreyi; identical to SEQ ID NO: 540

SEQ ID NO: 9499 - DNA, 777 bp, Vibrio vulnificus; identical to SEQ ID NO: 1425
  CDS (1)..(777)

SEQ ID NO: 9500 - protein, 258 aa, Vibrio vulnificus; identical to SEQ ID NO: 530

SEQ ID NO: 9501 - DNA, 879 bp, Xanthomonas axonopodis (pv. citri); identical to SEQ ID NO: 543
  CDS (1)..(879)

SEQ ID NO: 9502 - protein, 292 aa, Xanthomonas axonopodis (pv. citri); identical to SEQ ID NO: 544

SEQ ID NO: 9503 - DNA, 879 bp, Xanthomonas campestris (pv. campestris); identical to SEQ ID NO: 541
  CDS (1)..(879)

SEQ ID NO: 9504 - protein, 292 aa, Xanthomonas campestris (pv. campestris); identical to SEQ ID NO: 542

SEQ ID NO: 9505 - DNA, 22 bp, Primer
atgatgcgaatcgcgctcttcc

SEQ ID NO: 9506 - DNA, 24 bp, Primer
ttacttcaggtattcacccgtacg

SEQ ID NO: 9507 - DNA, 792 bp, Escherichia coli; identical to SEQ ID NO: 1849
  CDS (1)..(792)

SEQ ID NO: 9508 - protein, 263 aa, Escherichia coli; identical to SEQ ID NO: 1850

SEQ ID NO: 9509 - DNA, 756 bp, Bacillus halodurans; identical to SEQ ID NO: 1851
  CDS (1)..(756)

SEQ ID NO: 9510 - protein, 251 aa, Bacillus halodurans; identical to SEQ ID NO: 1852

SEQ ID NO: 9511 - DNA, 792 bp, Yersinia pestis; identical to SEQ ID NO: 1853
  CDS (1)..(792)

SEQ ID NO: 9512 - protein, 263 aa, Yersinia pestis; identical to SEQ ID NO: 1854

SEQ ID NO: 9513 - DNA, 792 bp, Salmonella enterica subsp. enterica serovar Typhi; identical to SEQ ID NO: 1855
  CDS (1)..(792)

SEQ ID NO: 9514 - protein, 263 aa, Salmonella enterica subsp. enterica serovar Typhi; identical to SEQ ID NO: 1856

SEQ ID NO: 9515 - DNA, 741 bp, Bacillus subtilis; identical to SEQ ID NO: 1857
  CDS (1)..(741)

SEQ ID NO: 9516 - protein, 246 aa, Bacillus subtilis; identical to SEQ ID NO: 1858

SEQ ID NO: 9517 - DNA, 897 bp, Agrobacterium tumefaciens; identical to SEQ ID NO: 1859
  CDS (1)..(897)

SEQ ID NO: 9518 - protein, 298 aa, Agrobacterium tumefaciens; identical to SEQ ID NO: 1860

SEQ ID NO: 9519 - DNA, 741 bp, Thermotoga maritima; identical to SEQ ID NO: 1861
  CDS (1)..(741)

SEQ ID NO: 9520 - protein, 246 aa, Thermotoga maritima; identical to SEQ ID NO: 1862

SEQ ID NO: 9521 - DNA, 822 bp, Sinorhizobium meliloti; identical to SEQ ID NO: 1863
  CDS (1)..(822)

SEQ ID NO: 9522 - protein, 273 aa, Sinorhizobium meliloti; identical to SEQ ID NO: 1864

SEQ ID NO: 9523 - DNA, 783 bp, Escherichia coli; identical to SEQ ID NO: 1865
  CDS (1)..(783)

SEQ ID NO: 9524 - protein, 260 aa, Escherichia coli; identical to SEQ ID NO: 1866

SEQ ID NO: 9525 - DNA, 816 bp, Escherichia coli; identical to SEQ ID NO: 1867
  CDS (1)..(816)

SEQ ID NO: 9526 - protein, 271 aa, Escherichia coli; identical to SEQ ID NO: 1868

SEQ ID NO: 9527 - DNA, 759 bp, Escherichia coli; identical to SEQ ID NO: 1869
  CDS (1)..(759)

SEQ ID NO: 9528 - protein, 252 aa, Escherichia coli; identical to SEQ ID NO: 1870

SEQ ID NO: 9529 - DNA, 804 bp, Deinococcus radiodurans; identical to SEQ ID NO: 1871
  CDS (1)..(804)

SEQ ID NO: 9530 - protein, 267 aa, Deinococcus radiodurans; identical to SEQ ID NO: 1872

SEQ ID NO: 9531 - DNA, 765 bp, Streptomyces coelicolor; identical to SEQ ID NO: 1873
  CDS (1)..(765)

SEQ ID NO: 9532 - protein, 254 aa, Streptomyces coelicolor; identical to SEQ ID NO: 1874

SEQ ID NO: 9533 - DNA, 849 bp, Escherichia coli; identical to SEQ ID NO: 1875
  CDS (1)..(849)

SEQ ID NO: 9534 - protein, 282 aa, Escherichia coli; identical to SEQ ID NO: 1876

SEQ ID NO: 9535 - DNA, 792 bp, Escherichia coli; identical to SEQ ID NO: 1877
  CDS (1)..(789)

SEQ ID NO: 9536 - protein, 262 aa, Escherichia coli; identical to SEQ ID NO: 1878

SEQ ID NO: 9537 - DNA, 771 bp, Rhodococcus opacus (Nocardia opaca); identical to SEQ ID NO: 1879
  CDS (1)..(771)

SEQ ID NO: 9538 - protein, 256 aa, Rhodococcus opacus (Nocardia opaca); identical to SEQ ID NO: 1880

SEQ ID NO: 9539 - DNA, 819 bp, Erwinia chrysanthemi; identical to SEQ ID NO: 1881
  CDS (1)..(819)

SEQ ID NO: 9540 - protein, 272 aa, Erwinia chrysanthemi; identical to SEQ ID NO: 1882

SEQ ID NO: 9541 - DNA, 795 bp, Bordetella pertussis; identical to SEQ ID NO: 1883
  CDS (1)..(795)

SEQ ID NO: 9542 - protein, 264 aa, Bordetella pertussis; identical to SEQ ID NO: 1884

SEQ ID NO: 9543 - DNA, 741 bp, Bordetella pertussis; identical to SEQ ID NO: 1885
  CDS (1)..(741)

SEQ ID NO: 9544 - protein, 246 aa, Bordetella pertussis; identical to SEQ ID NO: 1886

SEQ ID NO: 9545 - DNA, 744 bp, Bordetella bronchiseptica (Alcaligenes bronchisepticus); identical to SEQ ID NO: 1887
  CDS (1)..(744)

SEQ ID NO: 9546 - protein, 247 aa, Bordetella bronchiseptica (Alcaligenes bronchisepticus); identical to SEQ ID NO: 1888

SEQ ID NO: 9547 - DNA, 753 bp, Bacillus cereus (strain ATCC 14579 / DSM 31); identical to SEQ ID NO: 1889
  CDS (1)..(753)

SEQ ID NO: 9548 - protein, 250 aa, Bacillus cereus (strain ATCC 14579 / DSM 31); identical to SEQ ID NO: 1890

SEQ ID NO: 9549 - DNA, 798 bp, Vibrio parahaemolyticus; identical to SEQ ID NO: 1891
  CDS (1)..(798)

SEQ ID NO: 9550 - protein, 265 aa, Vibrio parahaemolyticus; identical to SEQ ID NO: 1892

SEQ ID NO: 9551 - DNA, 876 bp, Pseudomonas putida (strain KT2440); identical to SEQ ID NO: 1893
  CDS (1)..(876)

SEQ ID NO: 9552 - protein, 291 aa, Pseudomonas putida (strain KT2440); identical to SEQ ID NO: 1894

SEQ ID NO: 9553 - DNA, 834 bp, Bradyrhizobium japonicum; identical to SEQ ID NO: 1895
  CDS (1)..(834)

SEQ ID NO: 9554 - protein, 277 aa, Bradyrhizobium japonicum; identical to SEQ ID NO: 1896

SEQ ID NO: 9555 - DNA, 783 bp, Vibrio vulnificus; identical to SEQ ID NO: 1897
  CDS (1)..(783)

SEQ ID NO: 9556 - protein, 260 aa, Vibrio vulnificus; identical to SEQ ID NO: 1898

SEQ ID NO: 9557 - DNA, 774 bp, Oceanobacillus iheyensis; identical to SEQ ID NO: 1899
  CDS (1)..(774)

SEQ ID NO: 9558 - protein, 257 aa, Oceanobacillus iheyensis; identical to SEQ ID NO: 1900

SEQ ID NO: 9559 - DNA, 747 bp, Oceanobacillus iheyensis; identical to SEQ ID NO: 1901
  CDS (1)..(747)

SEQ ID NO: 9560 - protein, 248 aa, Oceanobacillus iheyensis; identical to SEQ ID NO: 1902

SEQ ID NO: 9561 - DNA, 783 bp, Escherichia coli O6; identical to SEQ ID NO: 1903
  CDS (1)..(783)

SEQ ID NO: 9562 - protein, 260 aa, Escherichia coli O6; identical to SEQ ID NO: 1904

SEQ ID NO: 9563 - DNA, 792 bp, Pectobacterium atrosepticum; identical to SEQ ID NO: 1905
  CDS (1)..(792)

SEQ ID NO: 9564 - protein, 263 aa, Pectobacterium atrosepticum; identical to SEQ ID NO: 1906

SEQ ID NO: 9565 - DNA, 756 bp, Salmonella typhimurium; identical to SEQ ID NO: 1907
  CDS (1)..(756)

SEQ ID NO: 9566 - protein, 251 aa, Salmonella typhimurium; identical to SEQ ID NO: 1908

SEQ ID NO: 9567 - DNA, 855 bp, Rhizobium meliloti (Sinorhizobium meliloti); identical to SEQ ID NO: 1909
  CDS (1)..(855)

SEQ ID NO: 9568 - protein, 284 aa, Rhizobium meliloti (Sinorhizobium meliloti); identical to SEQ ID NO: 1910

SEQ ID NO: 9569 - DNA, 810 bp, Rhizobium loti (Mesorhizobium loti); identical to SEQ ID NO: 1911
  CDS (1)..(810)

SEQ ID NO: 9570 - protein, 269 aa, Rhizobium loti (Mesorhizobium loti); identical to SEQ ID NO: 1912

SEQ ID NO: 9571 - DNA, 822 bp, Rhizobium loti (Mesorhizobium loti); identical to SEQ ID NO: 1913
  CDS (1)..(822)

SEQ ID NO: 9572 - protein, 273 aa, Rhizobium loti (Mesorhizobium loti); identical to SEQ ID NO: 1914

SEQ ID NO: 9573 - DNA, 810 bp, Pasteurella multocida; identical to SEQ ID NO: 1915
  CDS (1)..(810)

SEQ ID NO: 9574 - protein, 269 aa, Pasteurella multocida; identical to SEQ ID NO: 1916

SEQ ID NO: 9575 - DNA, 774 bp, Streptomyces coelicolor; identical to SEQ ID NO: 1917
  CDS (1)..(774)

SEQ ID NO: 9576 - protein, 257 aa, Streptomyces coelicolor; identical to SEQ ID NO: 1918

SEQ ID NO: 9577 - DNA, 876 bp, Pseudomonas putida; identical to SEQ ID NO: 1919
  CDS (1)..(876)

SEQ ID NO: 9578 - protein, 291 aa, Pseudomonas putida; identical to SEQ ID NO: 1920

SEQ ID NO: 9579 - DNA, 789 bp, Erwinia carotovora; identical to SEQ ID NO: 1921
  CDS (1)..(789)

SEQ ID NO: 9580 - protein, 262 aa, Erwinia carotovora; identical to SEQ ID NO: 1922

SEQ ID NO: 9581 - DNA, 825 bp, Escherichia coli; identical to SEQ ID NO: 1923
  CDS (1)..(825)

SEQ ID NO: 9582 - protein, 274 aa, Escherichia coli; identical to SEQ ID NO: 1924

SEQ ID NO: 9583 - DNA, 918 bp, Erwinia chrysanthemi; identical to SEQ ID NO: 1925
  CDS (1)..(918)

SEQ ID NO: 9584 - protein, 305 aa, Erwinia chrysanthemi; identical to SEQ ID NO: 1926

SEQ ID NO: 9585 - DNA, 876 bp, Pseudomonas putida; identical to SEQ ID NO: 1927
  CDS (1)..(876)

SEQ ID NO: 9586 - protein, 291 aa, Pseudomonas putida; identical to SEQ ID NO: 1928

SEQ ID NO: 9587 - DNA, 807 bp, Mycobacterium vanbaalenii; identical to SEQ ID NO: 1929
  CDS (1)..(807)

SEQ ID NO: 9588 - protein, 268 aa, Mycobacterium vanbaalenii; identical to SEQ ID NO: 1930

SEQ ID NO: 9589 - DNA, 798 bp, uncultured bacterium 582; identical to SEQ ID NO: 1931
  CDS (1)..(798)

SEQ ID NO: 9590 - protein, 265 aa, uncultured bacterium 582; identical to SEQ ID NO: 1932

SEQ ID NO: 9591 - DNA, 816 bp, Mycobacterium paratuberculosis; identical to SEQ ID NO: 1933
  CDS (1)..(816)

SEQ ID NO: 9592 - protein, 271 aa, Mycobacterium paratuberculosis; identical to SEQ ID NO: 1934

SEQ ID NO: 9593 - DNA, 753 bp, Bacillus cereus (strain ATCC 10987); identical to SEQ ID NO: 1935
  CDS (1)..(753)

SEQ ID NO: 9594 - protein, 250 aa, Bacillus cereus (strain ATCC 10987); identical to SEQ ID NO: 1936

SEQ ID NO: 9595 - DNA, 825 bp, Thermus thermophilus (strain HB27 / ATCC BAA-163 / DSM 7039); identical to SEQ ID NO: 1937
  CDS (1)..(825)

SEQ ID NO: 9596 - protein, 274 aa, Thermus thermophilus (strain HB27 / ATCC BAA-163 / DSM 7039); identical to SEQ ID NO: 1938

SEQ ID NO: 9597 - DNA, 756 bp, Rhodopseudomonas palustris; identical to SEQ ID NO: 1939
  CDS (1)..(756)

SEQ ID NO: 9598 - protein, 251 aa, Rhodopseudomonas palustris; identical to SEQ ID NO: 1940

SEQ ID NO: 9599 - DNA, 24 bp, Primer
atggctaacgcagatctggataaa

SEQ ID NO: 9600 - DNA, 25 bp, Primer
ttagaacggatagtcgtgataaccc

SEQ ID NO: 9601 - DNA, 1776 bp, Saccharomyces cerevisiae
  CDS (1)..(1776)
atgtctcacaaacaattcaaatcagatggaaacatcgttactccctacctacttggccttgctcgaagcaatcccggccttacagtgattaagcacgacagagtggttttccggactgcgtcagctcctaattcagggaaccctcctaaagtttcattggtttctggaggtggcagtggtcatgagccaacgcatgccggttttgttggtgaaggtgccttagatgcgattgcagcaggtgccatttttgcttctccttcaactaaacagatctattctgctattaaagctgttgaatctcctaagggtaccttgatcattgtaaaaaattacaccggtgatattatacattttggtctcgctgctgaaagagctaaagctgctggaatgaaagtcgaactggttgctgtaggagatgatgtctctgtcggtaagaagaaaggttctttagtcgggcgtcgaggtctcggagccaccgtattggtgcataaaattgctggggcagccgcttctcatggactggagttggcagaagttgccgaagttgctcagtcagtagttgacaatagtgtcacaattgcggcatctcttgatcactgcacggttcctggccacaaacctgaagccattttgggcgagaatgagtatgaaatcggtatgggtattcataacgagtctggtacctataagtcttctccgctgccatcgatttctgagctcgtttcccagatgcttcctcttcttctcgatgaggatgaagaccgttcttatgtgaagtttgagcccaaagaggacgtagttcttatggttaacaacatgggtggtatgtctaatctagaattgggttatgctgcagaggtcatttctgaacaattgattgataagtatcaaattgtgcccaagagaacgattactggagcattcattactgcattgaatggtcctgggtttggtatcactcttatgaacgcttcaaaagctggtggcgatatccttaagtatttcgattatcctaccacagcgagtggatggaatcaaatgtaccattctgccaaagattgggaggtacttgccaaagggcaggttcccaccgccccctctttaaagacattgaggaatgaaaaaggttcgggtgtgaaagctgattatgacacttttgctaaaattttgcttgctgggattgcaaaaattaacgaggttgaaccaaaggttacttggtacgataccattgcaggagatggtgattgcggaactactcttgtgtccggtggtgaagcattggaagaagctattaaaaaccatacgttgcgcctcgaggatgctgctcttggtatcgaagatattgcgtatatggttgaggattctatgggtggtacgtccggtggtctgtactctatctatctttctgctctcgcacaaggagttagggattctggggacaaggaacttactgcggaaactttcaaaaaggcatcaaacgttgcactagatgctttgtataagtatacgagagcccgtcctggttacaggactctgatcgatgctctgcaaccttttgtcgaagcgctgaaagccgggaagggtcccagagccgccgcccaagctgcttatgatggtgccgaaaagacaaggaagatggatgcccttgttgggcgtgcttcttacgtggctaaggaggagctgagaaaactcgacagcgaaggtggattaccagatccaggagcagttggtcttgctgcactactcgatggatttgttacagctgctgggtactag

SEQ ID NO: 9602 - protein, 591 aa, Saccharomyces cerevisiae
MSHKQFKSDGNIVTPYLLGLARSNPGLTVIKHDRVVFRTASAPNSGNPPKVSLVSGGGSGHEPTHAGFVGEGALDAIAAGAIFASPSTKQIYSAIKAVESPKGTLIIVKNYTGDIIHFGLAAERAKAAGMKVELVAVGDDVSVGKKKGSLVGRRGLGATVLVHKIAGAAASHGLELAEVAEVAQSVVDNSVTIAASLDHCTVPGHKPEAILGENEYEIGMGIHNESGTYKSSPLPSISELVSQMLPLLLDEDEDRSYVKFEPKEDVVLMVNNMGGMSNLELGYAAEVISEQLIDKYQIVPKRTITGAFITALNGPGFGITLMNASKAGGDILKYFDYPTTASGWNQMYHSAKDWEVLAKGQVPTAPSLKTLRNEKGSGVKADYDTFAKILLAGIAKINEVEPKVTWYDTIAGDGDCGTTLVSGGEALEEAIKNHTLRLEDAALGIEDIAYMVEDSMGGTSGGLYSIYLSALAQGVRDSGDKELTAETFKKASNVALDALYKYTRARPGYRTLIDALQPFVEALKAGKGPRAAAQAAYDGAEKTRKMDALVGRASYVAKEELRKLDSEGGLPDPGAVGLAALLDGFVTAAGY

SEQ ID NO: 9603 - DNA, 996 bp, Bacillus halodurans
  CDS (1)..(996)
atgaaaaaaatcatgaacggaccagaaaagatcgttgatcaaatgcttcagggctttgcttttgcccgagcggacaaagtcgggtacgatccgttgcatcgcgtcctctatcaaaaaaccttcgatcctaaaagtgtgccaattattagtggaggcggtagtggacacgaacctggacatttagggtatgtaggggaagggatgcttgcggccgctgttcacggcgatgtgttcgttccgccgtcagctcaacaagttcttgctgcaattcgtcaaatggatcaagggaaaggcgtactgttgataatcaaaaattttgttgcagatttagcgacgtttttgtcagcagaagttcaagcccgagccgagggaagagatgttgcgcatgtgatcgtaaacgacgatgtatccgttgaaagcgatgcatcctttgagaagcggaggcgtggagtggcaggagccgttctcgtccataaaattatcggagctgcagccaaggaaggctattcactagaagcgttacaagagattggtgaacaggttgtaaagaatttggccactttaggtgtggctctcacccatgcagatttaccggagagacgtgagccccaatttctgttggaggagggggaagtgtacttcggggttggaattcacggtgagcaagggtaccggaaagaaaagcttgtgtcgtctgaactgctggccgtcgaactagtgaataagttaaagagcctttatcgctgggataaaaatgatcaatatgcagttctcattaatggccttggaggcaccccgttaattgaacaatatgtgtttgctaatgacgttcgccggttattagcgattgaaaatttacacgtttcctttgtgaaggtaggaactcaactgacttccctaaatatgaaaggcatttcattgactatgctgaaaatctgtgacgagcagtgggtgaaatggctgtacgcgccagttgatgttgcccactgggcctaa

SEQ ID NO: 9604 - protein, 331 aa, Bacillus halodurans
MKKIMNGPEKIVDQMLQGFAFARADKVGYDPLHRVLYQKTFDPKSVPIISGGGSGHEPGHLGYVGEGMLAAAVHGDVFVPPSAQQVLAAIRQMDQGKGVLLIIKNFVADLATFLSAEVQARAEGRDVAHVIVNDDVSVESDASFEKRRRGVAGAVLVHKIIGAAAKEGYSLEALQEIGEQVVKNLATLGVALTHADLPERREPQFLLEEGEVYFGVGIHGEQGYRKEKLVSSELLAVELVNKLKSLYRWDKNDQYAVLINGLGGTPLIEQYVFANDVRRLLAIENLHVSFVKVGTQLTSLNMKGISLTMLKICDEQWVKWLYAPVDVAHWA

SEQ ID NO: 9605 - DNA, 996 bp, Listeria monocytogenes
  CDS (1)..(996)
atgagacgtttagtgaatgatgggtatgaagcagtagaagaaatgttagctggttatgttgcggcacaagggaaatacgtagattttgcagaaaatgataagcgagtaatcgtaagcaaacaaatgagcgaagaacctcgtgtccggattattgttggtggcggttctggtcatgagccacttttccttggttatgtagggaaggatttcgcggatgcggcggtagtcggtaacattaatacatccccttctccagaaccttgttataacgcggtaaaagctgttgatagtggcaaaggttgtctatatatgtacgggaactatgctggcgatgtaatgaactttgatatgggcgctgaaatggctgcggacgacggcattcgcgttgaaacagtgcttgtaacagatgatatttattcagcagaaaaggtagaagatcgtcgtggtgtggctggtgacttaatcgtatttaaagcagcggcgtctgcagcagcaaaaggacttgacctagatgcggtaaaacaagctgctgaaaaagcaaatgctaatacgttctcgatgggtgtggcgctttcttcttctacccttcctgtaaccggtaaagctattttcgaaatgaaagaaggcgaaatggaagttggcatggggattcacggtgagcctggtatcaaacgtacttccatcgaaccagctgataaagtagtcgaccaaatcatgggctatcttatagaagaaatgaaattaactagtgacgaagaagtacatgtacttattaatggacttggtggtttaccagtgatggatcaatacatttgttatcgccgtgtggatgaaattttgaaagaaaaaggcgtgcatattcataacccacttgttgggaactacgcgacttcgatggatatgattggtatgtcgattacactggttcgtttagacgatgaactgaaagaccttttagatacaccttgtgacacaccatatttcaaagtggactaa

SEQ ID NO: 9606 - protein, 331 aa, Listeria monocytogenes
MRRLVNDGYEAVEEMLAGYVAAQGKYVDFAENDKRVIVSKQMSEEPRVRIIVGGGSGHEPLFLGYVGKDFADAAVVGNINTSPSPEPCYNAVKAVDSGKGCLYMYGNYAGDVMNFDMGAEMAADDGIRVETVLVTDDIYSAEKVEDRRGVAGDLIVFKAAASAAAKGLDLDAVKQAAEKANANTFSMGVALSSSTLPVTGKAIFEMKEGEMEVGMGIHGEPGIKRTSIEPADKVVDQIMGYLIEEMKLTSDEEVHVLINGLGGLPVMDQYICYRRVDEILKEKGVHIHNPLVGNYATSMDMIGMSITLVRLDDELKDLLDTPCDTPYFKVD

SEQ ID NO: 9607 - DNA, 990 bp, Listeria monocytogenes
  CDS (1)..(990)
atgaagaagattcttaacggtactgatcaagtagtagaacagatggtggaaggtttagttaaatcgcatgctgatgttgttcaccgtgtcgaaggaactcgcgtcattgcaagaaatgataaacgtccaggaaaagtcggacttgtaagcggtggaggttctggtcacgagccggctcatgctggttatgtgggtcgcggaatgttgtctgcggctgtgtgcggtgatgttttcacttccccaactcccgaccaaatttatgaaggtattaaagccgcagatcaaggcgctggtgtgcttttgatcgtgaaaaactataccggtgatgtgatgaattttgaaatggcggcagatttagcagatgccgatgatattaaagtagaacaaattgtagtagatgatgatattgctgttgaggatagtacttttacaacgggacgccgcggtgtagccgggacagttctcgtgcataaaattatcggggcagccgcagaagcaggcgcatctcttgatgaactgaaagcccttggtgaaaaagttattgcttctgttaaaacgcttggtgttgctctttctccttgtacagttcccgaagttggccatcccggctttgagcttggtgacgacgaaatcgaactaggtattggtatccacggtgaacctggctttacacgtgaaaaaatcatgccatctgcaagtttagcgaagcaactgtacgaacggattagcaatgaaagcaaactcctagctggcgataaagtggttgttctcgtgaacggcatgggcgcaacaccacttatggaacaatatgttttcgcaaatgatgtccatgaacttctaaaaaatgccggcgttcaagttgaaaaaacactcgttggagattatatgacttctcttgaaatggctggtttatccttaaccattttgaaattagaggatgaaaaatgggtagatatgttgaaactcccagtggacacaattgcatggtaa

SEQ ID NO: 9608 - protein, 329 aa, Listeria monocytogenes
MKKILNGTDQVVEQMVEGLVKSHADVVHRVEGTRVIARNDKRPGKVGLVSGGGSGHEPAHAGYVGRGMLSAAVCGDVFTSPTPDQIYEGIKAADQGAGVLLIVKNYTGDVMNFEMAADLADADDIKVEQIVVDDDIAVEDSTFTTGRRGVAGTVLVHKIIGAAAEAGASLDELKALGEKVIASVKTLGVALSPCTVPEVGHPGFELGDDEIELGIGIHGEPGFTREKIMPSASLAKQLYERISNESKLLAGDKVVVLVNGMGATPLMEQYVFANDVHELLKNAGVQVEKTLVGDYMTSLEMAGLSLTILKLEDEKWVDMLKLPVDTIAW

SEQ ID NO: 9609 - DNA, 1029 bp, Brucella melitensis
  CDS (1)..(1029)
atgagcccgcagctcattcatattacaggagataccatgcagcgtttcatcaacaacccggacgaagtcgttgaggataccgtcaggggctttgtcaaagcgcactccgatatcattcgccttgcggaaaatccgcgcgtcattgccgcgaaagatgcacctgtcgctggcaaggttggtgttgttacaggcggcggatccggccatgaaccagccttcatcggctataccggcaagaatatgctcgatgcggtggcagttggtgaactgttttcctccccgaccgctaaaagcttccatgatgccatacgcgaagcaaatggcggcaaaggcgtggtggtcctctatggcaattatgccggcgacaatatgaatgtgaagatggcgaccaagctggctgccaaggatggcatcgatgttgcaacagtcgttgcaaatgacgatgtctgttcggcccccgccgccgaacgcgagaagcgccgcggcgttgccggtgagatattcatgtggaaggttggcggcgcaaaagcggcgaccggagctacgcttgaggaggttcgcgcaacggcgcagaaggccatcgataattgccgttcgatcggcgtcgggcttggaccgtgcacgttgcccgccgttggccatcccaattttgaaattgcgccgggcacgatggaagtcggcatcggccatcatggcgagccgggcgtgcgggtggagccgctgaagtctgcggctgaggtcgcaagagacatgtgccagatcgtgcttgacgatcatggactggcggaaggaaccgaagttgccgttcttgtctcgggtcttggcgcaacgccactcaacgaactctatattcttaacgacacgatcgaaaccgaaattcgggcacgcgggctgaagatccatcgtacctatatcggcaactatttcacgtcgcttgaaatggttggggcgacgctgacggtcatggcgctggacagtgagttgaaggaactgctcgatgtcgaagtgcgctgcactaccattttgtga

SEQ ID NO: 9610 - protein, 342 aa, Brucella melitensis
MSPQLIHITGDTMQRFINNPDEVVEDTVRGFVKAHSDIIRLAENPRVIAAKDAPVAGKVGVVTGGGSGHEPAFIGYTGKNMLDAVAVGELFSSPTAKSFHDAIREANGGKGVVVLYGNYAGDNMNVKMATKLAAKDGIDVATVVANDDVCSAPAAEREKRRGVAGEIFMWKVGGAKAATGATLEEVRATAQKAIDNCRSIGVGLGPCTLPAVGHPNFEIAPGTMEVGIGHHGEPGVRVEPLKSAAEVARDMCQIVLDDHGLAEGTEVAVLVSGLGATPLNELYILNDTIETEIRARGLKIHRTYIGNYFTSLEMVGATLTVMALDSELKELLDVEVRCTTIL

SEQ ID NO: 9611 - DNA, 2085 bp, Brucella melitensis
  CDS (1)..(2085)
atggcgccacagggaaaaacaaccgcaggtaaaatcggacaggcggaaccagccgatggcattccactgcgctatggcgacgatccatatgtctgggcttgctggctttattacgaagacgggcgcacgcagggcgaaatcgccaacatcatggggatttcgcgggctaccgtaaacagctatctcgcagatgcccgtaatcgaggcatcgtcaatatctcgattgaacctgcacgcctcggttcccttgcaattgcacaggaactcaagcaccatttcggattgagcgattgtctggtggtgcccaatgatgacggcgcgcatccccttatcgaccggcttgggacggctggtgcacaggcggtcaccaggcttctgaaatcgggagacgtacttgccgtcgcctgggggcggacagtccttgccattgccgagaatacctgcatatccaatttgcaggatgtaaccgtagtacaagcaaccggcgggacgcgcgccagttttgcttacacacctgaattgtgcgcggcggccatggcgcgcgcaacaaacgcacacctcgtcaacatcacggcccccgccattgtatccagtgcagacgtaaagacggcgattaccggggaaccgattattgttgagcaatttcaggtgttgaaccatgcaaacaaggcattgtttggcatttcatcgctgcggccgaattcaacaatccataccagcggtttctttgaaaatgtcgcgatacaggattacctggccaagaatgccgttggcgttgtagccgggcgtttcatcgatgcttatgggcaaccggtggccggcccgcttgatgacaggaccattggtatcacgctcgacaggctgcgaatgatcgacatgcgtattgccgttgcgggcggcttcgataaggtgccggcaattcttgcagccctgcggggtggttatatcaatgtcctgattaccgatgccgcgacaggccgtggtatcctcaatgcggatggcgtaaccgggatcgacagcaagctttcccagaagctgcgtgcagaaccggccgccaaagcatccagtcattatcgtacgcatatcaagaaatttctgaacagccccgatgatgtcgttgaggaaatgctcgacggcgccaccaaagcacatcgatcctatctcgtccccatcaatggatcgaaacgcgcgctcgttgcacgcaatggcccccgtgcggggaaagtgggactggtgatcgggggcggttcggggcatgaaccctgctttctgggctatgttggcaagggtcttgccgatgctgtagccattggcaatgtcttttcctcaccaccgccggcaccgatccttgaatgcgccagggcggcctcgggcggagaaggtgttctctttgtctatggcaactatgtcggagacgtcatgaatttcgagatggcggcggaaatggcgcaggaagctgctattccgacacgtaccgttctgacgacagacgacatatcgtcttcccccatagaggatcgcgatggccgtcgcggcgttgcggggaactttttcattttcaaggtagctggcgcagcttgcgatcgtggcatgtcgcttaaggcatgtgaagcggtgacacgcaaggctaaccggcgcacctatacgatgggcgtcgcactggaaccctgttcgctgccccagacgcggcgccacaattttgaaatcggcgccgaagaaatggaaatcggcatgggcatccatggcgaacgcggtgtcatccgggaaaaattgttgcccgccgacgcgattgtcgatcacatcatggaccggattttcagcgagatgaatgcctcgcccggagaccgggtagcggtgctcgtcaattcgttcggttcaacgcccctgatggaactctacgtcctgttcagacgtgtcgagcaacgcttgagcgccaagcacataacaatcgaggccaactgggtgggccattactgtacgtcgctggacatgaacggagcatccatatccgtcatgcatctcgatcaggaattatccgatctcttatcgcacccttgcgatacggcttttcttcgggtcaactga

SEQ ID NO: 9612 - protein, 694 aa, Brucella melitensis
MAPQGKTTAGKIGQAEPADGIPLRYGDDPYVWACWLYYEDGRTQGEIANIMGISRATVNSYLADARNRGIVNISIEPARLGSLAIAQELKHHFGLSDCLVVPNDDGAHPLIDRLGTAGAQAVTRLLKSGDVLAVAWGRTVLAIAENTCISNLQDVTVVQATGGTRASFAYTPELCAAAMARATNAHLVNITAPAIVSSADVKTAITGEPIIVEQFQVLNHANKALFGISSLRPNSTIHTSGFFENVAIQDYLAKNAVGVVAGRFIDAYGQPVAGPLDDRTIGITLDRLRMIDMRIAVAGGFDKVPAILAALRGGYINVLITDAATGRGILNADGVTGIDSKLSQKLRAEPAAKASSHYRTHIKKFLNSPDDVVEEMLDGATKAHRSYLVPINGSKRALVARNGPRAGKVGLVIGGGSGHEPCFLGYVGKGLADAVAIGNVFSSPPPAPILECARAASGGEGVLFVYGNYVGDVMNFEMAAEMAQEAAIPTRTVLTTDDISSSPIEDRDGRRGVAGNFFIFKVAGAACDRGMSLKACEAVTRKANRRTYTMGVALEPCSLPQTRRHNFEIGAEEMEIGMGIHGERGVIREKLLPADAIVDHIMDRIFSEMNASPGDRVAVLVNSFGSTPLMELYVLFRRVEQRLSAKHITIEANWVGHYCTSLDMNGASISVMHLDQELSDLLSHPCDTAFLRVN

SEQ ID NO: 9613 - DNA, 966 bp, Staphylococcus aureus
  CDS (1)..(966)
atgaaaaagttaatcaataaaaaagaaacatttttaactgatatgcttgaaggattgttaattgcgcacccagagttagatctgattgctaatacagttattgtaaaaaaagctaagaaagaacatggtgtagcaatagtctctggaggtggaagcggacatgaacctgcgcatgccggttttgttgcagaaggtatgctagatgcagcggtttgtggcgaagtatttacatcacctacacctgataaaatattagaagctattaaagcagtagatactggtgatggtgtattactagttgtaaaaaactatgcaggtgacgtgatgaatttcgaaatggcacaagagcttgcagaaatggaaggtataaatgttcaaactgttattgttcgtgacgacattgctgtgacaaacgaagtacaacgtcgtggtgttgcaggaacagtgtttgttcataagcttgccggttatcttgctgaaaaaggttattcattaacagagataaaatcgcgtgtagaagcgttgttacctgaaattaaaagtattggtatggcaattgagccaccgcttgttccaactactggaaaatatggctttgatattgaagacgacaaaatggaaatcggtattggtatacatggtgaaaaaggtattcatagggaagaagtaaaggatattgatcatattgttggaacattgttagacgaattgtataaagaagttactgccaatgatgtcatattaatggtaaatggtatgggtggtacgccgttatctgaattaaatatcgtaactaaatatattcaacaaaatttagctgcaagaacggttaatgttgctaaatggtttgttggtgattatatgacatctttagacatgcaaggtttttctataactatcgtgcctaataaaccagaatatttggaagcatttttagcaccaacaacaagtcaatactttaaataa

SEQ ID NO: 9614 - protein, 321 aa, Staphylococcus aureus
MKKLINKKETFLTDMLEGLLIAHPELDLIANTVIVKKAKKEHGVAIVSGGGSGHEPAHAGFVAEGMLDAAVCGEVFTSPTPDKILEAIKAVDTGDGVLLVVKNYAGDVMNFEMAQELAEMEGINVQTVIVRDDIAVTNEVQRRGVAGTVFVHKLAGYLAEKGYSLTEIKSRVEALLPEIKSIGMAIEPPLVPTTGKYGFDIEDDKMEIGIGIHGEKGIHREEVKDIDHIVGTLLDELYKEVTANDVILMVNGMGGTPLSELNIVTKYIQQNLAARTVNVAKWFVGDYMTSLDMQGFSITIVPNKPEYLEAFLAPTTSQYFK

SEQ ID NO: 9615 - DNA, 1719 bp, Sinorhizobium meliloti
  CDS (1)..(1719)
atgaccacgatctttgacgctccggaagatttcgccacgaccgcactcgccggtttcgcagcgatctatcagcgcaacgtccgcctggtgaagggcggcgtcgtgcgctcgaccaaggtgccgaagggcaaggtcgccgtcgtggtcggcggcggctcgggacattacccggcctttgccggttatgtcgggccggggctcgccgacgcggcggtcgccggcgatgtctttgcctcgccctcgactgccgcggtagcccgcgtctgccgccatgccgaccagggcggcggagtgcttctcggcttcggcaattacgccggcgacgtcctgaatttcggggttgctgccgaacggcttcgctccgaaggcatcgacgtgcgcatcctgccggtgaccgacgacgtggcgagtgcgcccgcggaaacgtctgccaagcgccgcgggattgccggcgacctcgtcgtcttcaagattgccggcgcggcagccgaagccggcaagtcgctcgacgaggtcgaacggctcgcgcgtcatgccaatgatcggacggtatccttcggcgtcgccttcggcggctgcacgcttccgggtgctgccggcccgctcttcaccgtgccgaagggccagatggcgctcgggctcggcattcacggcgaaccgggcgtcagcgaggagacgatcgcgacggcgagcgatctcgcaaagctccttaccggcaagcttcttgccgagcgccccgagggctccaggaaggtggccgccgtgctgaacggcctcggctcgaccaaatatgaagaactcttcgtgctctggacggcggtcgccagacagctcaatgacgcgggtcttgaaatcgtcgaccccgaatgcggcgaattcgtcaccagcctcgacatgcagggctgctcgctcacccttctctggctggacgaagagctggaggcgctctggcgcgcgcccacggatgcgccggtgctgcgcaagggcgtgatcattgccgccgaaccggcgaccgacgagatcgtagacgccgacggaccgcagtctttcggccctgcatcggacgcctcgaaggaaagcggcaaatgcatcgcccggctgatcggcaatattgccgaggcgctcaaggaggcggaagaggagctcggccgcatcgacgcctttgccggcgacggcgatcacggccagggcatgcgccgcggttctgccgccgcattcgacgcagcacagaccgcggtcgtggcgggggcaggggctgcaagcgtacttgctgccgcgggcgacgcctgggcggaccgcgccggcggcacctcgggcgccatctggggcctggctctgcgctcctggagcaatgccctcagcgatgaggaaaaggtgagcgacgcggcgatcgtgaagggctcccgcctcgcactcgacggcgtcacgcgcctcggccgcgcgcgcgtgggcgacaagacgctggtcgacgcgctggtgcctttcgtggagacgctggaaagggaatccgccgccggcaggccgcttgtcgaagcctgggatgcggcggccaaggccgcacaagaggccgccgatgcgacctccgcgctgaccccgaaactcggccgggcgcggccgctggccgaaaagagcatcggccacccggatgcgggtgcggtctcgctggcgctggtggcacgggtcgcgggtgcgtttttgagggaagctgcggcgggttga

SEQ ID NO: 9616 - protein, 572 aa, Sinorhizobium meliloti
MTTIFDAPEDFATTALAGFAAIYQRNVRLVKGGVVRSTKVPKGKVAVVVGGGSGHYPAFAGYVGPGLADAAVAGDVFASPSTAAVARVCRHADQGGGVLLGFGNYAGDVLNFGVAAERLRSEGIDVRILPVTDDVASAPAETSAKRRGIAGDLVVFKIAGAAAEAGKSLDEVERLARHANDRTVSFGVAFGGCTLPGAAGPLFTVPKGQMALGLGIHGEPGVSEETIATASDLAKLLTGKLLAERPEGSRKVAAVLNGLGSTKYEELFVLWTAVARQLNDAGLEIVDPECGEFVTSLDMQGCSLTLLWLDEELEALWRAPTDAPVLRKGVIIAAEPATDEIVDADGPQSFGPASDASKESGKCIARLIGNIAEALKEAEEELGRIDAFAGDGDHGQGMRRGSAAAFDAAQTAVVAGAGAASVLAAAGDAWADRAGGTSGAIWGLALRSWSNALSDEEKVSDAAIVKGSRLALDGVTRLGRARVGDKTLVDALVPFVETLERESAAGRPLVEAWDAAAKAAQEAADATSALTPKLGRARPLAEKSIGHPDAGAVSLALVARVAGAFLREAAAG

SEQ ID NO: 9617 - DNA, 993 bp, Sinorhizobium meliloti
  CDS (1)..(993)
atgcagcgtttcatcaacaatcctgacgaagtcgtcgaggataccgtcaagggtttcgtcaaggcgcatgccgacatcgtccgcctcggcgaaaatccgcgcgtcatcgtcgccaagggcgcgccggttgccggcaaggtgggtgtcgtgaccggcggcggctccggccatgagcctgccttcatcggctacaccggccgcaacatgctggacgccgtcgccgtcggcgagctcttttcctccccaacggccaagagctttcacgacgcgattcgcgaggcagacggcggcaagggcgtcgtctgcctctacggcaactatgccggcgacaacatgaacgtgaagatggcggtgaagctcgcggccaaggcagggatcgaagttgcgacggtcgtggccaatgacgacgtctgctccgcgccgcccgaagagcgcgagaagcggcgcggcgtcgccggagaaatcttcatgtggaagatcggcggggccaaggcggccgccggcgcgagtctcgaagaggtccgtgcggctgcccagaaggcgatcgacaattgccgctcgatcggggtcgggctcggcccctgcaccctccccgcggtcgggcatccaaacttccggatcgagccgggcacgatggaagtcggtatcggccatcacggtgagcccggcctgcgcgtcgaagcgctgaagaccgccgaagaggtcgctgtcgacatgtgcaagatcgtgctggacgatcacgacctgccgcagggcacggaagtggctgtgctcgtctccggcctcggcgcaacgccgctcaatgaactctacatcctgaacgacacgatcgagcgcgagatcaccgcccggggcctcaagatctaccgcaccttcgtcggcaactacttcacttcgctcgaaatggtcggagcgacgctgacggtcatggcgctcgacgacgaactcaaggcgctcctcgatgtcgaggtccgctgcaccgccgttctctga

SEQ ID NO: 9618 - protein, 330 aa, Sinorhizobium meliloti
MQRFINNPDEVVEDTVKGFVKAHADIVRLGENPRVIVAKGAPVAGKVGVVTGGGSGHEPAFIGYTGRNMLDAVAVGELFSSPTAKSFHDAIREADGGKGVVCLYGNYAGDNMNVKMAVKLAAKAGIEVATVVANDDVCSAPPEEREKRRGVAGEIFMWKIGGAKAAAGASLEEVRAAAQKAIDNCRSIGVGLGPCTLPAVGHPNFRIEPGTMEVGIGHHGEPGLRVEALKTAEEVAVDMCKIVLDDHDLPQGTEVAVLVSGLGATPLNELYILNDTIEREITARGLKIYRTFVGNYFTSLEMVGATLTVMALDDELKALLDVEVRCTAVL

SEQ ID NO: 9619 - DNA, 1101 bp, Escherichia coli
  CDS (1)..(1101)
atgccctaccgtaattgctggagcaaaataatgaaaaaattgatcaatgatgtgcaagacgtactggacgaacaactggcaggactggcgaaagcgcatccatcgctgacactgcatcaggatccggtgtatgtcacccgagctgatgcccctgttgcaggaaaagtcgccctgctgtcgggtggcggcagcggacacgagccgatgcactgtggttatatcggtcaggggatgctttcgggggcctgtccgggcgaaattttcacctcaccgacgcccgataaaatctttgaatgcgccatgcaagttgatggcggcgaaggtgtactgttgattatcaaaaattacaccggcgatattcttaactttgaaacagcgaccgagttactgcacgatagcggcgtaaaagtgaccactgtggtcattgatgacgacgttgcggtaaaagacagtctttatactgccgggcgacgcggcgttgccaacaccgtattaattgaaaaactcgtaggcgcagcggcggagcgtggcgactcactggacgcctgtgcggaactggggcgtaagctgaataatcaaggccactcaataggtatcgctctcggtgcctgtaccgttcctgccgcgggcaaaccttcttttaccctggcggataatgagatggagtttggcgtcggcattcatggtgagccgggtattgaccgccgccccttctcttcccttgatcaaaccgtcgatgaaatgttcgacaccctgctggtaaatggctcataccatcgcactttgcgtttctgggattatcaacaaggcagttggcaggaagaacaacaaaccaaacaaccgctccagtctggcgatcgggtgattgcgctggttaacaatcttggcgcaactccgctttctgagctgtacggcgtctataaccgcctgaccacacgttgccagcaagcgggattgactatcgaacgtaatttaattggcgcgtactgcacctcactggatatgaccggtttctcaatcaccttactgaaagttgatgacgaaacgctggcactctgggacgccccggtccacaccccggcccttaactggggtaaataa

SEQ ID NO: 9620 - protein, 366 aa, Escherichia coli
MPYRNCWSKIMKKLINDVQDVLDEQLAGLAKAHPSLTLHQDPVYVTRADAPVAGKVALLSGGGSGHEPMHCGYIGQGMLSGACPGEIFTSPTPDKIFECAMQVDGGEGVLLIIKNYTGDILNFETATELLHDSGVKVTTVVIDDDVAVKDSLYTAGRRGVANTVLIEKLVGAAAERGDSLDACAELGRKLNNQGHSIGIALGACTVPAAGKPSFTLADNEMEFGVGIHGEPGIDRRPFSSLDQTVDEMFDTLLVNGSYHRTLRFWDYQQGSWQEEQQTKQPLQSGDRVIALVNNLGATPLSELYGVYNRLTTRCQQAGLTIERNLIGAYCTSLDMTGFSITLLKVDDETLALWDAPVHTPALNWGK

SEQ ID NO: 9621 - DNA, 993 bp, Bacillus halodurans
  CDS (1)..(993)
atgaagaaaattctcaacgatccgcaaaacgttttggatgaaatgctcgatggatttgtatatgccaatggacatcttgttgaacgagtggcggggacaggtgtgattcgccggacatatgaagacaaaggcaaagtggcgttagttagtggaggcggtagcggacatgaaccgagtcatgctggtttcgtcggacaaggaatgctgtcagccgccgtttgcggagaagtgtttacgtcgccaacgccggatcaaatttttgaaggaattaaagcggcagatcaaggaggcggcgttcttctgatcatcaaaaactacacaggtgatgtgatgaattttgaaatggcaggagaaatggctgaagccgaaggaataactgttgatcacatcattgtgaatgatgatattgcggtggaagatagctcatttacagctggaagacgtggggtcgcaggaacgattattgtccacaaaattgtcggagctgccgctgaagcaggtctatcgctacaaagtttaaaagtgctaggtgaaacagtcattgagaacacgaagacgatcggtgtgtcgatcttgcctgcaaccgtaccagctgtcgggaagccaggatttgaactgggagacgacgaaatggaatatggtgttgggattcacggggagccaggttatcgtaaagaaaagctgaaatcgtccaaggaaatagccgaagagttgatcctcaaattaaaagaagcgtttggctggagcaaaggagataaatacggtgtgttagtcaatgggcttggagctacacctcttatggagcagtatgtgtttatgaatgatgtagcgaacaagctaacagaggaagggcttaacatccaatttaaaaaagtgggctcttttatgacgtctatcgacatggccggtgtttctcttactcttataaaaatcgtggaagaaaaatggcttgactattggaatcatgaagtgaaaacggtggactggatgtaa

SEQ ID NO: 9622 - protein, 330 aa, Bacillus halodurans
MKKILNDPQNVLDEMLDGFVYANGHLVERVAGTGVIRRTYEDKGKVALVSGGGSGHEPSHAGFVGQGMLSAAVCGEVFTSPTPDQIFEGIKAADQGGGVLLIIKNYTGDVMNFEMAGEMAEAEGITVDHIIVNDDIAVEDSSFTAGRRGVAGTIIVHKIVGAAAEAGLSLQSLKVLGETVIENTKTIGVSILPATVPAVGKPGFELGDDEMEYGVGIHGEPGYRKEKLKSSKEIAEELILKLKEAFGWSKGDKYGVLVNGLGATPLMEQYVFMNDVANKLTEEGLNIQFKKVGSFMTSIDMAGVSLTLIKIVEEKWLDYWNHEVKTVDWM

SEQ ID NO: 9623 - DNA, 1695 bp, Agrobacterium tumefaciens
  CDS (1)..(1695)
atgaagaagctcatcaacgatccatccaccgttgtccgggacatgctggagggcatcgtggcgctcagccccgaaaccattctgcttcaggatgagaacgtggtcataaggtccggcctgcctgaagcggaaaagcgcaaggttgcagtgctttcgggcggtggcagcggacatgagccggcccacgccggttatgtcggcacgggcatgttgacggttgcggtggcgggcgatgtcttcacttcgccgagcaccgacgcggttctcgccggcatcagggccgcggccggccctgccggtgcgctggtcatcgtcaagaactataccggcgaccggctgaatttcggcttggcggcggagctggcgagggccgaaggaatccctgtcgagatcgttgtcgtcgccgacgacgttgccttgaaggatacggttcccgccgagcgccgccgcgggattgcggggacggtgctcgtgcacaagctcgcgggggccgcagcggaaaagggccttcctcttcaagaggtggcccgcatcgcccgggacgctgccgccaagctatcttccatgggtgtctcgctgggatcctgcacgctgccggctgtcggcaagccgggcttcgtgcttggcgagaccgaaatcgaagtcgggctcggtatccatggcgagcagggcgtgcagcggatgcccattgcctcggctgacgcgctcgtgcagctggtgatcgaaacgatcgaagccgacggcaagctcgccggcggcaatcgcgtcgctctgctggtcaacggcctgggggcaacgccgccgatggaactcgccatcgtcgcacggtcggcagtcgcgcggctggaggcgaaaggcatcgtcgtggaacgtgcctgggccggcaccttcctttcagccctcgatatgcccgggttttcgttgtcggtcatgcaggttgacgacgcagcgctcagcctcatcgacgcgccaaccgaggctggcgcatggccgcgcggcggtgcggtgaaccgcaagcgggttctgccttcggcaaacgccgaaaagaccgtggttgcgacaaacaagatgacggcggccggcgagcggcttcgttcgggcgcggaacggtccgcgagagccctgatcgctgcggagcccaggctgacgcaactcgatagcgttgcaggtgacggcgacctcggcgccagcatggtgcgtggcggcgaggcgatccttgcgctgccgaaagagagtttcggcgacgtctccgatggattgatggcgatggccaatgcgatgcgcaaggccatcggcggaagctcggggccgttctatgcgacaggcctcatgcgcgcttcgcgacagctggcagggatcgatgagccagcggcccagcagatggcggaagcattcgtggcggctgttgcggcggtctcggaacttggcggtgcgaaaccgggcgatcgcacgatgatcgatgcgctttatccggcagcgaaaaccttcagggacaagcttgtgacaggcgcttcggcagaagaagcctggcaatccgcggtggcggcgggcgaggtgggcgcagaggcgacagcgtccatgaagccacggctcgggcgcgcaagttacctcggtgagcgggccgtcggccatcccgatgggggcgcggtcgccgttggcatctggctcaaagctatcgaggctgcgatctcgtga

SEQ ID NO: 9624 - protein, 564 aa, Agrobacterium tumefaciens
MKKLINDPSTVVRDMLEGIVALSPETILLQDENVVIRSGLPEAEKRKVAVLSGGGSGHEPAHAGYVGTGMLTVAVAGDVFTSPSTDAVLAGIRAAAGPAGALVIVKNYTGDRLNFGLAAELARAEGIPVEIVVVADDVALKDTVPAERRRGIAGTVLVHKLAGAAAEKGLPLQEVARIARDAAAKLSSMGVSLGSCTLPAVGKPGFVLGETEIEVGLGIHGEQGVQRMPIASADALVQLVIETIEADGKLAGGNRVALLVNGLGATPPMELAIVARSAVARLEAKGIVVERAWAGTFLSALDMPGFSLSVMQVDDAALSLIDAPTEAGAWPRGGAVNRKRVLPSANAEKTVVATNKMTAAGERLRSGAERSARALIAAEPRLTQLDSVAGDGDLGASMVRGGEAILALPKESFGDVSDGLMAMANAMRKAIGGSSGPFYATGLMRASRQLAGIDEPAAQQMAEAFVAAVAAVSELGGAKPGDRTMIDALYPAAKTFRDKLVTGASAEEAWQSAVAAGEVGAEATASMKPRLGRASYLGERAVGHPDGGAVAVGIWLKAIEAAIS

SEQ ID NO: 9625 - DNA, 948 bp, Lactococcus lactis subsp. lactis
  CDS (1)..(948)
atgttaaaagggattgatttgacttaccctcagttgacttatctaccagaaactggaattctctatgataatacatataatgaaaaaacagttccaattatttcaggtggaggaagtggtcatgaaccggcccatgtaggttacgttggttctggaatgcttgcggcagctgtgactggtcctctatttataccaccaaagtctaaaaatattttaaaagctattcgccaagttaactcaggcaaaggcgtttttgtgattatcaaaaattttgaagctgacttaaaggaatttaatgaggcaataaaagaagcgagaactgaaggaattgatgtaagatatattgtcagtcatgatgatatttcggtaaatgcttataattttcataaaagacatcgaggagttgctggaacaattttacttcataaaattctcggtgcttttgctaaagaaggcggaagtattgatgaaattgaacaattagccctgtcactttccccagaaatttatactttgggtgttgccttagcacctgttcattttcctcatcaaaagacttcatttgttctagctgaagatgaagtttcttttggaattggaatacacggagaacccggttatcgtgttgaaaaatttgaaggctcagagcgtattgccatagagttagtaaataagttaaaagcagaaattaactggcaaaaaaaagcaaataaaaattatattttgcttgtaaatggtttgggttcaacaacattaatggaactttacagttttcaatatgatgtgatgcgccttttagaacttgaaggcttatctgttaagttttgcaaagttggaaacttaatgacaagttgtgatatgtcaggaatttcattaacgctttgttctgttaaagatcctaaatggttggactatctgaatgttccaacgggagcttttgcatggtaa

SEQ ID NO: 9626 - protein, 315 aa, Lactococcus lactis subsp. lactis
MLKGIDLTYPQLTYLPETGILYDNTYNEKTVPIISGGGSGHEPAHVGYVGSGMLAAAVTGPLFIPPKSKNILKAIRQVNSGKGVFVIIKNFEADLKEFNEAIKEARTEGIDVRYIVSHDDISVNAYNFHKRHRGVAGTILLHKILGAFAKEGGSIDEIEQLALSLSPEIYTLGVALAPVHFPHQKTSFVLAEDEVSFGIGIHGEPGYRVEKFEGSERIAIELVNKLKAEINWQKKANKNYILLVNGLGSTTLMELYSFQYDVMRLLELEGLSVKFCKVGNLMTSCDMSGISLTLCSVKDPKWLDYLNVPTGAFAW

SEQ ID NO: 9627 - DNA, 951 bp, Lactococcus lactis subsp. lactis
  CDS (1)..(951)
atgttagacggattaacctatgcttacggggatttgattgaaaaagttccagattttgaaattattcaacgtaaaagtcctaaaagtggaaaagttgccttagtatcaggcgggggttctggacacaaaccggctcatgctggctttgtcggggaaggaatgctgtcagcagctgtttgtggagctattttcacatcaccaacgcctgatcaaatttatgaggcaatcaaatctgctgacgaaggagctggagtactcttaattatcaaaaattatttaggcgatgtgatgaattttgaaatggcacgagaaatggctgagatggaagagattaaggttgagcaaattattgttgacgatgatatcgccgttgaaaattcgctctatactcaaggaagacgaggagttgctggaacagtccttgttcataaaatattaggcgcagctgcccatcaagaggcttctttagatgaaatcaaagatttggctgataaggtcgtcaagaatatcaagactattggcttagctttgtcagccgcaacagttccagaagttggaaaacctggttttgttcttgatgataatgaaattgaatatggcgtaggaattcatagtgaacccggataccgtcgggaaaaaatgaaaacttcttatgagctagcaacagaactggttggaaagttgaaagaagaattcaaatttgaagctggtcaaaaatatggaattcttgtaaatggtatgggagcgacgccactaatggagcaattcatttttatgaatgatgttgcaaaattactgacagaagaaaatattgaaattctttttaaaaaagttgggaattatatgacttcaattgatatggcaggcttgtcacttacaatgattaagttggaagatgaccaatggctcaaaaatcttaatgaagacgtgaaaactatttcttggggataa

SEQ ID NO: 9628 - protein, 316 aa, Lactococcus lactis subsp. lactis
MLDGLTYAYGDLIEKVPDFEIIQRKSPKSGKVALVSGGGSGHKPAHAGFVGEGMLSAAVCGAIFTSPTPDQIYEAIKSADEGAGVLLIIKNYLGDVMNFEMAREMAEMEEIKVEQIIVDDDIAVENSLYTQGRRGVAGTVLVHKILGAAAHQEASLDEIKDLADKVVKNIKTIGLALSAATVPEVGKPGFVLDDNEIEYGVGIHSEPGYRREKMKTSYELATELVGKLKEEFKFEAGQKYGILVNGMGATPLMEQFIFMNDVAKLLTEENIEILFKKVGNYMTSIDMAGLSLTMIKLEDDQWLKNLNEDVKTISWG

SEQ ID NO: 9629 - DNA, 786 bp, Pichia angusta
  CDS (1)..(786)
atggtgggcagacgtggtctggccggtacgagtcttgtgcacaagattgtcggtgccaaggccgccaaggactcgaacaaagcctcgttgagcgaggtgtaccagctgggcgaggccgtggtggccaatctggtgaccatcggcgcgtcgctcgaccactgcactattccgggtaacagacaccacgagtccgagtccgacgacgaggacgagcagaaacatctgctcaaggaggacgagatcgaggtgggcatggggatccacaatgagtcgggcatcaagcgtgtttcgccgatcccgaccatcgacacgcttgtggcagatctgctcaagtacttgctcgacaagagcgacgaggagagaaactatgtggacttcgactcgtcggacgaggttgtgctgatgatcaacaatttgggcggcacgtcgaacctcgaactgtacgctatccagaacactgtcgttgagcagctggccaccgactacaagatcaagccagcaagagtgtacacgggcgcgtacaccacgtcgctagacggtcctggtttttcgatcacgttgctgaacgtgaccaaggcggggggaaaggaggttttcgagtgtctggactacccaaccaaggttcctggatggaactcgtcgtacacaacggcagaatgggcggcgaagtccgagtcgttcgtcatcgacgctccgccagtgagcgacgcgtcgcgacctcgaaagtgcggttctcgagcagcacagtcaaggctgtgttggagagcgggtgcaagaagctgctga

SEQ ID NO: 9630 - protein, 261 aa, Pichia angusta
MVGRRGLAGTSLVHKIVGAKAAKDSNKASLSEVYQLGEAVVANLVTIGASLDHCTIPGNRHHESESDDEDEQKHLLKEDEIEVGMGIHNESGIKRVSPIPTIDTLVADLLKYLLDKSDEERNYVDFDSSDEVVLMINNLGGTSNLELYAIQNTVVEQLATDYKIKPARVYTGAYTTSLDGPGFSITLLNVTKAGGKEVFECLDYPTKVPGWNSSYTTAEWAAKSESFVIDAPPVSDASRPRKCGSRAAQSRLCWRAGARSC

SEQ ID NO: 9631 - DNA, 1755 bp, Saccharomyces cerevisiae
  CDS (1)..(1755)
atgtccgctaaatcgtttgaagtcacagatccagtcaattcaagtctcaaagggtttgcccttgctaacccctccattacgctggtccctgaagaaaaaattctcttcagaaagaccgattccgacaagatcgcattaatttctggtggtggtagtggacatgaacctacacacgccggtttcattggtaagggtatgttgagtggcgccgtggttggcgaaatttttgcatccccttcaacaaaacagattttaaatgcaatccgtttagtcaatgaaaatgcgtctggcgttttattgattgtgaagaactacacaggtgatgttttgcattttggtctgtccgctgagagagcaagagccttgggtattaactgccgcgttgctgtcataggtgatgatgttgcagttggcagagaaaagggtggtatggttggtagaagagcattggcaggtaccgttttggttcataagattgtaggtgccttcgcagaagaatattctagtaagtatggcttagacggtacagctaaagtggctaaaattatcaacgacaatttggtgaccattggatcttctttagaccattgtaaagttcctggcaggaaattcgaaagtgaattaaacgaaaaacaaatggaattgggtatgggtattcataacgaacctggtgtgaaagttttagaccctattccttctaccgaagacttgatctccaagtatatgctaccaaaactattggatccaaacgataaggatagagcttttgtaaagtttgatgaagatgatgaagttgtcttgttagttaacaatctcggcggtgtttctaattttgttattagttctatcacttccaaaactacggatttcttaaaggaaaattacaacataaccccggttcaaacaattgctggcacattgatgacctccttcaatggtaatgggttcagtatcacattactaaacgccactaaggctacaaaggctttgcaatctgattttgaggagatcaaatcagtactagacttgttgaacgcatttacgaacgcaccgggctggccaattgcagattttgaaaagacttctgccccatctgttaacgatgacttgttacataatgaagtaacagcaaaggccgtcggtacctatgactttgacaagtttgctgagtggatgaagagtggtgctgaacaagttatcaagagcgaaccgcacattacggaactagacaatcaagttggtgatggtgattgtggttacactttagtggcaggagttaaaggcatcaccgaaaaccttgacaagctgtcgaaggactcattatctcaggcggttgcccaaatttcagatttcattgaaggctcaatgggaggtacttctggtggtttatattctattcttttgtcgggtttttcacacggattaattcaggtttgtaaatcaaaggatgaacccgtcactaaggaaattgtggctaagtcactcggaattgcattggatactttatacaaatatacaaaggcaaggaagggatcatccaccatgattgatgctttagaaccattcgttaaagaatttactgcatctaaggatttcaataaggcggtaaaagctgcagaggaaggtgctaaatccactgctacattcgaggccaaatttggcagagcttcgtatgtcggcgattcatctcaagtagaagatcctggtgcagtaggcctatgtgagtttttgaagggggttcaaagcgccttgtaa

SEQ ID NO: 9632 - protein, 584 aa, Saccharomyces cerevisiae
MSAKSFEVTDPVNSSLKGFALANPSITLVPEEKILFRKTDSDKIALISGGGSGHEPTHAGFIGKGMLSGAVVGEIFASPSTKQILNAIRLVNENASGVLLIVKNYTGDVLHFGLSAERARALGINCRVAVIGDDVAVGREKGGMVGRRALAGTVLVHKIVGAFAEEYSSKYGLDGTAKVAKIINDNLVTIGSSLDHCKVPGRKFESELNEKQMELGMGIHNEPGVKVLDPIPSTEDLISKYMLPKLLDPNDKDRAFVKFDEDDEVVLLVNNLGGVSNFVISSITSKTTDFLKENYNITPVQTIAGTLMTSFNGNGFSITLLNATKATKALQSDFEEIKSVLDLLNAFTNAPGWPIADFEKTSAPSVNDDLLHNEVTAKAVGTYDFDKFAEWMKSGAEQVIKSEPHITELDNQVGDGDCGYTLVAGVKGITENLDKLSKDSLSQAVAQISDFIEGSMGGTSGGLYSILLSGFSHGLIQVCKSKDEPVTKEIVAKSLGIALDTLYKYTKARKGSSTMIDALEPFVKEFTASKDFNKAVKAAEEGAKSTATFEAKFGRASYVGDSSQVEDPGAVGLCEFLKGVQSAL

SEQ ID NO: 9633 - DNA, 872 bp, Mycoplasma capricolum
  CDS (74)..(550)
tatcaaatttattaaatagtataatttaattaagtctaataagtaaaatgcttataaagatgaaaggtagattatgaaaaagttgataaacagttctgaaacattagttaatgaaatgttagaaggtttggttaaagcttatccagataaattaaaaagaattgataattttgatgtagttattagaaaaaattctccaattgaaaataaagttgctcttgtaagtggtggaggttctggtcatgaaccagcacatgcaggttatgttggatatggtatgttagatgcagcagtagctggagctgtatttacttcaccaactcctgatcaaatttatcaagcaattaaatctgttgattcaaaaaaaggagtactattaatcattaaaaattatactggtgatattttaaactttgaaatggctcaagatatggctagtatggatggaatagaagtagaatctgttgttgttaatgatgatgtagctgttgaagatagtttatatacagcgggaagaagaggagtagctggaactgtttttgtttcataaaatagctggagcaaaagctgaaatgaatgcttcgcttcaagaagttaaacaagttgctttaaaagtaattaataatgtaagaacaatgggaatggcaatttctccatgtattttaccatcaactggtaagtcaaatttctcattaaatgaagatgaaatagaaattggaataggaattcatggtgaaccaggagtttatagaaaaaaaataacaccagtaaatcaaatagtagatattttaatagagagaattttaaatgatattactattaataaaggtgaagaaatagcagttatgataaatggaatgggtgtcacacct

SEQ ID NO: 9634 - protein, 158 aa, Mycoplasma capricolum
MKKLINSSETLVNEMLEGLVKAYPDKLKRIDNFDVVIRKNSPIENKVALVSGGGSGHEPAHAGYVGYGMLDAAVAGAVFTSPTPDQIYQAIKSVDSKKGVLLIIKNYTGDILNFEMAQDMASMDGIEVESVVVNDDVAVEDSLYTAGRRGVAGTVFVS

SEQ ID NO: 9635 - DNA, 2225 bp, Lycopersicon esculentum (tomato)
  CDS (137)..(1921)
gaattcggcacgagcctctataaatcttttttttccccttctctctctttttgtgtttgttcagacttcggacaaagcattcaacaattgaagtctactctccccacacctacaaagccctcagcacaattatccgatggattttcagagcaaaaaactcatcaacgaccccaatgatgttgtgacagagttcattgagggacttattgagaattatccagggttgcagtatctggatggtttcccagaggttaaggtcgtcttgcgtgctgatgtttctggtgcaaaatatgacaaagttgccatcatatcaggtggtggaagtggccatgagcctgctcatgctggatttgttggagaagggatgctgactgcagctatctgtggggacgtttttgcctctccaaatgttgattcaattcttgcgggcatacgagctgtcacaggtcccatggggtgccttcttattgtcaagaactatactggtgatcgactgaattttggtttggctgctgaacaagcaaaatctgaaggttataaagtcgagatggtaatcgtcggtgatgactgtgctttaccacctccaagaggcattgctggccgaagagggttggcagggacgcttcttgttcacaaggttgccggagctgcagcagcttgtggtcttccccttgctgacgttgcagctgaagccaaacgtgcatcagaaatggttgggacaatgggcgttgcgttatctgtttgcacgtcgccaggacaggtgacttcagaccgtttaggcccagggaagatggagcttggtcttggaatacatggggaaccaggagctgctgtagctgaccttcaaccagtagatgtggtggtttctcatgttctgaaggagattttgtcaccggagaccaactacgttccaatcacgcgtgggagtagagtcgtgctcctgattaatggattaggagcaacaccattgatggaattgatgattatagctggcaaggctgtcccagaattgcagcttgaacatggtctagctgttgatagagtctatacagggtcatttatgacgtcacttgatatggcaggcttttcaatttcggtaatgaaggctgatcaagcaattttagatcgtttagatgctccaactaaagctccaaattggcctgttggtgctgaaggcaaccggcctcctgcaaagattcctgttccacttccgccatcacattctatcaagattgaaaagacattgagtcggcctgaaaaactgagccctcagggtcatatccttgagacagctattgaagcagcagctactgaagttgtaaatctcagggataatttgaatgagtgggacaataaagttggtgatggcgattgtggttcaactatgttcagaggtgctgtggctatacttgaagacatgaagaagtactatccgttgaatgaccctgcagaaacagtcaatgaaattggagcctccattggaagagtaatggggggaactagcggtatcttatacagtatattctgtaaggcagcatatgcgaagttgaaagaaaatgctgagtcggttgtcacagctattcactgggctgatgcacttgaagctgctatcgctgctgttagtaaatatggaggagctagtgctggttatcgtacccttttagatgctcttataccagcattgtcagctcttaaagagaggttgaatgctggggacgaccctgcggatgctttcattatttctgctgaggcagcatctgctggagccgagtcaaccaagcacatgcaggcgcaggctggccgttcaacctatgtacccggagatattcttgcatcagttcctgacccaggtgccatggctgcagctgcgtggtacagagcagctgcgttagctgtgaaggagaagtataatacagcataagcatatttaatcggccattcctattacttcctgcaggaatgttttctctttctcgaggaagaaattaacccaacaattttttgctcgtaaaccttatgaggagttagctttccgcttatgcagtcctgcataaagccgagagagtgtagaaaatgtatgttacagtccttttatacagtgttctaagtgagggaaaaaacaaacactgccatgtagaatggtaatctgtgaaggtggttgtaaactttattgtaacaatggattttcttattctgctacttttagcaaaaaaaaaaaaaaaaaa

SEQ ID NO: 9636 - protein, 594 aa, Lycopersicon esculentum (tomato)
MDFQSKKLINDPNDVVTEFIEGLIENYPGLQYLDGFPEVKVVLRADVSGAKYDKVAIISGGGSGHEPAHAGFVGEGMLTAAICGDVFASPNVDSILAGIRAVTGPMGCLLIVKNYTGDRLNFGLAAEQAKSEGYKVEMVIVGDDCALPPPRGIAGRRGLAGTLLVHKVAGAAAACGLPLADVAAEAKRASEMVGTMGVALSVCTSPGQVTSDRLGPGKMELGLGIHGEPGAAVADLQPVDVVVSHVLKEILSPETNYVPITRGSRVVLLINGLGATPLMELMIIAGKAVPELQLEHGLAVDRVYTGSFMTSLDMAGFSISVMKADQAILDRLDAPTKAPNWPVGAEGNRPPAKIPVPLPPSHSIKIEKTLSRPEKLSPQGHILETAIEAAATEVVNLRDNLNEWDNKVGDGDCGSTMFRGAVAILEDMKKYYPLNDPAETVNEIGASIGRVMGGTSGILYSIFCKAAYAKLKENAESVVTAIHWADALEAAIAAVSKYGGASAGYRTLLDALIPALSALKERLNAGDDPADAFIISAEAASAGAESTKHMQAQAGRSTYVPGDILASVPDPGAMAAAAWYRAAALAVKEKYNTA

SEQ ID NO: 9637 - DNA, 1743 bp, Schizosaccharomyces pombe
  CDS (1)..(1743)
atggataagcactttatcaacgatcctgaagtcctcgtccttgatggccttaaatccttggccgacatgaacaaaactttaactgttcatgaagagggaaaattcatctatttccatgactacaacaaaaagaatgtcagtgtcatttccggcggtggtgctggtcatgaacccactcattcttcgttcgtgggcaagggtatgcttactgccgccgtctcaggctccatttttgcttctccgtcgtcaaagcaaatttataccggtattaagcaagtcgaatctgaggctggcaccttggtaatttgcaaaaactacaccggtgacatccttcactttggtatggccttggagaagcaaagaacggctggtaagaaggctgaacttattgccgttgcagatgacgtatcagtaggtcgtaagaagagcggtaaggtcggacgtcgtggtttgtctggtactgttcttgttcacaaaatcgctggtgcagctgccgccagagggttacctttggaagccgttacgaccattgctaaggctgctattgacaatttggttagtatcggtgcttcactcgctcacgttcacgtccctggtcatgagccaattgcaaaagaagatgaaatgaaacatgatgaaatggaacttggaatgggtattcacaatgaacctggatgcaagcgtatttcccctattccctctattgatgacctaattgctcagatgcttaagcaaatgttggatcaatccgacaaggaccgtgcctatgtaaagattgagggtgacgatgaagtagtcttacttatgaataaccttggtggtctttccatgcttgaattcagtgccattagccacaaggtgaaggaagcattggctaaagaatacaaaatcaaccccgttcgcatctttgccggtccatttaccaccagtttgaatggcttgggtttcggtatcactttgctccgtaccactgaccgcgtcaaagtcgagggcgaagaatactctttggttgatttgattgaccaacctgttgaagctatcggatggcctttgtgtcaaccctctgacttgaagtccaaaaacaagattggcaatgtcagcatcgaggagggtcagaaggatgtcaagtctcccgttactgtcgataaggagaaggttcgtcaggcgattgtcaattcgatggagaatctcatcaaagcagagcctaaaattacaaagttcgatacgatggctggtgatggtgactgtggtactactttgaagcgtggtgctgaaggtgttttgaagtttgttaaatccgacaaattctctgacgatcctattcgtattgttcgtgatatcgcagatgttattgaagacaatatggatggtacatctggtgctttgtacgccattttcttccatggctttgcgaagggcatgaaagacaccttggagaagagcaaggacatttcatctaagacatgggctgctggtttgaaggttgctcttgatactcttttcaagtatactcccgctcgtcctggtgacagcactatgtgtgatgctcttgttccatttgtcgaaacatttgttaaaactaatgatcttaatgctgccgtagaggaggctcgtaaaggtgctgatgctactgcagatatgcaagccaaacttggacgtgctgtctacgttggtgatgatgttaaagttcccgatgccggcgctcttggtgtcgttgcaattgtcgaaggatttacgaaataa

SEQ ID NO: 9638 - protein, 580 aa, Schizosaccharomyces pombe
MDKHFINDPEVLVLDGLKSLADMNKTLTVHEEGKFIYFHDYNKKNVSVISGGGAGHEPTHSSFVGKGMLTAAVSGSIFASPSSKQIYTGIKQVESEAGTLVICKNYTGDILHFGMALEKQRTAGKKAELIAVADDVSVGRKKSGKVGRRGLSGTVLVHKIAGAAAARGLPLEAVTTIAKAAIDNLVSIGASLAHVHVPGHEPIAKEDEMKHDEMELGMGIHNEPGCKRISPIPSIDDLIAQMLKQMLDQSDKDRAYVKIEGDDEVVLLMNNLGGLSMLEFSAISHKVKEALAKEYKINPVRIFAGPFTTSLNGLGFGITLLRTTDRVKVEGEEYSLVDLIDQPVEAIGWPLCQPSDLKSKNKIGNVSIEEGQKDVKSPVTVDKEKVRQAIVNSMENLIKAEPKITKFDTMAGDGDCGTTLKRGAEGVLKFVKSDKFSDDPIRIVRDIADVIEDNMDGTSGALYAIFFHGFAKGMKDTLEKSKDISSKTWAAGLKVALDTLFKYTPARPGDSTMCDALVPFVETFVKTNDLNAAVEEARKGADATADMQAKLGRAVYVGDDVKVPDAGALGVVAIVEGFTK

SEQ ID NO: 9639 - DNA, 3269 bp, Schizosaccharomyces pombe
  CDS (922)..(2697)
gaattcaatctagaatttggtcttgttgatgttctagaacgagcttcttggtttttttgagatattttttctaccacagaattaccaaggacgtggggcaaaggaccgctcaaactccatactggtttattgggtttacttccaacatttagctcttcgtagagtggatcaacataatttggacgagaacttcctgagttatcttcaagctttccagctaaatatccttcgagccaatgttgtgattccggatcagcagaattgtttaggtccttgaggtttggagaagaaaatgctacctttaaagcatctttggtttttgattgattaggcaaagtcgtatttattttttttggtatattttgttgagttgatgggccaccatgaacgctctcagtctctgagtctgagggcgatgacgatggcgacggaatgtgtgaagaagtgttcatataaattggattgaaaacgagaataacctcagcttatatggaaattttttatatggattcggttacgtccgagaatgctctattggtttgagaacaaggcggggaaaaaggatacggtgtcaacgtttttttttacattctgataataaattattcaacatatcaaacgtcaatggcaacatggatgtggggaattatattaagtgacgaactcgataaaagcggagtagtctatctacaagaatttactttatgattgtccctcaaactccactttttagtttccacaataagctccacttttaactaaagggggctagttccaagtttccggtcgatctcgaataatgattggttatacaagccgatcacccgcatcccgcaaatctcagaacataccgtgcgcggggtaaggtgattcaagagaataggtttaaaagaagaaagaaacgttccttttcaattaaaaatgtctgtaaaacaatttgtatctgaaggacatatagtacgcccatacttgcttggacttgctagaagtaaccctggcctaactgttattgaacatgatcgtgtaatttacaggacagcctctgccccgggttctggtgatccgcctaaagtaactttagtgtctggtggtggtagtgggcacgagcctacacatgctggttttgttggtgatggagccttggacgccgtagcttgtggagacatttttgcttctccctctactaaacaaatttactctgctctcaaagctgttgcatctcctaagggaactttaattattgtcaaaaattacacaggtgatattattcattttggcttggcagctgagagagccaaggcagctggaatgaacgttgagcttgttgccgtaggagatgatgtttctgtaggcaaaaagagaggtgcactcgtaggacgaagaggtttaggagccactgtgctagtacacaaaattgcgggatctgcagcagcattaggactggatctgcatcaagttgctcaagtggcccaatcagtgattgacaatgctgctaccatagcagcttcattggatcactgcgccgttcccggtcgcaaatttgaaacaaacttgggtccagacgagtatgagattggaatgggtattcataacgagcctggaaccttcaaatcatcaccacttccatctattcccgagctagttacagagatgctttcgattttgtttggtgagaaaaacccggacaatagtttcgtagagttttcttcaaaagacgatgttattcttctagtaaacaatatgggtggtatgtccaacttagagttgggatatgctactgaagtagtttcggaacaattagccaaacgaggtatcattcctaaaagaaccatgtctggtacttttgtaaccgcattgaacggaccgggttttggaattacattggtcaatgcttctaaggctactccagatattttcaaatattttgacttgccaacaactgctagtggatggaacgtttcttatcataacgcaaaggactgggaggttttggctgacggcaaggtgccaacagctcccgctttggagcatacccgtaatgagaagcacagcggtgtaaaggctgacccaaagatgtttactaaaattttaaaagctgccgttgacgctatcaatgaatttgagccaaagacaacttggtacgatacgattgcaggagatggtgattgtggaacaacccttgtgaatggtggagaggccatcataaaggctattaatgataaatcaattcgattggatgatggtgtaaatggtattgacgatttggcctatattgttgaggattcgatgggaggtacatcgggtggtctttactcgatttatttgtctgcgctagccaaaggagttcgtgagtcaggcgattccgaattatccgtgcatacgtttgcgtttgcaagcaagtatgcacttgacgctcttttcaaatacactagggcccgtaaaggattccgtactctgatcgatgctattcaaccatttgttgaaactttaaatgaaggtaagggacttgatgctgctgcgaaagctgccacggaaggttctgaacaaactagaaaaatggatgctgtcgttggaagagcgtcttatgttgctaaagaggaacttcataagcttgatagtgagggaggcttaccggatcctggtgcctttgcgttagcggcgatcttgaaagcaattgttgaggctagtgaacattaaaacgttttctatagctatctcaggtttgactcatgttgatcatgcacagaagtgatatcgtaaaggcatatcgtgtgagcggagattttaaaatttgttttggctttctcctaaagtttttgccacagtatgcttgactaaattctttgttcattaccttttacaacttttctttattagtcaatatattgtgaataaaaagccttaaattaaacgattacttatgtattatgtacatttttgctcctgtcgtctagtgttaatttataagcaagcgtcgtattatgatataaagtcatgttgaaaaaagtgttattactttagggattctaacaaatattctgtccatatgcagttagaagtggtaatgtaacttgagatcgccattagaattagacgactgaaagaatccacggtttagcatagtcaatgtggacagtgtcgttttgatcgacggtcgatcgcgggattgatcagttgacgtatatttgtgccacttttgttgttcgttaaccaaaacagtcagtaatagcgataaattaaatgcgttccattctctgatttcaataata

SEQ ID NO: 9640 - protein, 591 aa, Schizosaccharomyces pombe
MSVKQFVSEGHIVRPYLLGLARSNPGLTVIEHDRVIYRTASAPGSGDPPKVTLVSGGGSGHEPTHAGFVGDGALDAVACGDIFASPSTKQIYSALKAVASPKGTLIIVKNYTGDIIHFGLAAERAKAAGMNVELVAVGDDVSVGKKRGALVGRRGLGATVLVHKIAGSAAALGLDLHQVAQVAQSVIDNAATIAASLDHCAVPGRKFETNLGPDEYEIGMGIHNEPGTFKSSPLPSIPELVTEMLSILFGEKNPDNSFVEFSSKDDVILLVNNMGGMSNLELGYATEVVSEQLAKRGIIPKRTMSGTFVTALNGPGFGITLVNASKATPDIFKYFDLPTTASGWNVSYHNAKDWEVLADGKVPTAPALEHTRNEKHSGVKADPKMFTKILKAAVDAINEFEPKTTWYDTIAGDGDCGTTLVNGGEAIIKAINDKSIRLDDGVNGIDDLAYIVEDSMGGTSGGLYSIYLSALAKGVRESGDSELSVHTFAFASKYALDALFKYTRARKGFRTLIDAIQPFVETLNEGKGLDAAAKAATEGSEQTRKMDAVVGRASYVAKEELHKLDSEGGLPDPGAFALAAILKAIVEASEH

SEQ ID NO: 9641 - DNA, 1785 bp, Neurospora crassa
  CDS (1)..(1785)
atgtcaaagcgtcaccttttcccatccttggacgggctcgtccccaaggctcttcgcggcatcgttgcttcgaacccccgactcaacctggacgaagccaacaaagtcgtatacgactccgaagcacctcggtccaatgtcagcattgtcagtggcggaggatctggacatgagcctgcctgggccggctatgttggaaccaacttacttgcggcagccgtaatgggtgacgtctttgcctcaccaagcaccaagcaaattctagccgcggtcgaatcagtaccttccgacaagggcactctcctggtaattacgaactacacgggcgactgtcttcattttggactcgcggccgagaagacgaaggcaaagggcaatccgtgtaagatgctcatctgcggcgacgatgtctccatcgggaagaagggcggctccctagtcggaagacgtgggttggccgggcaaattggagtgctcaaggttcttggtgcggcagctgctcagggggcgactctcgatgagctttacgatttcggttctgcatttgccaactcgattgtcagcatttctgctactctcgaccattgccacgtcccggggaggactgagcacggagcactagccgaggacgagctggaactgggaactggaccacacaacgagccaggttactggaagctgtcaccagcaccttcagccgagggactcgtccagcagattctcaagtactgcctggacgagacagaccccgaaagaagctacgtcaagttcaaccccggtgatgagacggtccttttgatcagcaatttcggcggcatctcgaatcttgagttgggcgggctcgtagacgagattctgcaacaactgctcaaggactggaatatggagccggttcgagtgtactcgggatgcctggagacatcactcaacgctcctgcattttcagtatccgttatcaacatcaccgctgctgcagccaacagcacctacaccgttgaccagatcaagggcttctttgacactcgaacggacaccgcctgggaagccgttgctggataccagagttatccgcgacgacgtaagcggtctgagcaggtcgttccacccccgaaagaaatcaggagaacagtcgatgactccactgacctgaagattgacccatcgctgctcgagagcatgatcgagagcgcctgcaacgcagtgtcagccgcagagccggatctcacaaagtgggacaccgtcatgggcgacggcgattgcggcctgaccctgcagacgggagccaacgcgctagtagatgctctgaagaccaagaaggttgcctccaatggctcggtgatcgaggtcctgaacgagctggaagatatcgtcgagggtaagatgggagggacattgggtggcattctgggtatcttcttcgtggcgctgcggacggcgcttcaggagaacatcggactcgcaaaggaagtgggagttcctgctctatggggaaaagctttgtcaactgccatcagtcatttgcgtcagtacaccccggccaaagttggtgatcgtacagtgatggacacgctgattcccttcgccatggctatggaagaagggagaagctttgaacagagcgtcgctgcagctgtgaagggatccgaagggaccaagaagttgaagccaaaactgggcagggctacttacgttggtgttggtgcggataacaacaaggagctgccgcccgatccaggtgcgtggggagccatggtcggactccagggcctcttgtcggctttctaa

SEQ ID NO: 9642 - protein, 594 aa, Neurospora crassa
MSKRHLFPSLDGLVPKALRGIVASNPRLNLDEANKVVYDSEAPRSNVSIVSGGGSGHEPAWAGYVGTNLLAAAVMGDVFASPSTKQILAAVESVPSDKGTLLVITNYTGDCLHFGLAAEKTKAKGNPCKMLICGDDVSIGKKGGSLVGRRGLAGQIGVLKVLGAAAAQGATLDELYDFGSAFANSIVSISATLDHCHVPGRTEHGALAEDELELGTGPHNEPGYWKLSPAPSAEGLVQQILKYCLDETDPERSYVKFNPGDETVLLISNFGGISNLELGGLVDEILQQLLKDWNMEPVRVYSGCLETSLNAPAFSVSVINITAAAANSTYTVDQIKGFFDTRTDTAWEAVAGYQSYPRRRKRSEQVVPPPKEIRRTVDDSTDLKIDPSLLESMIESACNAVSAAEPDLTKWDTVMGDGDCGLTLQTGANALVDALKTKKVASNGSVIEVLNELEDIVEGKMGGTLGGILGIFFVALRTALQENIGLAKEVGVPALWGKALSTAISHLRQYTPAKVGDRTVMDTLIPFAMAMEEGRSFEQSVAAAVKGSEGTKKLKPKLGRATYVGVGADNNKELPPDPGAWGAMVGLQGLLSAF

SEQ ID NO: 9643 - DNA, 1752 bp, Bacillus cereus
  CDS (1)..(1752)
atgaaaaagattataaacaaaccagaaacattagtaatggaaatgtgcaacggaatggttatggctcatccagagcttgagcttttgaaaaaatataaagtgattaagaagaaagaaatgaacgaaaataaagtaacgttaattagtggaggcggtagtggtcacgagccggcacatgcaggattagtcggaaaaggaatgttagatgcggcagtgtgcggagatgtgtttgcgtcaccttcacaaattcaggtataccaagcgattaaagagacagctagtaaaaaaggtacgttattaattattaaaaattatagcggcgatattatgaatttcaaaaacggtgcgcatttagcgaaggaagatggaattgaagtcgactacgtaaaggtggacgatgatattgcggtagaagatagcctgtacacagtaggacgccgcggcgttgcgggcgttattttagttcataaaattgccggcgcagcagcggaagcaggtatggatttaggagcggtgaaagctgtagcagaaaaagcagcggctaacgtgcgcacaatcggtttagcattaacgtcttgtacagttccagcgagtggatcacctactttcacacttgcggaagatgaaatggaatacggtgtaggtattcacggcgaaccaggaattaagcgtgaaaaaatgctgtcagcagatgaactagcgaaccgtatgacaaatgaccttgtaaaagatttaggagtaaaagatggcgaggaaatcgcaattctagttaacggttttggcggaacaccactgcaagaactttacttatttaacaacgcagttacgagagaactagctgcaagaaacattaaaattaatagagtattcgtcggtaactatatgacaagtattgatatggctggtatgtctttaacggtaatgaagttagatgaagagctaaaaacattactatcaaaagaatgtaatacaccagcgtttaaagtagacggtccagttgaaagtgtagagtacgtaaatgtacttgaagagacagaagagaaggaagtttcatttgaactagaaactgcggaagagcacgctgttattaaagataatgttattacattaaacaacatgatttatctcgttgataaaatgagcgatattattattaaaaatgaagtaccgttctgtgagctagatacgcatgctggtgatggcgacttcggaatgagtgtggcaaaaggatttaagcaattaaaacgtgagtggcactctattgtagaacaagaaaacgtaacgatcggatcattccttgacggctgttcgatgattattatggaacattgcggcggcgcatctggtccaatttggggcggtgcattccgcgcagctagtaaagcagcagccgagaagcgtgagttaacagtgaaagaattcgctgaaatgctgcaagcagcattgcaaggcatccaatcgatcggtgaaagatcattcggcagaggagcagtagttggtgacaaaacacttgttgacgcacttgctccatgtgtagactcttggttagatagcgcctcaaacgaagtagacgtaaaaactgcctttgaaaaaggagcagaagcagcggtcaaaggagcagagtacacgaaagaaatcgtagctcgcatgggccgcgctggtacagttggcgaaagaagcttaggatatccagatgcaggtgcacatgcacttggggttatctttacggagattgcaggtagtttgaaatag

SEQ ID NO: 9644 - protein, 583 aa, Bacillus cereus
MKKIINKPETLVMEMCNGMVMAHPELELLKKYKVIKKKEMNENKVTLISGGGSGHEPAHAGLVGKGMLDAAVCGDVFASPSQIQVYQAIKETASKKGTLLIIKNYSGDIMNFKNGAHLAKEDGIEVDYVKVDDDIAVEDSLYTVGRRGVAGVILVHKIAGAAAEAGMDLGAVKAVAEKAAANVRTIGLALTSCTVPASGSPTFTLAEDEMEYGVGIHGEPGIKREKMLSADELANRMTNDLVKDLGVKDGEEIAILVNGFGGTPLQELYLFNNAVTRELAARNIKINRVFVGNYMTSIDMAGMSLTVMKLDEELKTLLSKECNTPAFKVDGPVESVEYVNVLEETEEKEVSFELETAEEHAVIKDNVITLNNMIYLVDKMSDIIIKNEVPFCELDTHAGDGDFGMSVAKGFKQLKREWHSIVEQENVTIGSFLDGCSMIIMEHCGGASGPIWGGAFRAASKAAAEKRELTVKEFAEMLQAALQGIQSIGERSFGRGAVVGDKTLVDALAPCVDSWLDSASNEVDVKTAFEKGAEAAVKGAEYTKEIVARMGRAGTVGERSLGYPDAGAHALGVIFTEIAGSLK

SEQ ID NO: 9645 - DNA, 999 bp, Bacillus cereus
  CDS (1)..(999)
atgaaaaagattatgaatgatgtacaaaatatcgttcaagatatgctgcacggcttttattttgaacataacgacaaagtaaattacgatgaaacgaataacatcatttatgtaaaagatatcgaaaaaatgaagcaagacgtcgctattataagtggcggtggtagcggacatgaacctgctgatattggctatgtaggaaaaggtatgcttacagcggcagtaaacggaagcatcttcactccgcctacagtggaacaaattgcggcggcaactcgccttatgccaaaagataaaagtatactattcattattaaaaactttaaagatgacgttgagaactttcttgcggcaaagcagatcgctaaagaagaaggaagaaaaattgaccacatcatcgtaaatgacgacgtttcaattgaagatgatgcttcttttaataaaagaagacgcggcgtcgctggtactgttttcgttcaaaaaatacttggtgcggccgctcttgaaggccattctctagaagaactaacaacacttggccgctctatcactaaaaacttacacacattaggagttgctctttcccctgtcaacgatccagtaaaaggaaaagcttcattcacattaaatgacgatgaagtgttttatggcgtcggcattcacggagaaaaaggttaccgtaaagaagcactatcctcttctgaaatattagcgatcgaactaatgaacaaactaaaaagcatttatcgctggagaaaaggagacaacttcgctatcctcattaacggactcggcgcaactccattaatggaacaatacattttcgcaaacgacattcgccgtttgtgtgaacttgaaggattgcaagtgacattcgtaaaggttggtacactgttaacttctttagatatgaagggtgtttcgcttagtttgcttaaggtagaggatttggattgggtgaagtggttgaaggcggatgttagagtgggtaattggtaa

SEQ ID NO: 9646 - protein, 332 aa, Bacillus cereus
MKKIMNDVQNIVQDMLHGFYFEHNDKVNYDETNNIIYVKDIEKMKQDVAIISGGGSGHEPADIGYVGKGMLTAAVNGSIFTPPTVEQIAAATRLMPKDKSILFIIKNFKDDVENFLAAKQIAKEEGRKIDHIIVNDDVSIEDDASFNKRRRGVAGTVFVQKILGAAALEGHSLEELTTLGRSITKNLHTLGVALSPVNDPVKGKASFTLNDDEVFYGVGIHGEKGYRKEALSSSEILAIELMNKLKSIYRWRKGDNFAILINGLGATPLMEQYIFANDIRRLCELEGLQVTFVKVGTLLTSLDMKGVSLSLLKVEDLDWVKWLKADVRVGNW

SEQ ID NO: 9647 - DNA, 993 bp, Streptomyces avermitilis
  CDS (1)..(993)
atgaagatgctcatcaacgtcgcggagacggtggtcgcggacgcgctgcgggggatggcggccgcgcatccggagctgacggtggacgtggagaagcgggtgatcgtccggcgcgacgcaccggtggccggaaaggtcgggctcgtctccggcggcggctcgggacacgagccgctccacggcggcttcgtgggcccgggcatgctctcggcggcctgtcccggcgaggtcttcacgtctcccgtgccggaccagatggtgcgggccgcggccgccgtggacagcggcgcgggtgtgctgttcatcgtgaagaactacacgggtgacgtcctgaacttcgacatggcggcggaactcgccgaggacgagggcgttcaggtcgcgaaagtcctggtcaatgacgatgtcgccgtcaccgacagcctgtacacggccggccggcgcggcacgggcgcgaccttgttcgtcgagaagatcgcgggcgccgccgccgaggagggcgcgccccttcagcgggtcgaggcactggcccggcaggtcaacgagaacgcgcgcagcttcggtgtcgccctgagcgcctgcaccaccccggccaagggcagccccaccttcgacctcccggacggcgagctggagctgggtgtcggcatccacggcgagccgggccgggagcggcgcgcgatgatgacctcgcgggagatcgccgacttctcggtgcacgcgatcctggaggaccttaatccgagcaaccccgtgctggtcctggtcaacggtatgggagcgaccccactcctggagctgtacggcttcaacgcggaggtgcagcgggtgctggtggagcgcggtgtcccggtggcacgcacgctcgtcggcaactacgtcacctcgctcgacatggccggcgcctccgtcaccctgtgccaggtcgacgaggagctgctgcgtctgtgggacgcgccggtgagcacgcccggcctccgctggggcatgtga

SEQ ID NO: 9648 - protein, 330 aa, Streptomyces avermitilis
MKMLINVAETVVADALRGMAAAHPELTVDVEKRVIVRRDAPVAGKVGLVSGGGSGHEPLHGGFVGPGMLSAACPGEVFTSPVPDQMVRAAAAVDSGAGVLFIVKNYTGDVLNFDMAAELAEDEGVQVAKVLVNDDVAVTDSLYTAGRRGTGATLFVEKIAGAAAEEGAPLQRVEALARQVNENARSFGVALSACTTPAKGSPTFDLPDGELELGVGIHGEPGRERRAMMTSREIADFSVHAILEDLNPSNPVLVLVNGMGATPLLELYGFNAEVQRVLVERGVPVARTLVGNYVTSLDMAGASVTLCQVDEELLRLWDAPVSTPGLRWGM

SEQ ID NO: 9649 - DNA, 984 bp, Enterococcus faecalis
  CDS (1)..(984)
atgaaaaaaattattaatgaacctggtaaaattgtcgaagaaatgctccaaggaattgtgaaaagctatggaaaccttgttcatcaagtcgaagattctcgcgtgattgctcgcaacgactcaaacaaacaagttgggttagtatctggtggcggaagtggtcatgagcctgcacatgctgggtttgttggtgatggaatgttaaatgccgcagttttaggtgatgtctttacttcaccaacaccagatcaaattttaacagggatccaagcggcagaccaaggggccggtgttctgttaatcgtaaaaaattatacaggcgatattttgaactttgaaatggccaaagatatggctgatatggaagacattcatgtagaaatggtcgttgtcgatgatgatattgctgtcgaagatagcacctataccgctggaaaacgcggcgttgccgggactgttcttgtccataaaattttaggacatcatgcccgccaaggtgcttctttagaagagctcgtttctttaggagaaaagattgtatcagccacgaaaacaattggagtggctttaaaagcagccactgtgcctgaagttggcaaaccaggttttactttaccagaagatgaaattgaatttggcgtagggattcacggagaaccaggctatcgtcgtgaaaaaatccaaccatcgaaagagttagcgaaagaattagttgaaaaaacattaagtagctatgagcaacaaccacaaacagtaggggtacttgtcaatggcatgggtggcacgccattaatggaacaatttgtatttatgaacgacgtgctaacattgttagaagataaaggtgttcaagtgaccttccataaagtgggtaactatatgacgtctattgacatgcaaggattatctttaacgatgattgacttggcgacaaaagactggcaaacagcgctagaaagcaatgtaacaacaatttcttggtaa

SEQ ID NO: 9650 - protein, 327 aa, Enterococcus faecalis
MKKIINEPGKIVEEMLQGIVKSYGNLVHQVEDSRVIARNDSNKQVGLVSGGGSGHEPAHAGFVGDGMLNAAVLGDVFTSPTPDQILTGIQAADQGAGVLLIVKNYTGDILNFEMAKDMADMEDIHVEMVVVDDDIAVEDSTYTAGKRGVAGTVLVHKILGHHARQGASLEELVSLGEKIVSATKTIGVALKAATVPEVGKPGFTLPEDEIEFGVGIHGEPGYRREKIQPSKELAKELVEKTLSSYEQQPQTVGVLVNGMGGTPLMEQFVFMNDVLTLLEDKGVQVTFHKVGNYMTSIDMQGLSLTMIDLATKDWQTALESNVTTISW

SEQ ID NO: 9651 - DNA, 996 bp, Clostridium butyricum
  CDS (1)..(996)
atgaaaaaattaataaataatccagaaggtgttttagaagatatgttagctggtcttacagctgcttaccctgaatatttaaaaaaattagataatgccaatgtaatagtgagagctaatagcaaaaaagataaagtatcagtaataagtggtggaggtagtggacatgaacctgcacatgctggatatgtaggatatgggatgttagatggggcagtatgtggtgaagtatttacatctccaactccagaccaagtatatgaagcaattaaagctactgataatggacaaggggttttagttgtaataaaaaattatactggtgatgttatgaactttgaaatggcaaagggaatggctgaagatgaaggcataaaagttgaagaagtaattgtaaatgatgatgttgctgtagaaaatagtttatatacagcaggaagaagaggaattgcgggtactgtttttgttcataaaatagctggagctaaagcggaaagtggtagcaatttagaagaagtaaagagagttgcggaaaagactattgaaaatgttagaagtatgggaatgtccttatcatcttgtatagtaccagcagcaggcaaagctaatttttgtttaggtgaagatgaaatagagattggaatgggaatacatggagagccaggtactcatagagaaaaaatttctacagcagatgaaataacagaacatttggtaaataaaatattagatgatatgacaataaaaaatggtgatgatgttgcagttttagtaaacggtttaggatcaacacccaatatggagttatatattgtaaataaaaaaattaataaaatgttgaaagataaaggaataaatattcataaaacttttattggagaatttatgacagctttagaaatggcaggatgttctatttctatattgaagcttgatgatgaattaaaagaactacttgattcaaaatctaatactccaggattcaaagtattttag

SEQ ID NO: 9652 - protein, 331 aa, Clostridium butyricum
MKKLINNPEGVLEDMLAGLTAAYPEYLKKLDNANVIVRANSKKDKVSVISGGGSGHEPAHAGYVGYGMLDGAVCGEVFTSPTPDQVYEAIKATDNGQGVLVVIKNYTGDVMNFEMAKGMAEDEGIKVEEVIVNDDVAVENSLYTAGRRGIAGTVFVHKIAGAKAESGSNLEEVKRVAEKTIENVRSMGMSLSSCIVPAAGKANFCLGEDEIEIGMGIHGEPGTHREKISTADEITEHLVNKILDDMTIKNGDDVAVLVNGLGSTPNMELYIVNKKINKMLKDKGINIHKTFIGEFMTALEMAGCSISILKLDDELKELLDSKSNTPGFKVF

SEQ ID NO: 9653 - DNA, 1059 bp, Vibrio parahaemolyticus
  CDS (1)..(1059)
atgaaaaagttaattaaccaagtcgatgatgttgtattgcagcaaatggaaggcctggcattgtcccgccctgagctaaaagctaactacgaacctcgttacatgtggcatgaggaaacgccggggcaagtggcattggtttctggtggtggctgtggtcatgaacctttacacgcaggttttattggtaaaggcatgctgacaggcgcttgccctggagaggtatttacttcacctacgccagatcaaatgtacgaatgtggtaaccaagtgaatactggtgaaggcgtgctatttattattaaaaactacaccggagacgtgttgaactttgaaacggccgtggagttgcttcataccgatggcatcaaagttggggcggtgttggtggatgacgatgttgcggtcaaagacagcctgtacaccgctggtcgtcgtggtgttgctggaacggtattagttgagaagttagttggtgctgccgcgaacaaaggttattcgctggagcaatgtgaagcactggctcgtcgcgttaataatcactgtcgttcatttggcgtggcgcttaatgcttgcgttgtgccagctgcgggtaaaccatcttttgttctggaagatgatgaagtggagtttggtgttggtatccatggtgaaccaggtatcaagcgagtgaaatacaccgacgccgatatgttagtggatgagatgtttgctgaagttgctgaaaacacgccttatcagcgcacattgcgtatttggaatcgtgacgaaggtgaatgggatgaagtggaatccagcattgagcctttcgccgctgaacacgactacattgtgatggtgaatggtatgggcggaacgccaatttctgagctttacggagtgtaccgccgtcttgcccataactgcgagcaagcggggttccgtatcgtgcgtaatatggttggtaacttctgtacgtcactcgatatggaaggcgtttcaattacgttgctgaaagcagataaagagatgttggagctgtttgatgctcctgtcgatacggctgcaatcaagtggtaa

SEQ ID NO: 9654 - protein, 352 aa, Vibrio parahaemolyticus
MKKLINQVDDVVLQQMEGLALSRPELKANYEPRYMWHEETPGQVALVSGGGCGHEPLHAGFIGKGMLTGACPGEVFTSPTPDQMYECGNQVNTGEGVLFIIKNYTGDVLNFETAVELLHTDGIKVGAVLVDDDVAVKDSLYTAGRRGVAGTVLVEKLVGAAANKGYSLEQCEALARRVNNHCRSFGVALNACVVPAAGKPSFVLEDDEVEFGVGIHGEPGIKRVKYTDADMLVDEMFAEVAENTPYQRTLRIWNRDEGEWDEVESSIEPFAAEHDYIVMVNGMGGTPISELYGVYRRLAHNCEQAGFRIVRNMVGNFCTSLDMEGVSITLLKADKEMLELFDAPVDTAAIKW

SEQ ID NO: 9655 - DNA, 999 bp, Lactobacillus plantarum
  CDS (1)..(999)
atgaaaaaaataattaatgatcccaagaatgtcgtcgacgaaatggttgatgggttagtacgtgcctatcctcagtatttaactaaattaccggataccgaagcaatggttcgtagtgatcaagattcaatgcagggaaaagttggaattgttagtggtggcgggagtggtcatgagcccgcccacgccggctttgttggccctggcatgctcagcgctgccgtggcaggacaggttttcacctcaccgacgccagaccaaatttatgcggcaattaaggctgtcgatcaaggtaagggcgttttcttagtcgtgaagaattattctggtgatgtcatgaatttcgatatggcgaaagatatggctgaattagatgatattcaagttaaatcgattgtcgttgatgatgacattgctgttaaggatagtttatatactcagggtcgtcgcggggttgccggcactatctttatgcataagatacttggggcggccgcggatcaaggcgttgatttggatgatttagaaagtttagcaacgcatgttttaccacggattaaaacgattgcggtcgcattatccgcagcgacggttccggaagtcggcaaacctggctttgaattggcagatgatgaaatcgagtttggcgtcggaatccatagcgaaccaggttatcggcgcgaaaaaatcaagccatccaaacaacttgttcaggaattgctaggtaaattagatgatgaattacacctacagtcagatcatcagtatgcgttcttggttaatggtatgggagcgacgccattgatggatcagtatgtcttttgccatgacttgttggatgaactggcaacacggcacattcaaccggcctttatgaaggttggtaattatatgacttcgattgatatggccggtatttcactgacgatattcgatgttgctgaatctcagtggctagattacttacagtacccggtcaaaacaatcgcgtggtcataa

SEQ ID NO: 9656 - protein, 332 aa, Lactobacillus plantarum
MKKIINDPKNVVDEMVDGLVRAYPQYLTKLPDTEAMVRSDQDSMQGKVGIVSGGGSGHEPAHAGFVGPGMLSAAVAGQVFTSPTPDQIYAAIKAVDQGKGVFLVVKNYSGDVMNFDMAKDMAELDDIQVKSIVVDDDIAVKDSLYTQGRRGVAGTIFMHKILGAAADQGVDLDDLESLATHVLPRIKTIAVALSAATVPEVGKPGFELADDEIEFGVGIHSEPGYRREKIKPSKQLVQELLGKLDDELHLQSDHQYAFLVNGMGATPLMDQYVFCHDLLDELATRHIQPAFMKVGNYMTSIDMAGISLTIFDVAESQWLDYLQYPVKTIAWS

SEQ ID NO: 9657 - DNA, 1059 bp, Clostridium tetani
  CDS (1)..(1059)
atgttatataataaatttaagggtttagaggatatactaaagaaaggggtatgtttaagtatgaaaaaaattataaataacgtagattatgctgtagaggatatgctagaaggtatgataaaggcctatcctaataaaattagaaaattagatgctggaaatataatagtaagaaaagatgctccaataaaagataaagtagcacttgtaagtggtggaggaagtggtcacgaacctgctcatggtggatatgtaggaaagggaatgctagatgctgcagtagcaggtgcggtatttacatcaccaacaccagatcaggtttttgaagctgtaaaagcagtagatggcggacgtggcgtattattagttataaaaaactatagcggagacgtaatgaattttgaaatggcaaaggatatggcagaaatggaaggaatacaagtagaagctgttgtagtaaatgatgatgtagctgtagaggatagtacttataccactggtagaaggggaattgcaggtactatttttattcataagatagcgggggctaaagcggagaaaggtgcttcattagaagaagtaaaatctgtagcagaaaaggttatttcaaatgtaaaaagcatgggagtggcgcttacaccctgcactgtaccagcggcagcaaagcctagctttaccttagaagaaaatgaaatggaaataggaataggtatccatggagaaccaggaactcatagggaagaattaaaatccgcagatgaaattacagaacacctagtgaataaaattttagatgatataaaaatagataaaggtgaggaagtagcaattatggtaaatggattaggttctacacctttaatggaattatttattgtaaataagaaagtacatcaaatgttagaggataagggtataaaagtatatgaaacttttgtaggagaatatatgacatcccttgaaatggcaggttgctcagtaactttattaaaattagatggagagctaaaagaattattagatgctaatgcggacactccagctatgaaagtgttataa

SEQ ID NO: 9658 - protein, 352 aa, Clostridium tetani
MLYNKFKGLEDILKKGVCLSMKKIINNVDYAVEDMLEGMIKAYPNKIRKLDAGNIIVRKDAPIKDKVALVSGGGSGHEPAHGGYVGKGMLDAAVAGAVFTSPTPDQVFEAVKAVDGGRGVLLVIKNYSGDVMNFEMAKDMAEMEGIQVEAVVVNDDVAVEDSTYTTGRRGIAGTIFIHKIAGAKAEKGASLEEVKSVAEKVISNVKSMGVALTPCTVPAAAKPSFTLEENEMEIGIGIHGEPGTHREELKSADEITEHLVNKILDDIKIDKGEEVAIMVNGLGSTPLMELFIVNKKVHQMLEDKGIKVYETFVGEYMTSLEMAGCSVTLLKLDGELKELLDANADTPAMKVL

SEQ ID NO: 9659 - DNA, 1017 bp, Bradyrhizobium japonicum
  CDS (1)..(1017)
atgaggccaaagggaagaagcggggaggagacaatgaagaagttcatcaattcggtcgacggcgtgcttgcggagagcctcgacggacttgcggccgcgcatgccgatctcgtcgcgcttgggccggagcggaaattcgtgcggcgccgtgagctgaacccgaagaaggtcgcactcgtctcgggcggcggcagcgggcatgagccgctgcatgcgggcttcgtcggctatggcatgctcgacgccgcctgcccgggacaggtcttcacgtcgccgacgccggaccagatcgtcgaggccgctcaggcggtttcgggtgaggccggcgtgctgttcatcgtgaagaactacgcgggtgaccgcatgaatttcgagatggcggccgagatcgccgaggggctcacggcgaccatcgtcaccgacgatgacgtcgcggtcgagaactcgacccacagcatcgggcgtcgcggcgtggctggcacgctcatcgtggagaagatcgtcggcgcggcagccgagaagggcgccgacctcaagggctgcgttgcgctcggcgagcgcgtcaacgtgcgcacgcgttcgatgggcgtggcgctgacgagctgcacggtcccggctgcgggcacgccgaccttctcgctcggccaggacgagatggagatgggggtcggcattcacggcgagccgggacgccgccgcgtcaagctggagcgggcagacgcgatcgcggacgagatgacgacggcgatcgcgcaggatctcgacgcgcgcgacggggccgaggccctcctgctcgtcaacggatttggcggaacgccaacgatcgagctctatctgatgtacaacgcggcccgccggatgcttgagaagcgcggcttgcgcatcgctcgctcgctggtcggcagcttcgtcacctcgctggacatggccgggtgctcgctcaccgtcagcctgctcgatgctgagacgaccgcgctctgggaccatcccgtgcgcacggcggcattgaaatggtaa

SEQ ID NO: 9660 - protein, 338 aa, Bradyrhizobium japonicum
MRPKGRSGEETMKKFINSVDGVLAESLDGLAAAHADLVALGPERKFVRRRELNPKKVALVSGGGSGHEPLHAGFVGYGMLDAACPGQVFTSPTPDQIVEAAQAVSGEAGVLFIVKNYAGDRMNFEMAAEIAEGLTATIVTDDDVAVENSTHSIGRRGVAGTLIVEKIVGAAAEKGADLKGCVALGERVNVRTRSMGVALTSCTVPAAGTPTFSLGQDEMEMGVGIHGEPGRRRVKLERADAIADEMTTAIAQDLDARDGAEALLLVNGFGGTPTIELYLMYNAARRMLEKRGLRIARSLVGSFVTSLDMAGCSLTVSLLDAETTALWDHPVRTAALKW

SEQ ID NO: 9661 - DNA, 963 bp, Staphylococcus epidermidis
  CDS (1)..(963)
atgaaaaagttaattcaagataaaaacacaattttaaaagatatgcttgatggaattacagtttcaaacaacgatgttgaagttgtatctgacactattgttgttagaaagcataaaaaacaatcaggtgttgcactcgtttctgggggcggcagtggacatgaacctgcacacgcaggatttgtagcagaaggcatgctcgatgcagctgtatgtggagaaatcttcacttcacctacacctgataaaatattagatgccattaaagctgtggacaatggtgacggcgttctacttgttattaaaaactatgcaggagacgttatgaactttgaaatggctcaagaaatggctcaaatggaagatattaaagttgaaagtgttattgtcagagatgatattgctatttctgacccggaaaaacgccgtggtgtagcgggtacagtatttgtgcataaatatgctggatacctagctgaaaaaggtgttgcacttgatgaaatcaaatctaaagttgaggcacttttaccagatattaaaagtattggtatggcattaacgcctccaatggtgcccacaactggtaaaaacggtttcgatattgaagacaatcaaatggaaattggtatcggtattcacggtgaaaaaggtttacatcgtgaagacgtacaacctattaacgtgattgttgaacgtttactcgatcaattatacaaagaaattgagaaaaaacctttaatcgtaatggttaatggtatgggtggtacgccactatcagaattaaatatagttactaaatatctagatgaacaattcaatcagaatgatattgatgttaaacaatggttcgtaggtgactatatgacagcattagacatgcaaggcttctctataactgtactccccttcagtgaagaattgagtgaagctttagctgcacctacagcaagtaaatatttttaa

SEQ ID NO: 9662 - protein, 320 aa, Staphylococcus epidermidis
MKKLIQDKNTILKDMLDGITVSNNDVEVVSDTIVVRKHKKQSGVALVSGGGSGHEPAHAGFVAEGMLDAAVCGEIFTSPTPDKILDAIKAVDNGDGVLLVIKNYAGDVMNFEMAQEMAQMEDIKVESVIVRDDIAISDPEKRRGVAGTVFVHKYAGYLAEKGVALDEIKSKVEALLPDIKSIGMALTPPMVPTTGKNGFDIEDNQMEIGIGIHGEKGLHREDVQPINVIVERLLDQLYKEIEKKPLIVMVNGMGGTPLSELNIVTKYLDEQFNQNDIDVKQWFVGDYMTALDMQGFSITVLPFSEELSEALAAPTASKYF

SEQ ID NO: 9663 - DNA, 1089 bp, Yersinia pestis
  CDS (1)..(1089)
atgctgtcgttgcgcgcgctaaattaccgcggcatccagttaactcacccactgtttttatttattttccattttaacgagattgctatgaatcgaattattaacgatccggatcaggttgtggaagaggcgataaaaggctatttagcggcttatccacatttttttgctaaaaccgcgcatgagaaagtattgaagtatccagagatacccctccaagggaaagtaggcgtagtgaccgggggcggttctggccatgaacccgcgtttctgggctatatcggtaaaaatatgctggatgccgtagcggttggtgagatcttctcctccccggcggctggggcatttttagaagcgtttaaagttgccgacggcggtgcgggtgttgcttgtctgtacggtaattacgccggggacaatatgaacgtcaaaatggcggcaaaaaaagccgaggccatggggataagggttcgcaccgtggttgctaatgatgatgtggcctctgcaccaccgtcggaaagagagaaacgccgaggtgtggcgggtgaaatttttatgtggaaagtgggcgcagcagcggcgtctcaaggctacgctctggataatgtcatagaggttgctcagaaagcgattgatcactgccgttcaatcggcgtgggcttaacctcctgtaccatcccggcggtgggtaaacctaatttctcgatagaagacggcatgatggaagtggggattggtcatcacggagaaccgggtattcgggttgagtcgctacagaatgcacatcagatggcaaagaccatggtggatttggtggtcgctgataggccgtttagccaaggcgatgaggtagcggtgttgatctctgggctcggtgccacgccgaccattgagctgtatatctattatgcagaagtcgccaaattattagaggcgcaggggataacaatatatcgcccttatattggtaattattttacctcgctagacatgatgggggtcacgctgacgctgatgaaactggatgatgaattaaaatctttaattgatgtacccactcattcattaggcttaacccagttggagtaa

SEQ ID NO: 9664 - protein, 362 aa, Yersinia pestis
MLSLRALNYRGIQLTHPLFLFIFHFNEIAMNRIINDPDQVVEEAIKGYLAAYPHFFAKTAHEKVLKYPEIPLQGKVGVVTGGGSGHEPAFLGYIGKNMLDAVAVGEIFSSPAAGAFLEAFKVADGGAGVACLYGNYAGDNMNVKMAAKKAEAMGIRVRTVVANDDVASAPPSEREKRRGVAGEIFMWKVGAAAASQGYALDNVIEVAQKAIDHCRSIGVGLTSCTIPAVGKPNFSIEDGMMEVGIGHHGEPGIRVESLQNAHQMAKTMVDLVVADRPFSQGDEVAVLISGLGATPTIELYIYYAEVAKLLEAQGITIYRPYIGNYFTSLDMMGVTLTLMKLDDELKSLIDVPTHSLGLTQLE

SEQ ID NO: 9665 - DNA, 990 bp, Streptococcus agalactiae
  CDS (1)..(990)
atgaaaaaaattctcaatcaaccaactgatgttgttactgaaatgctagatggattagcatatgttcataatgatttagtacatcgcatagaaggttttgatatcattgctcgcaatgaagagaagtcaggaaaagtggctctcatttctggcggaggaagtggacatgagccttcacatgctggtttcgtaggcgaaggaatgttatctgcagctgtgtgtggtgcagtatttacttctccaactcctgaccaagttcttgaagcaattaaagaagctgatgagggggctggagttttcatggttatcaaaaattattcaggggatatcatgaactttgaaatggcacaagatatggctgaaatggaaggcatagaagttgcaagtgtggtcgttgatgatgatattgcagtcgaagacagtctttacacacaaggaaaacgtggtgtagctggtacgatactcgtccataaaattctaggacatgctgctcgtcatggcaaatcacttcaggaaatcaaagctattgctgatgaattagtaccaaacattcacactgttggacttgcactaagcggggctactgttcctgaagtaggcaagccaggatttgttcttgcagaagatgaaattgaatttggtatcggtattcatggtgaaccaggttatcgtaaagaaaaaatgcaaccttcaaaggctttagcgacagaattagttgataagttaattgaatcgttcgatgctaaatctggcgaaaaatatggtgtccttattaacggtatgggtgcaaccccacttatggaacaatatgtctttgctaacgatgttgccaaactccttgaggataaaggcattgaagtgaattacaaaaaacttggtaactatatgacttcaattgatatggctggtttatcactaaccttgattaaactggaaaatcaagagtggttagaagcacttaatagtgacgttacaaccattgcttggtaa

SEQ ID NO: 9666 - protein, 329 aa, Streptococcus agalactiae
MKKILNQPTDVVTEMLDGLAYVHNDLVHRIEGFDIIARNEEKSGKVALISGGGSGHEPSHAGFVGEGMLSAAVCGAVFTSPTPDQVLEAIKEADEGAGVFMVIKNYSGDIMNFEMAQDMAEMEGIEVASVVVDDDIAVEDSLYTQGKRGVAGTILVHKILGHAARHGKSLQEIKAIADELVPNIHTVGLALSGATVPEVGKPGFVLAEDEIEFGIGIHGEPGYRKEKMQPSKALATELVDKLIESFDAKSGEKYGVLINGMGATPLMEQYVFANDVAKLLEDKGIEVNYKKLGNYMTSIDMAGLSLTLIKLENQEWLEALNSDVTTIAW

SEQ ID NO: 9667 - DNA, 993 bp, Oceanobacillus iheyensis
  CDS (1)..(993)
atgaaaaaaattattaataatcctaatgacgttgtatcagatatggtttctgggatgatacaggcctttccagaagaactagaacaaatagatggaacaatggtaattaaacgtaaggaattatcttcaaataaagtcggtcttgttagtggtggaggaagcggtcacgaaccagcgcatgctggatatgttggaaagggaatgttagatgcagcagttgctggtgaagtatttacttcacctactcctgatcaaatattggaagcaattaaagcagtagatactggtcatggagttttattaattgtaaaaaactatacaggagatgttatgaatttcgatatggctagtgaattggctgagtcagagggaataaaggttgaacaagttattgttaacgatgatgttgcggtagaagatagtgactttactactggtcgaagaggtattgctggtactgtgtttgtacacaaaatcgctggagcaatggctgagacaggtgctactttaaatgaagtgaaggaagttgctgaaaaaacaattaatcaagtcagatcaatggggatggcacttactccatgtacagtacctgctgcaggtaaaccaagttttcaattagaagaaaatgaaatggagattggtatagggatacatggggaagcaggtatagagagaaaaccaatagcatctgctgaagatattgccaatgaactaacgcaaaaagtatttgatgatctgggattacaatcaggtgatgaggttgcagtgatgattaatggattaggtgcaactccagagatggaattatttatattacagaaacatgtaaatcatttgcttgaaaataaacgtttatctgtgtttcgtacgtatgtaggtgagtttatgacatctctagaaatgacaggttgctcggtcactttattgaaattggacgatcaattaaaatctcttttagaagcagctagtgaagctacagcatttcgtgtataa

SEQ ID NO: 9668 - protein, 330 aa, Oceanobacillus iheyensis
MKKIINNPNDVVSDMVSGMIQAFPEELEQIDGTMVIKRKELSSNKVGLVSGGGSGHEPAHAGYVGKGMLDAAVAGEVFTSPTPDQILEAIKAVDTGHGVLLIVKNYTGDVMNFDMASELAESEGIKVEQVIVNDDVAVEDSDFTTGRRGIAGTVFVHKIAGAMAETGATLNEVKEVAEKTINQVRSMGMALTPCTVPAAGKPSFQLEENEMEIGIGIHGEAGIERKPIASAEDIANELTQKVFDDLGLQSGDEVAVMINGLGATPEMELFILQKHVNHLLENKRLSVFRTYVGEFMTSLEMTGCSVTLLKLDDQLKSLLEAASEATAFRV

SEQ ID NO: 9669 - DNA, 996 bp, Mycoplasma penetrans
  CDS (1)..(996)
atgaaaaaattaataaataatccaaatgatatagttagtgaaatggttgatggaattgtatcttcatatccttcatatgttaaaaaactaaatgatttacctgtaattgtgagagcaaataaaaaagtaaataaagttgctttgataagtggtggaggaagtggtcatgaacctgctcatgcaggatatgtaggttatggaatgctagatgcagcagtttgtggagaagtatttacatcaccaagtgcagataaagtatatgaagctattaaagcaactgatgctaataaaggtgtcttgttaattattaaaaattatagtggtgatgtaatgaattttgatatggcaagtgaaatggcatcaaatgaaaatattgaagttaaaaaagtagttgtagatgatgatatagcagttgaaaatagtacttattcaattggaagaagagggattgctggtacaatttttgttcataaaattttaggagcagctgctgaaaaaggatattcattaaatgatttagaaactttgggtaatagacttgttaaaagaattaaaactttaggaatgtctttatattcttgttatgtgccaacaagtggtaaacatagctttcaattaaaagaagatgaaattgaaattggtgttggaattcatggtgaacctggaactcataaagaaaagattaaatcagttaatgaatatgttgatttcattttagataaattattatcagagcttgacaataaagaaaaagaagatgttgctgttttagtaaatggattaggttctacaacattaatggaattattcattattggtaaccgtgtccaatctgttttaaaaaataaaaatgtaaaagtatatgatacaaatgtaggtaactatatgacttctcttgatatggcaggcttttctataactttagtaaaattagataaagaacttaaagaattattagattataaagctgatacaattgcatttaaaaagggttaa

SEQ ID NO: 9670 - protein, 331 aa, Mycoplasma penetrans
MKKLINNPNDIVSEMVDGIVSSYPSYVKKLNDLPVIVRANKKVNKVALISGGGSGHEPAHAGYVGYGMLDAAVCGEVFTSPSADKVYEAIKATDANKGVLLIIKNYSGDVMNFDMASEMASNENIEVKKVVVDDDIAVENSTYSIGRRGIAGTIFVHKILGAAAEKGYSLNDLETLGNRLVKRIKTLGMSLYSCYVPTSGKHSFQLKEDEIEIGVGIHGEPGTHKEKIKSVNEYVDFILDKLLSELDNKEKEDVAVLVNGLGSTTLMELFIIGNRVQSVLKNKNVKVYDTNVGNYMTSLDMAGFSITLVKLDKELKELLDYKADTIAFKKG

SEQ ID NO: 9671 - DNA, 1728 bp, Oryza sativa
  CDS (1)..(1728)
atggcgttgcaggggaagaagctcatcaatgacccgaacgatgtggtgacggagttcatcgaggggctggtggagacgtacccgggcctgcagtacttggacgggttccctcagattaaggttgttcttcgtgctgatgtcgtacagggcgcctatgataaggtcgcggttatctcaggtggtggaagtggccatgagccaacccatgctggatttgttgggccaggaatgttgacagctgccgtttctggagatgttttcacttctccgcccgttgattctattttagctgctattcgagctgtaactggtcccatggggtgccttctaatagtaaagaactacactggtgatagactcaattttggactagctgctgagcaggcaaaatctgaaggctataagatggagatggttattgttggagacgattgtgccctccctccacctcgaggaatagctggtagaagaggtttagcagggactatccttgtgcacaaggttgctggggctgctgcagatgctggcttatctcttgcagaagttgctgcagaagcaaaacatgcatctgaggttgttggtacaatgggagttgcactttctgtttgcacattgcctggtcaggtgacatctgatcgcttgggtcctaagcaaatggagcttggccttggaattcatggagaacctggtgttgctgttgttgagctccagcccattgatgtagtagtagaacatgttcttaagcagatattgtcacagttgccttacactgtagtattacctgatcgtttgatcccatctttgaaatgcagattgggtgcaactcctatcatggaacttatgattgcagcaagaaaagcagttcctgaattacaattggagtatgggattgctgttgacagagtctacactggcacacttatgacttcacttgatatggctgggttctctatcactattatgagatcagatgaaaacattttgcagcgacttgatgctccaactaaagctccggcttggcctgttggatctgaaggaaatcgtccaccagcaaaaattcctgttccagtaccaccatcaccatcagggaaggatgatgagattctcactgaacctcaggagttaagcaagcaagggtgtattctggaggctgctattgaagcaggggctaaagaaattatcaatatcaaggataacttaaatgaatgggatagtaaagtgggtgatggtgactgtggaaccacgatgtatagaggtgcaacaactattcttgaagatctgaagaagcgctacccaatgaatgatgcagctggaacaattaatgagattgggtcaacagtccggagagtgatgggtggaacaagtggaatcttgtatgacatactttgcaaagctgcatatgcaagcttaaaacagaacacaagtattggtgcaaatgaatgggctgatgctttggaggcctctgttgctgcgtttgatgaactcatcgtgcttaaacagtctctcaaagccggggacgatcctgtgactgcctttatcgcgtcttctgaagcagcatcagctggtgctgaatccactaaacagatgcaagcgaaggcaggacggtcgtcatacattgcacccgacctggtggcatcagttcctgatccaggagcagttgctgcagcagcatggtaccgtgcggcggctcatgcagtgaagagtaagctgcacgcctcggatagctag

SEQ ID NO: 9672 - protein, 575 aa, Oryza sativa
MALQGKKLINDPNDVVTEFIEGLVETYPGLQYLDGFPQIKVVLRADVVQGAYDKVAVISGGGSGHEPTHAGFVGPGMLTAAVSGDVFTSPPVDSILAAIRAVTGPMGCLLIVKNYTGDRLNFGLAAEQAKSEGYKMEMVIVGDDCALPPPRGIAGRRGLAGTILVHKVAGAAADAGLSLAEVAAEAKHASEVVGTMGVALSVCTLPGQVTSDRLGPKQMELGLGIHGEPGVAVVELQPIDVVVEHVLKQILSQLPYTVVLPDRLIPSLKCRLGATPIMELMIAARKAVPELQLEYGIAVDRVYTGTLMTSLDMAGFSITIMRSDENILQRLDAPTKAPAWPVGSEGNRPPAKIPVPVPPSPSGKDDEILTEPQELSKQGCILEAAIEAGAKEIINIKDNLNEWDSKVGDGDCGTTMYRGATTILEDLKKRYPMNDAAGTINEIGSTVRRVMGGTSGILYDILCKAAYASLKQNTSIGANEWADALEASVAAFDELIVLKQSLKAGDDPVTAFIASSEAASAGAESTKQMQAKAGRSSYIAPDLVASVPDPGAVAAAAWYRAAAHAVKSKLHASDS

SEQ ID NO: 9673 - DNA, 990 bp, Streptococcus pyogenes
  CDS (1)..(990)
atggtaaccatattaaatcaaacacaaacacttatttcccaatatatagcaagtgtattagcagcccatccccacctagtccaattacaggatttgcctattatttataataggcatctcgatgatcaactcatcccaattctatccggaggaggatccggacacgaacctgctcattccggcttcgttggtgatggtatgctgtcagctgccatctatggcgatatttttactcccccaactgccacagacatcttagaagccctgcgatttctagataaaggtaagggggtctttgtcattatcaaaaactttgaagccgacattcgtgaatttagccaagccattcatctagcacgacaagaaggtcgtaacatcaaatatattatttcccacgacgatatctcggttgaacctaaaaagcaattccaaatgcgccaccgaggactcgctggaactatattgcttcacaaaatcttaggagcagctgcacaaagtggggcaagtttggatgaccttgaacacctagcttttgaccttgccacagagattgctaccatcggatttgcaaccaaatctgctagcctacccaatgcggcactacctctttttgacttgcctgatcatcagatttcatatgggattggtattcatggtgaagaaggctatcgcacggtcccatttatgtcatcagagcatcttgctgtggaaattgttaataagcttcaaattaaattccattggcaagaagacgaacattttattcttctagttaataatttaggaacagcaaccgacttggaacaaggcatttttctgaatgatatccatcaacttttagatcttgaagggcttcatcttccttttatcaaaaacggaaaattcatgactagccttgacatgactggtatctctgttaccctttgtcgtcttaaagatagacagtggctagactacttacaagctccaaccaatgcctacgcttggtaa

SEQ ID NO: 9674 - protein, 329 aa, Streptococcus pyogenes
MVTILNQTQTLISQYIASVLAAHPHLVQLQDLPIIYNRHLDDQLIPILSGGGSGHEPAHSGFVGDGMLSAAIYGDIFTPPTATDILEALRFLDKGKGVFVIIKNFEADIREFSQAIHLARQEGRNIKYIISHDDISVEPKKQFQMRHRGLAGTILLHKILGAAAQSGASLDDLEHLAFDLATEIATIGFATKSASLPNAALPLFDLPDHQISYGIGIHGEEGYRTVPFMSSEHLAVEIVNKLQIKFHWQEDEHFILLVNNLGTATDLEQGIFLNDIHQLLDLEGLHLPFIKNGKFMTSLDMTGISVTLCRLKDRQWLDYLQAPTNAYAW

SEQ ID NO: 9675 - DNA, 999 bp, Thermoanaerobacter tengcongensis
  CDS (1)..(999)
atgaaaaagttaattaacaaccctgagagcgttgtaaaggagatgattgaggggcttttggcagctcatcccaattatctcagaaagcttgagaatatcaatgtgattgtgagaaaagatgcgccagttgaaggtaaagtaggacttgtcagtggtggaggaagtggacacgaacctgcccacgcaggatacgtgggttacggaatgcttgacgctgcttgccctggagaagtctttacttcaccgacacctgaccagatgtatgaggctattaaggctgtaaactctgggaagggcgtgctgcttatcattaaaaattacacgggagacgtaatgaattttgaaatggcaagagaaatggcgcaagcagagggaatagaggtggaccaggttatagtaaacgatgatgtggcagtggaaaacagcacttggacgcaaggcagacgcggtatagcaggaactgtttttgtccataagattgccggagcaaaagctcaagagggagctagccttaaggaggtaaagagggtagctgaaaaagtcatagcgaatgtccgttcgatgggaatggcgttaacaccttgtactgtgcctgcagcgggtaagccaagttttactcttcaagaagatgagatggagattggaataggcatacacggagagcctggtacgcacagagagaagataaaacacgttgatgaaatagtggagcatttaatggacaaaataataaatgaccttccttataaatcaggcgatgaagtggctgtaatgataaatggaatgggtggaactcctctgatggagctttatatcgctaacagaaaagtcgcagaaattctaaaagaaaaggatataaaagtttacaagacttatgtgggagaatttatgacttctcttgagatgagcggcttttctataactttgttaaagctggatgaggagttaaaggcattgttggatgcaaaggctgatacgccagcatttaaacaactataa

SEQ ID NO: 9676 - protein, 332 aa, Thermoanaerobacter tengcongensis
MKKLINNPESVVKEMIEGLLAAHPNYLRKLENINVIVRKDAPVEGKVGLVSGGGSGHEPAHAGYVGYGMLDAACPGEVFTSPTPDQMYEAIKAVNSGKGVLLIIKNYTGDVMNFEMAREMAQAEGIEVDQVIVNDDVAVENSTWTQGRRGIAGTVFVHKIAGAKAQEGASLKEVKRVAEKVIANVRSMGMALTPCTVPAAGKPSFTLQEDEMEIGIGIHGEPGTHREKIKHVDEIVEHLMDKIINDLPYKSGDEVAVMINGMGGTPLMELYIANRKVAEILKEKDIKVYKTYVGEFMTSLEMSGFSITLLKLDEELKALLDAKADTPAFKQL

SEQ ID NO: 9677 - DNA, 999 bp, Fusobacterium nucleatum
  CDS (1)..(999)
atggaggtatatatgaaaaaactcataaatgataaaaataatattgtagaagaagttgtacaaggaatgataaaagcttttcccaataaagtttcaagagtggaaaatgagcctataattataagaaaaaataaaaaagttaataaggttgctttaattagtggaggaggaagtggacatgaacctgcacatgctggctatgttggttatggaatgttagatgcagcagtatgtggagaaatttttacttctcctggagctgataaagtttatagtgctataaaagctgttgatgcaggaaaaggtgttcttcttataataaaaaattatagtggagatgtaatgaattttgaaatggcaggcgaaatggctcaagcagaaggaataactgtaaagcaagttgtggttgacgatgatattgcagttgaaaatagtacctatactgttggtagaagaggaatagcaggaactatttttgttcataaaattttaggtgctgctgctgaaaaaggttatgatttagataaattagttgaacttggaaataaagttgttaaaaatttaaaaactatgggtatgtctttaaaaccttgtacagtttttacaactggtaaagaaagttttgaaatagctgatgatgaggttgaaattggtttaggaatacatggagagcctggaactcatagagaaaaaatgacaacagctaatgaatttactaaaaaattatttgaaaaaatttatgctgaatctaatgttcaaaatggagatagatttgcagttttagtaaacgggcttggagaaacaactttaattgaattatttattataaataatcatctacaagatttactaaaagataaaagaatagaggttgctaaaactttggttggtaactatatgacttcacttgatatgggaggattctctataagtttattaaaattagataaggaaatggaagaacttttaaatgcagaggaagacacaatagcattttaa

SEQ ID NO: 9678 - protein, 332 aa, Fusobacterium nucleatum
MEVYMKKLINDKNNIVEEVVQGMIKAFPNKVSRVENEPIIIRKNKKVNKVALISGGGSGHEPAHAGYVGYGMLDAAVCGEIFTSPGADKVYSAIKAVDAGKGVLLIIKNYSGDVMNFEMAGEMAQAEGITVKQVVVDDDIAVENSTYTVGRRGIAGTIFVHKILGAAAEKGYDLDKLVELGNKVVKNLKTMGMSLKPCTVFTTGKESFEIADDEVEIGLGIHGEPGTHREKMTTANEFTKKLFEKIYAESNVQNGDRFAVLVNGLGETTLIELFIINNHLQDLLKDKRIEVAKTLVGNYMTSLDMGGFSISLLKLDKEMEELLNAEEDTIAF

SEQ ID NO: 9679 - DNA, 2350 bp, Mus musculus
  CDS (89)..(1825)
cttcagacctggtagcagtcaggaccgtccacccggcggcatctcagagcagaagtgtgagctcagcttgtttcagaactttcccaccatgagttccaagaagatggtgaattctgtggaagggtgtgctgatgatgcccttgctgggttagtagcctctaaccctgacttgcagctcctgcaagggcaccgtgtggccctacgttctgacctggacaccctcaagggccgggtagcacttctgtcaggtggaggctcaggccatgagcctgcccatgccggttttatcgggaaagggatgctaacaggtgtcatcgcaggatctgtgtttgcctctcctcctgtgggcagcatcctggcagccattagagctgtggcccaggcaggcacagtgggcaccctcctcattgtgaagaactacactggggatcggctcaactttggacttgccatggagcaggccaaggccgagggcatctctgtggagatggtgatagttgaggatgacagtgccttcaccgtcctcaagaaggcaggccggcgtggcctgtgtggcacagtacttatccacaaggtggcaggtgctctggctgaggaaggaatggggctggaggagatcacaaagagggtgagcgtgatcgccaagaccatgggtaccctaggggtgagcttgtcatcctgcagtgtccctggcgccacacacacctttgagcttgcagctgatgaaatagagctaggcctggggatccatggggaagctggtgttcgtcggataaagatagcacctgttgatcagattgtcactcttatgcttgaccacatgacaaacacctccaatatatttcatgtgcctgtacggtcaggctcttcagtggtgctgatagtcaacaatctgggtggcctgtctttcctggaactgggcatcatagctgatgctgccatacgcttgctggagggccgtggagtgaaggtcgcccgtgccctggtgggcaccttcatgtcagcgctggagatgcctggtgtgtctcttactttgatgcttgtggatgaacccgtgctgaagctaatagatgctgaaactactgcaaaagcctggcctcacatggccaaggtctctgtgactgggaggaagcggattcgggcagctcccacagagcctccagaagcccctgaagccactgcagcaggaggtgtaacatcaaagcagatggcacttgtgctggatcggatatgcaccaccctcatcggactggaggagcacctgaatgccttggacagggctgctggtgatggggattgtggttctacccatagccgtgctgccaaagccattcagggctggctaaaggaaggcccatctctaaccagccctgcccaggtactctccagattgtctgtcctgctgctggagaggatgggaggctcatctggggcgctctatggcctgttcctgactgcagctgcccagcctctcaaggccaagactgacctcccaacctggtctgctgccatggatgccggcttagagtccatgcagaagtatggaaaggctgcaccaggagacaggacaatgctggattctctgtgggcagcagcacaggagttccaagcctggaagagcccaggggccagtctcctcccagtcctgactaaagcagtcaagagtgctgaagctgcagccgaggccaccaagaatatggaagctggtgctgggagagctagttatatcagctctgcacaactagatcagccagaccctggagcagtcgcagctgctgccatcttccgtgccatcctggaggtcttgcagacgcagggagcatgactgcttttctcctcctcagctcatttgttactttgtcttgccttcagatggtcacctccctccctccctccttccctcccccttcccccaccctccccctaacacccaacctctgcatggaacaggacatccttcaccacaccttcagaactgttccatgaagatcgtatctggctaggtgggtcacatgtccgggcagcactgttcttcccctcctcaggatgaggagtccctcagatcttatccaccccagtctctaactgggtatacccatttcgtttcaagatttcaggcctcagcctggcagtggtggcgcacgcctttaatcccagcacttgggaggcaaaaagattctaggcctcttcctctggaaggcctcctatacccagtcagtatacgaaagaaagttaataaaatccattgaagccataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9680 - protein, 578 aa, Mus musculus
MSSKKMVNSVEGCADDALAGLVASNPDLQLLQGHRVALRSDLDTLKGRVALLSGGGSGHEPAHAGFIGKGMLTGVIAGSVFASPPVGSILAAIRAVAQAGTVGTLLIVKNYTGDRLNFGLAMEQAKAEGISVEMVIVEDDSAFTVLKKAGRRGLCGTVLIHKVAGALAEEGMGLEEITKRVSVIAKTMGTLGVSLSSCSVPGATHTFELAADEIELGLGIHGEAGVRRIKIAPVDQIVTLMLDHMTNTSNIFHVPVRSGSSVVLIVNNLGGLSFLELGIIADAAIRLLEGRGVKVARALVGTFMSALEMPGVSLTLMLVDEPVLKLIDAETTAKAWPHMAKVSVTGRKRIRAAPTEPPEAPEATAAGGVTSKQMALVLDRICTTLIGLEEHLNALDRAAGDGDCGSTHSRAAKAIQGWLKEGPSLTSPAQVLSRLSVLLLERMGGSSGALYGLFLTAAAQPLKAKTDLPTWSAAMDAGLESMQKYGKAAPGDRTMLDSLWAAAQEFQAWKSPGASLLPVLTKAVKSAEAAAEATKNMEAGAGRASYISSAQLDQPDPGAVAAAAIFRAILEVLQTQGA

SEQ ID NO: 9681 - DNA, 1071 bp, Escherichia coli
  CDS (1)..(1071)
atgactatgaagaaattaattaaccagattgattctgttgtcacagaacaaatggaaggactcatcgccacctggccacacctgcaggcaaattacgcaccccgatatgtgtggtgcaaacaaaccgataatgcagtggcgctgatttcaggcggcggctcaggccatgaaccactgcatgcaggttttgtcggtatgggaatgttaaccggtgcatgtcctggtgaaatcttcacatcgcccacaccagaccaaatgatcgaatgtgccaaagcggttgataatggttctggcgttctgtttttcatcaaaaattacactggcgatattctgaatttcgaaacggcagtcgagatgttacacgaagaaggcatcgccgttgggaccgtcattattgatgatgatgtagcggtaaaagatagcctgtatacagccggacgtcgcggtgttgcgggtacagtttttgttgaaaagattgtcggtgcggctgcacttcagggatataacctggggcagtgcgagcaacttggcaaagatgttaacaatgccacccgttcttttggcatcgcactgtcagcctgtacggttcccgccgcgggaaaaccctcatttgaactggctgataatgaaatcgaatttggtgtcgggatccacggtgaacccggcattgaacgccgcactttgcaagatctgaacactttaatcgacagcgtgatagcgcaattactggataataccccctggcgacgcacattacgccattgggatcgccatgcggggggatggattgacgcatcatcaatgaatgagtcattcgatcaaaatgccgaatatattgtgttaattaacggacttggcagcacgcctgaatcagagttatatggtgtagccagggtatttatgtgcgccgcacagcgccagggaattaaaattagccgccagttggtcggtaattattgtacatcattagatatggccggattttccattagcctgctgaaatgtaccccagagtttttgcaactttgggatgccccggtcaatacgccagcgcttcgttggggatgttaa

SEQ ID NO: 9682 - protein, 356 aa, Escherichia coli
MTMKKLINQIDSVVTEQMEGLIATWPHLQANYAPRYVWCKQTDNAVALISGGGSGHEPLHAGFVGMGMLTGACPGEIFTSPTPDQMIECAKAVDNGSGVLFFIKNYTGDILNFETAVEMLHEEGIAVGTVIIDDDVAVKDSLYTAGRRGVAGTVFVEKIVGAAALQGYNLGQCEQLGKDVNNATRSFGIALSACTVPAAGKPSFELADNEIEFGVGIHGEPGIERRTLQDLNTLIDSVIAQLLDNTPWRRTLRHWDRHAGGWIDASSMNESFDQNAEYIVLINGLGSTPESELYGVARVFMCAAQRQGIKISRQLVGNYCTSLDMAGFSISLLKCTPEFLQLWDAPVNTPALRWGC

SEQ ID NO: 9683 - DNA, 1749 bp, Clostridium perfringens
  CDS (1)..(1749)
atgaagaaaataatgaattcagcagaaacactagtaagagaaatgtgtaacggaatggttatggcacacccagagttagaatttttaaacaagtataaggttgttaaaaagaaagatattaatgaagataaggtaacacttataagtggtggtggaagtggtcatgaaccagcacatgcagggtttataggaaaaggtatgttagatgtagctgtatgtggagatgtatttgcttcaccttcacaaatacaaatttatcaagcgataaaagcatctaagagcaataaaggtacacttcttataatcaagaattatagtggtgatatgatgaactttaaaaatgcagctcaccttgctacagaagatggaataaaagttgattacataaaggttgatgatgacatagctgttgaagatagtctttatactgtaggacgtagaggggttgcagggactgttttagtacataaaatagcaggagcagctgctgaaagaggaaatagcttagaagaagttaaaagaatagctaagaaagctgctagcagtgtaaaaagtataggatttgctttcacatcttgtactgttccagctaaaggaactccaacatttgaattaggtgaagatgaaatggaatatggagttggaatacatggagagcctggaattcgtagagaaaaaatagctacagcagatgaattagctgaaagaatggttaatcaacttataaatgaattagattataaagatgaagaattagttgtacttgtaaatggatttggagctactcctcttcaagagttatatttattaaacaactcagtatttagagaattacataaaagaggaattaaggtttgtaaaaacttcgttggcaactatatgacaagtatagatatggctggagcttcattatcaataatgaaacttgatgacgagttaaaagagttaatgaaagatgagtgtgatactctagcatttaaagttagtaatcatatggatatgaatgaatatgaagaagtagtaattgaagaaaaagaaattccagtatcatataaagttgaaacttgtgaatcattcaaagaaataaagaacgaaaagatttcacttgagaatatgatttacatattagataaaatgagtgaagtaataattgataatgaagtacctttctgtgaattagactctcatgcaggtgatggagactttggaatgagtgttgccaaaggatttagaatacttaaaagagagtggaaagatatattagaaatagaaaatttaaatatatcagagttcttaaatgcttgttcattagttataatggagcactgtggtggagcatcaggtccaatatggggatcagctttcagagcagcaagcaaaaatgttataaacaaagatgaattaacagttaaagattttgcagaaatgatgcaagaagcagtattaggaattcaaaaaactggagagcgttcatttggaagaggagctgtagttggtgataaaacattaatagatgctttagtaccttgtgcagattcttggacaaacagtgctgaagaaggattaagtttcaaagaagcatttaaaaatggtgcagaagcagcagttttaggagctaagaaaacagaagaaatagtagctcgtatgggtagagctggtacagtaggtgaaagaagtattggttatccagatgcaggagcatatggtttaggtgtaatcttcactgaaatatcaaatgatattaaataa

SEQ ID NO: 9684 - protein, 582 aa, Clostridium perfringens
MKKIMNSAETLVREMCNGMVMAHPELEFLNKYKVVKKKDINEDKVTLISGGGSGHEPAHAGFIGKGMLDVAVCGDVFASPSQIQIYQAIKASKSNKGTLLIIKNYSGDMMNFKNAAHLATEDGIKVDYIKVDDDIAVEDSLYTVGRRGVAGTVLVHKIAGAAAERGNSLEEVKRIAKKAASSVKSIGFAFTSCTVPAKGTPTFELGEDEMEYGVGIHGEPGIRREKIATADELAERMVNQLINELDYKDEELVVLVNGFGATPLQELYLLNNSVFRELHKRGIKVCKNFVGNYMTSIDMAGASLSIMKLDDELKELMKDECDTLAFKVSNHMDMNEYEEVVIEEKEIPVSYKVETCESFKEIKNEKISLENMIYILDKMSEVIIDNEVPFCELDSHAGDGDFGMSVAKGFRILKREWKDILEIENLNISEFLNACSLVIMEHCGGASGPIWGSAFRAASKNVINKDELTVKDFAEMMQEAVLGIQKTGERSFGRGAVVGDKTLIDALVPCADSWTNSAEEGLSFKEAFKNGAEAAVLGAKKTEEIVARMGRAGTVGERSIGYPDAGAYGLGVIFTEISNDIK

SEQ ID NO: 9685 - DNA, 990 bp, Selenomonas ruminantium subsp
  CDS (1)..(990)
atgaagaagctgatcaatgatgtagagtccgtagaggagcagatgattcttggtctggtaaaatccgctccgcataaactgcggaagctggacgaaggcaacatcgttgttcgtgtacagaaaaaagagggaaaggtcgcgctgatcagtgggggcggcagcggccacgaaccggcccatgccggcttcgtcggagagggcatgctggattgtgcggtagccggcccggtattcacctcgcccacaccggataagattttagcgggtatagagaacgttcatgcaggcaaaggcgtgctctgtatcgtcaaaaactacagcggcgatgtgatgaattttgaaatggctgtcgatatggcaggcgatgaggacatcgaagccgattatgtggtggtcaacgatgatgtagcggtaaaagacagtctctacactacaggccgccgtggcgtagccggtacggttttggtgcataagattgctggtgccaaggctgaacagggggcagatttagctgaggtcaaggctgtggcagaaaaagttattgccaatgtccgaaccatggggatggcactttcgccctgtacggttccggcagcgggcaaaccgggctttgtactggcggatgatgaagtcgaaataggcattggcattcatggagagccgggcatcacgagagagaaaatcagcacagcagatgaaaccgcgaagaaacttttagatacgattctgacggatttggatttcaaggggcaggaagtggtgctcatcgttaatggtatgggggcaaccccgctgatggaactttatatcatcaataactttgtgcaggactatctcaaggaacaggggataaaggtctacgataccatggtaggcaattttatgacctctattgagatggcaggtttttccctgactctgctgcgccttgatgatgaattgaaggcactctacgatgccaaagcagatacgccggcatggaaacgctga

SEQ ID NO: 9686 - protein, 329 aa, Selenomonas ruminantium subsp
MKKLINDVESVEEQMILGLVKSAPHKLRKLDEGNIVVRVQKKEGKVALISGGGSGHEPAHAGFVGEGMLDCAVAGPVFTSPTPDKILAGIENVHAGKGVLCIVKNYSGDVMNFEMAVDMAGDEDIEADYVVVNDDVAVKDSLYTTGRRGVAGTVLVHKIAGAKAEQGADLAEVKAVAEKVIANVRTMGMALSPCTVPAAGKPGFVLADDEVEIGIGIHGEPGITREKISTADETAKKLLDTILTDLDFKGQEVVLIVNGMGATPLMELYIINNFVQDYLKEQGIKVYDTMVGNFMTSIEMAGFSLTLLRLDDELKALYDAKADTPAWKR

SEQ ID NO: 9687 - DNA, 999 bp, Rhizobium loti
  CDS (1)..(999)
atgaagaagctgatcaacagtcctgagaaatatgtggatgaagcgctggcggggatgagtttggcgcaccagggtgcctacaagatttccggcagcaacggccgtgtcattgaacgggccaagaaaaaggcttggggcaaggttggagttgtttccggcggtggctttgggcacttgccgctgtttgccggatatgtcggagaaggactgctggatgcctgcgcagtcgggcatgtgttcgccggcccgtcctacgacgacatatccgaggccttgaacgcggctgaccacggcggtggcgttctatcggtcattgccaattatggcggcgacaccatggtgtttggcatggtcaatgacacgttgatcgctgagggcaaggactgcgccaccgtaattgtggccgatgacgttgcaagtgcagacaaggatcgagccgacacgcgtcgcggcgtggctgggatcatcttcgcattcaaagttgctggagccgcagcggaaaggggactcagcctacatgaggtgaaagctgtgactgaaaaggccatggctggttgccggtccataggggttgcactatcggcctgcacagtaccccaggcgggcgagccgacctttcatctcgaagaagatgccattgaaatgggcatgggcattcacggtgagaaaggattgtggcgcgggtcgcttaaacccgctgacgaaattgccgcagagatggtcgaacgcttgttggctgacctcaaacccgcacaggggtctagcgtggcggttctggtcaacggcctgggtgcaacaccgctggaagaactctacattctgtaccgcaaagtggcccacctgatcgaggcagcgggtctgaagatcgcctactcacttgctggtgaatacgcgacttcaatggaaatggcgggcgcctcggtgagcgttatgcaggtcgacgatgaattgctcggtctgttgaatgcccctgcccaatgtcccctgtggagagcgtga

SEQ ID NO: 9688 - protein, 332 aa, Rhizobium loti
MKKLINSPEKYVDEALAGMSLAHQGAYKISGSNGRVIERAKKKAWGKVGVVSGGGFGHLPLFAGYVGEGLLDACAVGHVFAGPSYDDISEALNAADHGGGVLSVIANYGGDTMVFGMVNDTLIAEGKDCATVIVADDVASADKDRADTRRGVAGIIFAFKVAGAAAERGLSLHEVKAVTEKAMAGCRSIGVALSACTVPQAGEPTFHLEEDAIEMGMGIHGEKGLWRGSLKPADEIAAEMVERLLADLKPAQGSSVAVLVNGLGATPLEELYILYRKVAHLIEAAGLKIAYSLAGEYATSMEMAGASVSVMQVDDELLGLLNAPAQCPLWRA

SEQ ID NO: 9689 - DNA, 1014 bp, Rhizobium loti
  CDS (1)..(1014)
atgccggtgcagaccaagaagatcatcaatgacggcaaccgcgccgtcgacgaaatgctcgaagggatcctcgccgcgcatcctcgccacctcaggagcgcggacggcagcccgcgctcgatcatcgcccgtgacgggccgcggcccggcaaggtcgggctggtgatcggcggcggctcaggtcatgagccgaccttcctcggctttgtcggcaagggactggcggatgcggcggccatcggcaacgtcttcgcctcgccgccgcccgatccgatcctcgaatgcgccaaggcagtcagcggcggcgccggcgtcttgttcatgtacggcaactatgccggcgacgtgatgaatttcgacatggcggccgagatggcagcgatggacgacatcgaggtgcgcaccgtcctgaccaccgacgacgtcgcctcggcgctgcgcgaccagcggcagaagcgccgcggcgtcgccggcaatttcttcatcttcaaggcggccggtgccgcctgcgaccggatgctctcgctggacgaggtcgagcgcatcgcccggaaggccaacgaccacaccttcaccatgggcgtggcgctgtcgccctgctcgctgccgcagacaaggcggccgaatttcgagatcggcgcgggcgagatggagatcggcatgggcatccatggcgaacccggcatcgcccgcggcaagctcgggagcgccgacgcgatcaccgacgagatgctggacaagatcctcgccgagatggcgccgacgcgcggcgacaaggtcgcggtgctggtcaactcgctcggctcgacgccgctgatggagctctacatcatgaaccggcgggtcaagcagcggctcgacgacatcggcgtcaccatccacgcgacctgggtcggcaattactgcacgtcgttggaaatggccggcgcctcggtgacgctgtttcatctcgacgaggaattgcagaccatgctcgaccatccctgcgactgcgccatgttccgtgccggctga

SEQ ID NO: 9690 - protein, 337 aa, Rhizobium loti
MPVQTKKIINDGNRAVDEMLEGILAAHPRHLRSADGSPRSIIARDGPRPGKVGLVIGGGSGHEPTFLGFVGKGLADAAAIGNVFASPPPDPILECAKAVSGGAGVLFMYGNYAGDVMNFDMAAEMAAMDDIEVRTVLTTDDVASALRDQRQKRRGVAGNFFIFKAAGAACDRMLSLDEVERIARKANDHTFTMGVALSPCSLPQTRRPNFEIGAGEMEIGMGIHGEPGIARGKLGSADAITDEMLDKILAEMAPTRGDKVAVLVNSLGSTPLMELYIMNRRVKQRLDDIGVTIHATWVGNYCTSLEMAGASVTLFHLDEELQTMLDHPCDCAMFRAG

SEQ ID NO: 9691 - DNA, 1644 bp, Rhizobium loti
  CDS (1)..(1644)
atgaagcactttttcaaccgcagggaaacgatcgtcaccgaggcgctggacggcctgttgcgcaccatcggctcaggcgatctcgcgcgcctcgacggctatcccgagatcaaggtcgtgctgcgcgccgactgggacaagtcgagggtcagcgtcgtttccggcggcggcgccgggcatgagccttcgcatgccggctttgtcggcaagggcatgctgacggcggcggtctcgggcgagatcttcgcctcgccgagcgtcgaagcggtgctcgctgccatccgcgcggtcaccggcccggccggctgtctgcttatcgtcaagaactacaccggcgaccggctcaatttcggcctagcggcggaaaaggcgcgcgccgagggctttcgcgtcgagatggtgatcgttgccgacgacatcgcgctgcccgatatcgcccagccgcgcggcgtcgccggtaccctgttcgtgcacaagatttccggccatctgtcggaggccggccacaatctggctgatatcgcggcggcggcacgggcggcggcaaaggatatcgtttcgctcggcatgtcgctgtcctcctgttccatccccggccagccgcatgaagacaggtttggcgcggacgacggcgaacttggccttggcattcatggcgagccgggcgtcgagcggattgccttgcaaagcgtcgacaggctggtcgcgatcatggcggagcgcctcgcagcagggctcgacccgaaggcgagccatgccttgctgatcaacaatctcggcgcggtgccgcccctcgaaatgtcgctgattgccaatgcggtgctagcctcgccactggccaagactgtcaagctgacgatcggccccggcccgctgatgacggcgctcaacatgaacggcttctcgttgtcgctgatccggctcgatgcggcgcgcgaagcagccctgctggcgccggtcggcccgcatgcctggatgccggccaagccggtcgcggcacctgtcatcgtgccgatggcgaaggcagccggacaaagtgttgcgcacaaggccagccaggatgccagcagcaggcgcctgatcgtcacggtctgcgaaaaattgatctcgctcgaagcgtcattgaacgggctcgacgccaaggcgggcgacggcgacaccggctcgacggtggcgaccggcgcgcgcagcatcctggaacggctcgacgtcctgccgctggcgaaccctgcggcgacgcttggcgcaatcggcgacatattgagttcgtcgatgggcggctcgagcggggtgctgctgtcgatcttcttcacggcggcggcacaggtcctcggtggcggcgccagtctgtccaaggcactgcttgccgggctcgagcggatgactttctacggcggcgccaaaccgggtgatcgcaccatggtcgatgcgctggagcccgcgctaaaagcgctcgacgccgatggcctggaggaggcagcggccgccgcccagcgcggggccgaggcgacagccgccatggaaaaggcgaaggccggacggtcggcctatgtcggcaccaaattgcaaggcgtggtcgaccccggcgcccatgcggtggccgaggtgttttcggccgccgccacgctgctcgtcacggcctga

SEQ ID NO: 9692 - protein, 547 aa, Rhizobium loti
MKHFFNRRETIVTEALDGLLRTIGSGDLARLDGYPEIKVVLRADWDKSRVSVVSGGGAGHEPSHAGFVGKGMLTAAVSGEIFASPSVEAVLAAIRAVTGPAGCLLIVKNYTGDRLNFGLAAEKARAEGFRVEMVIVADDIALPDIAQPRGVAGTLFVHKISGHLSEAGHNLADIAAAARAAAKDIVSLGMSLSSCSIPGQPHEDRFGADDGELGLGIHGEPGVERIALQSVDRLVAIMAERLAAGLDPKASHALLINNLGAVPPLEMSLIANAVLASPLAKTVKLTIGPGPLMTALNMNGFSLSLIRLDAAREAALLAPVGPHAWMPAKPVAAPVIVPMAKAAGQSVAHKASQDASSRRLIVTVCEKLISLEASLNGLDAKAGDGDTGSTVATGARSILERLDVLPLANPAATLGAIGDILSSSMGGSSGVLLSIFFTAAAQVLGGGASLSKALLAGLERMTFYGGAKPGDRTMVDALEPALKALDADGLEEAAAAAQRGAEATAAMEKAKAGRSAYVGTKLQGVVDPGAHAVAEVFSAAATLLVTA

SEQ ID NO: 9693 - DNA, 987 bp, Rhizobium loti
  CDS (1)..(987)
atgaagaaatttatgaacgcggtggacacggtgctgaccgagagcctcgacggtttcgtggctgcccatgccgatatcctcgcgcttggcgaagaacacaaattcgtccgccgcagggcgttgcggccgggcaaggtggcgctgatctccggcggcggctcgggccacgagccgctgcatgccggctttgtcggccatggcatgctggacgccgcctgccccggccaggtgttcacctcgccgacgccggaccagatgctggcggcgacgcaggccgtcgacagcggcgccggctgcctgttcatcgtcaagaattacgagggcgatgtgatgaatttcgacatggcggccgaaatgtctgacggcgttctacgggtggtgaccaatgacgatgtcgccgtcgagaattcgtcctatacgaccggccgtcgcggcgtcgccggcacgctggtggtggaaaagatcgtcggcgcggcggccgagcatggcctggcgctgccggtgctgaaggcgctgggcgagcgcgtcaacgccgccacccgctcgatgggcgtggcgctgaccagcggcaccgtgccggcggcaggcaagccgaccttcgatatcggcgacggcgagatggaattcggcgtcggcatccatggcgaacccggccgccggcgcgacacgttgaagagcgcggacgcgatcgccgaggaaatctgcgcgtcgatcctgggcgatctcggcgacaaggcgaaaggccccgcgctgctgttcgtcaacggcttcggcggcacgccgctgatggagctctatctgatgtacaacagcgcgcgaagaattctcgagaagcgtggcgtgacgatagtccgttcgcttgtcggcagctatgtcacctcgctcgacatggccggctgctcgatcacgctcaccatgctcgatgacgagatgaccggctggtgggatgcgccggtccatacggcggcattgcgctggggcatgtag

SEQ ID NO: 9694 - protein, 328 aa, Rhizobium loti
MKKFMNAVDTVLTESLDGFVAAHADILALGEEHKFVRRRALRPGKVALISGGGSGHEPLHAGFVGHGMLDAACPGQVFTSPTPDQMLAATQAVDSGAGCLFIVKNYEGDVMNFDMAAEMSDGVLRVVTNDDVAVENSSYTTGRRGVAGTLVVEKIVGAAAEHGLALPVLKALGERVNAATRSMGVALTSGTVPAAGKPTFDIGDGEMEFGVGIHGEPGRRRDTLKSADAIAEEICASILGDLGDKAKGPALLFVNGFGGTPLMELYLMYNSARRILEKRGVTIVRSLVGSYVTSLDMAGCSITLTMLDDEMTGWWDAPVHTAALRWGM

SEQ ID NO: 9695 - DNA, 2210 bp, Homo sapiens
  CDS (52)..(1779)
agcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgtcctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaaaaaaaaaaaaaa

SEQ ID NO: 9696 - protein, 575 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 9697 - DNA, 1950 bp, Neurospora crassa
  CDS (1)..(1950)
atgtccaaccgacacttcatcaacgacccccaacacctcgtcctcacatccctgcaatccaccaccctcctcaaccccggcatcgccctcgacgcccacaacaaaatcgtctacctgcgtcccggctacggcaatgcctcctcctcctcctcctcctccaaccaaagacagaaagtctccctcatctccggcggcggctccggccacgaaccttccttctccagcatggtcggtcgcggtctcctctctgcctgtgtagcaggtaccatcttcgcttccccctccgccgaacaagtccgtacagcgatcatggggcgggttgaaaacaacgagccctcctcctctcctgaacatggacaacaacaacagagaggagaggacgcgggcggggtcctggtggtagtcatgaactacaccggtgacgtgctcaactttggcctagccgtagaaaaagccaaagccgcgggggtgaacgtggagatggtggttgtcggggatgatgtcggtgttggacgggctaaagctgggaaagtaggcagaagaggcattgcggggacggtgttggtccaaaagattgcgggagcgttggctgcgcagggacggagtctgaaggaggtgacaaaggtggccaatttggcggcggagaatatcgtcagtgtcggcgccagtctggagcatgtgcatgttccggggagaagggcggaggcggagggcgccgagttcaaggtgttgaaggagggcgaggtggagattggcatggggattcataatgagcaagggagcagtagggagaaggggattgggttgccggagttggtggggaagatgctgaagcagttgctggatcggaacgatgaggacagggcgtttgtgaacgtaaattcgaatgaggtggtgctgttggtgaacaacctcggtggtgtcagcccgttggagatgggcgggattgtcaccgaggtggtgacgcagttggcggaacaaccgtatgggatcaagcccgtgaggatcctgagcggcacgtatatgacgagcttgaatgggttgggatttagtatctcgctgttgaatgtggttaacacggacattggcggaccgggcatgattgacttgctggattacccatctgaggcaacgggttggacagcacccatctccaagctgacttgggaggagcagcgggaaaacaagagtacccgggagaatgaggtcaagtccgaggaggaggtgaggccttgtggtctaacgtatgagccccaggaggtgcagaagcagctggttgccgggctgaaggctgtcatcgccgccgaaccggatgtgaccaagtacgacaccatggtgggtgatggtgattgcggtatcggtctgaagcgcggcgctgaggcaatcttgtcgcatctcgactccaaccccctaacaggcgatgcagccattgacctcgccaagatcgtcaccgtggtcgagcaaaccatggacggtacctcgggtgctctctacggcatcttcctcaacgctctggtcgcctctctccacactgtcggtggaggggagtcggacaagaaagctgctgatgaaaatgcctgggccgcagccctcaaactgagctgtgaggccctgtccaagtacacgcccgctcgtcccggtgaccgcaccctggttgatgccctctatccctttgtcgatgcgctcgaaaagaccggtgatgtgaagaaggcggccgaggctgccaagcagggagctgagggcaccaagggtatgaaggccaagttgggccgcaccgtctacattggcgggtccggattcgagcaggtgccggatccgggcgcttggggattggccaagttcttccttggactggctggaattgaaaaggctgatgattccagtgctaagcaggccaagggatcggatgatggatgggaggaggttacaagagaggcggaattgccgtaa

SEQ ID NO: 9698 - protein, 649 aa, Neurospora crassa
MSNRHFINDPQHLVLTSLQSTTLLNPGIALDAHNKIVYLRPGYGNASSSSSSSNQRQKVSLISGGGSGHEPSFSSMVGRGLLSACVAGTIFASPSAEQVRTAIMGRVENNEPSSSPEHGQQQQRGEDAGGVLVVVMNYTGDVLNFGLAVEKAKAAGVNVEMVVVGDDVGVGRAKAGKVGRRGIAGTVLVQKIAGALAAQGRSLKEVTKVANLAAENIVSVGASLEHVHVPGRRAEAEGAEFKVLKEGEVEIGMGIHNEQGSSREKGIGLPELVGKMLKQLLDRNDEDRAFVNVNSNEVVLLVNNLGGVSPLEMGGIVTEVVTQLAEQPYGIKPVRILSGTYMTSLNGLGFSISLLNVVNTDIGGPGMIDLLDYPSEATGWTAPISKLTWEEQRENKSTRENEVKSEEEVRPCGLTYEPQEVQKQLVAGLKAVIAAEPDVTKYDTMVGDGDCGIGLKRGAEAILSHLDSNPLTGDAAIDLAKIVTVVEQTMDGTSGALYGIFLNALVASLHTVGGGESDKKAADENAWAAALKLSCEALSKYTPARPGDRTLVDALYPFVDALEKTGDVKKAAEAAKQGAEGTKGMKAKLGRTVYIGGSGFEQVPDPGAWGLAKFFLGLAGIEKADDSSAKQAKGSDDGWEEVTREAELP

SEQ ID NO: 9699 - DNA, 1005 bp, Pasteurella multocida
  CDS (1)..(1005)
atgactagaaaaccaaaaaaactccttaatcatccaaatgatgtgcctgcggagcaattagaagggttgctctatgcatgccatgggaaactttcaaaagtagagggttatagtggagtgattcgtacagatattgcagatcagcaagtcgtcgtggttactggtggtggtagtggacatgaaccgatgtttgcgggctttgtggggaaaggattagcagacgctgcggcactgggtgaaatttttacttcaccttctccagatattattatcgaaacgactaaagccgcacaaaaaggtcaaggtgtgcttttcgtctatggtaattatgctggggataatatgaattttgatattgcggcagaattattagaagaagaaggtatcactgtcaaaaccgtacgtgtgacagacgatatttctgcggcaccgccagaaagaatgcaagaacgtcgtggtgttgctggtgatatgtatgtccttaaaattgcaggtgcagccgttcagtccggttatgaccttgacgccttacatgaagtgacgagtaaagcgaattttaatactcgaactatgggggttgctttagcggcatgttctattcctcagacaggaaaatttaactttgagcttgcagatgatgaattagagcttggtatggggattcatggtgaaacgggcgtaagacgtcagaaattaacaagtgcggatgaaattaaccaagaaattgttgatcggatttgtgcggatatcgggttgcaagcaggagatagggtgtgtgtcacaatcaataatttaggtgcggcaacttatactgagttattaatttcaaaccgcaaagtccatcaagaattagcaaaacgtggtattcaagtgcatgacactttgattggttcttattgtacgtctcaggaaatggcggggtattctgtgacacttttccgcttagatgatgaattacaaaaattatatgacttgccttgtgatggttttgcatggagaaaataa

SEQ ID NO: 9700 - protein, 334 aa, Pasteurella multocida
MTRKPKKLLNHPNDVPAEQLEGLLYACHGKLSKVEGYSGVIRTDIADQQVVVVTGGGSGHEPMFAGFVGKGLADAAALGEIFTSPSPDIIIETTKAAQKGQGVLFVYGNYAGDNMNFDIAAELLEEEGITVKTVRVTDDISAAPPERMQERRGVAGDMYVLKIAGAAVQSGYDLDALHEVTSKANFNTRTMGVALAACSIPQTGKFNFELADDELELGMGIHGETGVRRQKLTSADEINQEIVDRICADIGLQAGDRVCVTINNLGAATYTELLISNRKVHQELAKRGIQVHDTLIGSYCTSQEMAGYSVTLFRLDDELQKLYDLPCDGFAWRK

SEQ ID NO: 9701 - DNA, 993 bp, Streptomyces coelicolor
  CDS (1)..(993)
atgaggatgctcatcaacgtccccgagaccgtcgtcgcggatgcgctgcgcggtatggccgccgcccatcccgagttgaccgtggacgtcgagaaccgggtgatcgtgcggcgggacgcccccgtgtccggggaggtggccctggtgtcggggggtggctccgggcacgagccgctgcacggcgggttcgtgggccccgggatgctgacggccgcctgtccgggcgaggtgttcacctcgccggtgccggaccagatggtgcgggccgcggcggccgtgaacagcggggccggggtgctcttcgtcgtcaagaactacaccggtgacgtgctcaacttcgacatggccgccgagctggccgaggacgagggcatccaggtcgcgaaggtgctggtcaacgacgatgtggcggtgacggacagcctctacacggccgggcggcgcggcacgggggcgaccctgttcgtcgagaagatcgccggggcggcggcgcgggaggggcggccgctggagcaggtggaggcgatcgcccgccgggtcaacgagagctcgcgcagtttcggggtggcgctgagcgccgtcacgacgccggccaagggcagccccaccttcgacctcccgtccggggagctggagctgggcatcggcatccacggggagcccggccgggagcggcggccgatgatgacctccggcgagatcgccgaggccgccgtggacgcggtgctgaccgacctcggcccgcgcaaccccgtcctggtcctggtcaacggcatgggcgcgactccgctcctcgagctgtacggcttcaacgccgaggtgcagcgggtgctcggcgagcgcggcgtggccgtcgcccgcaccctcgtcggcaactacgtcacctccctcgacatggccggcgcctcggtcaccctgtgcgagatcgacgaggagctgctcgggctgtgggacgcgccggtcagtaccccgggtctgcggtggggcatgtga

SEQ ID NO: 9702 - protein, 330 aa, Streptomyces coelicolor
MRMLINVPETVVADALRGMAAAHPELTVDVENRVIVRRDAPVSGEVALVSGGGSGHEPLHGGFVGPGMLTAACPGEVFTSPVPDQMVRAAAAVNSGAGVLFVVKNYTGDVLNFDMAAELAEDEGIQVAKVLVNDDVAVTDSLYTAGRRGTGATLFVEKIAGAAAREGRPLEQVEAIARRVNESSRSFGVALSAVTTPAKGSPTFDLPSGELELGIGIHGEPGRERRPMMTSGEIAEAAVDAVLTDLGPRNPVLVLVNGMGATPLLELYGFNAEVQRVLGERGVAVARTLVGNYVTSLDMAGASVTLCEIDEELLGLWDAPVSTPGLRWGM

SEQ ID NO: 9703 - DNA, 1853 bp, Zygosaccharomyces rouxii
  CDS (35)..(1798)
ttcaattcaatttaactgatattgtggtagaagaatgagcggtgtcaagtcgttcgaagtttctgatccagtcaaccactccttaaaaggggttgctcttgcaaatccatcgttgacattgggttccggtgaaaagaatatcttcagaaaaactgatagcataacggttggattgattgcaggtggtggtaccggtcatgaaccaacacatgcgggattcgttggtaaaggtggtctctcagctgctgtatgtggtgaaatcttcgcatcaccatccaccaagcaaatcttgaatgctattcaattagtcgcagaaaactctagcagtgtgttgttggttgtgaagaactacactggtgatgttttgcatttcggtttatctgctgagcgtgccagagctcttggtatcgactgtcgtgtgatgacagtgactgatgatgtggcagttggtagagaaaaaggtggtatggtcggtaggagagctctcgcaggtaccgtacttgttcacaaatctctaggtgccttttctgagaagtactctgagaaatatggtatcgaaggtactgaaaaggtcgctcacattgttaacgatcatctagtttccattaacagttctttagaccattgcaaagtcccaggtagaaaatttgaaaccgaattgaattctaaccaaatggaattgggtatgggtattcacaacgagccaggtgtcccagtgttggattccattccaagtacggaagaattaattgagaagcaaatgcttccaaagatgttagatcctaacgataaggatagacattttgtagacttcggcaaagatgacgaagtgttgcttttggttaacaatttgggcggtgtttccaactttattatttccgctattgcatctataactgtagacctgttgaagaagaattatggaattgtgcctgtgcaggtcattactggtaccgttatgacttcctttaacggtaacgggtttggtttgaccctgttgaatgttagtggtacctccaagcagctcaaatcacatttctcagagattaactctgtgctggacttgattaatgcacctacagatgcacctggctggccagttacttcagttccaggtgacaagggcccatcttataatgaagacctatttaccaaagaggttaaggtaaaggacgctggtgcctacaactacgaaaactttgctcagtggatgaaagctggtgcagaaagtgtagttgctgcagagccacatattacatctctggacaataaagtaggtgatggtgactgcgggtacactttggtagctggtgtcaatggtattacagacagtttacccaagttatcgcgtaaatcgttgtcagaggctactgcgcagatttcggatgtcatagaaagttccatgggtggtacctctggtggtctctattcgattttgatctcaggatttgctcatggattaatccaagcatccgacggtgagaacactccagtgacaccagagttgaccgctaaggccttagacattgctttggagactctttataaatacacaaaggcaagacccggtgcatctacaatgatcgatgctctagaacctttcatcaaagaattctctgcttctaaagatttcgataaggcagtagctgctgctgaagagggtgctaaagccactggtagcagagaggccaaattcggtagagcctcatacgtcggagactcctcgaacgtggaagatcctggtgctgtgggcttagttgctttcatgaagggcgttcaatcagcatataaatcttaggtataaaagaggatttagccgccgagtatcctcttattaagtaagacgtatatca

SEQ ID NO: 9704 - protein, 587 aa, Zygosaccharomyces rouxii
MSGVKSFEVSDPVNHSLKGVALANPSLTLGSGEKNIFRKTDSITVGLIAGGGTGHEPTHAGFVGKGGLSAAVCGEIFASPSTKQILNAIQLVAENSSSVLLVVKNYTGDVLHFGLSAERARALGIDCRVMTVTDDVAVGREKGGMVGRRALAGTVLVHKSLGAFSEKYSEKYGIEGTEKVAHIVNDHLVSINSSLDHCKVPGRKFETELNSNQMELGMGIHNEPGVPVLDSIPSTEELIEKQMLPKMLDPNDKDRHFVDFGKDDEVLLLVNNLGGVSNFIISAIASITVDLLKKNYGIVPVQVITGTVMTSFNGNGFGLTLLNVSGTSKQLKSHFSEINSVLDLINAPTDAPGWPVTSVPGDKGPSYNEDLFTKEVKVKDAGAYNYENFAQWMKAGAESVVAAEPHITSLDNKVGDGDCGYTLVAGVNGITDSLPKLSRKSLSEATAQISDVIESSMGGTSGGLYSILISGFAHGLIQASDGENTPVTPELTAKALDIALETLYKYTKARPGASTMIDALEPFIKEFSASKDFDKAVAAAEEGAKATGSREAKFGRASYVGDSSNVEDPGAVGLVAFMKGVQSAYKS

SEQ ID NO: 9705 - DNA, 1878 bp, Arabidopsis thaliana
  CDS (1)..(1878)
atggttcctccggctaaaaaattcatcaacaaccccaacgatgttgtaaccgagttcatcgaaggtctcgtcgaaacttatcctggacttcagtatttggatggtcttcccgagatcaaagttgtactaagagctgatgtctcagctgcaaattatgacaaggttgccgttatatcaggaggaggaagtgggcatgaaccagcacaagctgggtatgttggagaaggaatgctcacagctgctatttgtggagatgtttttgcttcgccaactgttgattccatcctagctaggattcgtgctgtaactggtccaaaaggatgcctcttggttgtcacgaactatactggtgaccgcttgaactttggcctggcagctgagcaagcaaaaactgagggtttcgatatagaggtaactactgtaattgttggagatgattgtgctctacccccgccgcgtggcgtagctgggcgcagaggtttagcgggaacagttcttgtccataaggttgctggagcagcagctgctgctggactttctctagcagaagttgcagcagaagcaaaacatgcatctgaaatggttggaaccatgggtgttgcactatctgtctgtgcgcttccaggacaggttacatcagatcgtttgggtccagagaaaatggaacttgggcttggagttcatggggagcctggtgctgctgtagtcgacattcaacctgtggaagttgtagtgtcccatgttcttcaacagatactgagtccagagacaaattatgttccaattacacgtggtaacagtgtggttctgatgattaatggcttaggtggtacacctctaatggaacttatgattgctgctggaaaagcagtcccaaaattacagttggaatatgggcttgccgttgatagggtgtatactggatcatttatgacgtctcttgatatggcaggtgactgtttctgttgtgtctatgtagagtcactgattttgtgctgtgctctcatactccttcccttctcagggttctcgatatcgatcatgaaggccgaccagtcaattttagagcgtttggatgctccgaccaatgctcctagttggccagttggcacagatgatctctctacaggaagccgcccaccagcaaagatccccgttccacttcccttccgatcaaccaaaaacgaagaggagcttagtcaacaggggcgaattcttgaggcagctattgaagcagcagcaactgtagtcatcaatctgaaggatagtttgaacgaatgggatggaaaagtaggtgatggggattgtggatcaacaatgtgcagaggtgcaacagctattctggaggacatgaagaattatccgctcaacgatgctgcggaaacagtgagtgagattggttcatcgattagaagagtcatggggggaacaagtggaataatacatgacactgtctcatatgaaaccagttacaatctcctctgtaaggcagcatatgcggagttaaaagctaacagtcaatcagaaaccacttccaaacactggtctgaagcactcaagtcatcaatctctgctgtcagtaaatatggtggagcaactgccggttatagaacgatgttagatgcgctcatccccgcttcaaaagtccttgaggagaagctgagtgttggggaggaccctattgctgcttttgttctgtctgctgaagctgcgaccgcaggagctgaatctaccattcatatgaaagcacaggccgggagatcaagctatgtatcagctgagatttttgcatcaattcctgatccaggagcaatggctgcagcggcatggtacagcgccgctgcaagagccgtgaaagagcagaggcagaggttttga

SEQ ID NO: 9706 - protein, 625 aa, Arabidopsis thaliana
MVPPAKKFINNPNDVVTEFIEGLVETYPGLQYLDGLPEIKVVLRADVSAANYDKVAVISGGGSGHEPAQAGYVGEGMLTAAICGDVFASPTVDSILARIRAVTGPKGCLLVVTNYTGDRLNFGLAAEQAKTEGFDIEVTTVIVGDDCALPPPRGVAGRRGLAGTVLVHKVAGAAAAAGLSLAEVAAEAKHASEMVGTMGVALSVCALPGQVTSDRLGPEKMELGLGVHGEPGAAVVDIQPVEVVVSHVLQQILSPETNYVPITRGNSVVLMINGLGGTPLMELMIAAGKAVPKLQLEYGLAVDRVYTGSFMTSLDMAGDCFCCVYVESLILCCALILLPFSGFSISIMKADQSILERLDAPTNAPSWPVGTDDLSTGSRPPAKIPVPLPFRSTKNEEELSQQGRILEAAIEAAATVVINLKDSLNEWDGKVGDGDCGSTMCRGATAILEDMKNYPLNDAAETVSEIGSSIRRVMGGTSGIIHDTVSYETSYNLLCKAAYAELKANSQSETTSKHWSEALKSSISAVSKYGGATAGYRTMLDALIPASKVLEEKLSVGEDPIAAFVLSAEAATAGAESTIHMKAQAGRSSYVSAEIFASIPDPGAMAAAAWYSAAARAVKEQRQRF

SEQ ID NO: 9707 - DNA, 1737 bp, Caenorhabditis elegans
  CDS (1)..(1737)
atgtcgaagaaatttgtgaacaaagcggaggaagctgtcgacgatgcgctttttggactggtttcatcgaattcgaatgtcaaatttcataagagctgccgacgagttgttcacatcaccgatctcaacccctcgcaccacgtttccctgatagctggaggtggttcaggacacgaaccgtatgctgccggatatgttggaaaaggtcttctgaccgctgcaattgccggaaacgtgttcgcttccccgccgtcgaggaacgttcaggcggcattggaggccactagaggagaagccggtgccatcttgttcgtcattaactacaccggagaccgtctgaactttggtttggcggctgagcgattcaacgcatcaggtggcacagctcgagtcgtcacgatcgccgatgacgtggcaattgacagcccgaatagcaaagttggacgtagaggtctggcgggtgcagttttaacaattaaaattgctggagccatggcctgggaaggaaaatcgctggatgagatctacgagacatctcaaaaagttgtgagctcaatgggtacactcggcgtgtcactttatacgggaagcttgccgggcaaaaatcgagagaccgagttgccggacgatcagattgaagtaggactgggaattcacggtgagccgggcaaatttcgtgctcaatttggcagtgccaatcgaattgtgcacagcttgttggacacactacgctcgaagatggaaatgcgggaaggcgagaagtttgtggttcttgtcaacaatttgggtagtgtttcgcagttggagatgaacatcgtgaatggagaggttttgagatattttgaagatcacaaaattggaatcactcgattcttcagcggtatctacatgacatctttagacggtcatggcgtcagtgtcaccattctgagagccgatgactctatgctacagtacttggatgctccagcggcggcgccgggatggattccagcactttcagtacaaaaatgtgtagatcatcaggaaatttcggattcgtcgtcccaaggcgacctaatctcagaaattccagcgtctggagtaactgtgaatgcccagctcgtggaagcatgcgtcggaggagttgtggatgcgatgctggaatccgagaaacatctgaatcaactcgacgcgtacgccggtgacggagactgtgggagcacgtttgccggagcagctgaagcgattcgcaagcagacatcaggcctcaactacactcatccggagacacttctcaagcagctttccatcatttttgagcaaaccgtcggaggaaccagtggagcgctgtacgcgttgatgttcagctcggcggcgcagagtttcgctcaaagatcgcaaagaggagaaaagatcgatcgaacgtcgattctggaggcgttggacaaggcgaatcgggcggttcaaaagtacggaggcgcgagagtcggagatcggacgatggttgatggattggatgcgatggtcgaggagttgagaaagggattcagtgggaatgaggaatcgttggatgcgatcttcgaggcggcggttaaggcttccgaaaaagcggcgaaagcgactgcaagccaaacggcaaccgtgggccgtgccagctacacatcgtcagaagcccaaacgaagcctgatgcaggggccacggcaatctcactctggcttagagcttgctggacggcttataaaagcgaaaaatga

SEQ ID NO: 9708 - protein, 578 aa, Caenorhabditis elegans
MSKKFVNKAEEAVDDALFGLVSSNSNVKFHKSCRRVVHITDLNPSHHVSLIAGGGSGHEPYAAGYVGKGLLTAAIAGNVFASPPSRNVQAALEATRGEAGAILFVINYTGDRLNFGLAAERFNASGGTARVVTIADDVAIDSPNSKVGRRGLAGAVLTIKIAGAMAWEGKSLDEIYETSQKVVSSMGTLGVSLYTGSLPGKNRETELPDDQIEVGLGIHGEPGKFRAQFGSANRIVHSLLDTLRSKMEMREGEKFVVLVNNLGSVSQLEMNIVNGEVLRYFEDHKIGITRFFSGIYMTSLDGHGVSVTILRADDSMLQYLDAPAAAPGWIPALSVQKCVDHQEISDSSSQGDLISEIPASGVTVNAQLVEACVGGVVDAMLESEKHLNQLDAYAGDGDCGSTFAGAAEAIRKQTSGLNYTHPETLLKQLSIIFEQTVGGTSGALYALMFSSAAQSFAQRSQRGEKIDRTSILEALDKANRAVQKYGGARVGDRTMVDGLDAMVEELRKGFSGNEESLDAIFEAAVKASEKAAKATASQTATVGRASYTSSEAQTKPDAGATAISLWLRACWTAYKSEK

SEQ ID NO: 9709 - DNA, 1782 bp, Streptomyces coelicolor
  CDS (1)..(1782)
atgacccgcctgttcaacgacccggccgccttcgccgacgaggcgctggagggcttcaccgccgcgcaccggcgctgggtccggccggtcaccggcggcgtcgtccgggccaccgccaccccggccggccaggtcgccgtggtgatcggcggcggttccggccactaccccgcgttctccggcctggtcggccgcggtctggcacacggcgcggccgtcgggaacgtcttcgcctcgccctccgcccggcagatccactccgtggccaccgccgcgcacgggggcgggggagtcctgctgatgtacggcaactacgccggtgacgtcctgcacttcggacaggccgccgagcgactcgccgccgacggcatcgagacccggacgttcgccgtcgccgacgacatctccagcgcgggccccgacgaatccgccaagcgccgcggcatagccggtgacctgcccgtcttcaaggcggcggccgccgcggccgagcagggcctgcccctggaggaggtgctgcgcgtcgccgaacgggcgggcgtccgcacccgctccttcggcatcgccttctccggctgcaccctgcccggcgccgaccatcccctgttcaccgtgcccgaggcccggatggccgtgggcctcggcatccacggcgagcccggcatcggcgaggaggccctgcccaccgccgacgaggcggccctgctgctcgtcgagacactgctcaaggaactccccgacgacgtcgccgacccggcgggccggcgcgccgccgtgattctcaacggcctcggctcggtcaagtacgaggagctgttcgtcgtctaccgcaaggtcgccgccctgctcggcgacgccggtgtggagatcgtcgacccggaggtcggcgaactggtcaccagcttcgacatggccggcatctcgctgacgctgacctggctggacgaccggctggaggagctgtggcgggccccggccgacacgcccgcctaccgcaagggcgccctcggcgacccggagcccgaccaggaccgggcggccgcgaccgcgggccaggacacggccgcggcccaggacaccgccgtgtccgacgcggccgcctccggcaccacggccgtacccgtcgcctcggacgcctcccgccgggccgccggcaccgtcctggccgcgctggacgcggtggcccgagtcgtcgacgcccacgccggcgaactcggccggatcgacgccgtggcgggcgacggcgaccacggcatcggcatgcggcgcggctccagcgcggcgcaccgggccgcccacgacgcccaccgggtcggcgcgggcgccggaaccgtcctcacccgcgccgccgacgactgggccgacaaggcgggcggcacctccggcgccctgtggggcacgatcctgcgctcactcggcacggccctcggcgaccgggacgcccccgacgccgcccgcgtcgccgaaggggtcacggaggcctccgccgccgtacgcagactgggcggggccgaggtcggcgacaagaccatggtcgacgtcctggtccccttcgccgacgcgctggccgccgccacggccgagggcctgcccctcgccgaggcctgggaccgcgccgccaccaccgccaccgcggccgccgccgggaccgccgacctgctgccccgccggggccgggcccgcccgcacgccgagaagtccctcggcacccccgacgcgggcgcccactccctcgccctgatcacccgcgccgtccacggcgcactgctcgaccaccactga

SEQ ID NO: 9710 - protein, 593 aa, Streptomyces coelicolor
MTRLFNDPAAFADEALEGFTAAHRRWVRPVTGGVVRATATPAGQVAVVIGGGSGHYPAFSGLVGRGLAHGAAVGNVFASPSARQIHSVATAAHGGGGVLLMYGNYAGDVLHFGQAAERLAADGIETRTFAVADDISSAGPDESAKRRGIAGDLPVFKAAAAAAEQGLPLEEVLRVAERAGVRTRSFGIAFSGCTLPGADHPLFTVPEARMAVGLGIHGEPGIGEEALPTADEAALLLVETLLKELPDDVADPAGRRAAVILNGLGSVKYEELFVVYRKVAALLGDAGVEIVDPEVGELVTSFDMAGISLTLTWLDDRLEELWRAPADTPAYRKGALGDPEPDQDRAAATAGQDTAAAQDTAVSDAAASGTTAVPVASDASRRAAGTVLAALDAVARVVDAHAGELGRIDAVAGDGDHGIGMRRGSSAAHRAAHDAHRVGAGAGTVLTRAADDWADKAGGTSGALWGTILRSLGTALGDRDAPDAARVAEGVTEASAAVRRLGGAEVGDKTMVDVLVPFADALAAATAEGLPLAEAWDRAATTATAAAAGTADLLPRRGRARPHAEKSLGTPDAGAHSLALITRAVHGALLDHH

SEQ ID NO: 9711 - DNA, 1659 bp, Citrobacter freundii
  CDS (1)..(1659)
atgtctcaattcttttttaaccaacgcacccatcttgtgagcgacgtcatcgacggggcgattatcgccagcccatggaataacctggcgcgtctggaaagcgatccggccattcgcatcgtggtccgtcgtgaccttaataaaaataacgtagcggtcatttccggcggcggttcgggacacgaacccgcgcacgttgggtttatcggtaaaggcatgctaaccgctgcggtctgcggcgacgttttcgcctccccgagcgtggatgctgtactgaccgcgattcaggcggtgaccggtgaggctggctgtttgttgattgtgaaaaactacaccggtgaccgtcttaatttcggtctcgccgccgagaaggcgcgtcgccttggctataacgttgaaatgctgattgtcggcgacgacatctccctgccggataacaaacacccacgtggcattgcgggaactatcctggtgcataaaatcgcaggctattttgccgaacgcggctataacctcgccaccgtcctgcgtgaagcgcagtacgcagccagcaacacctttagcctgggcgtagcgctttccagctgtcatctgccgcaagaaaccgacgcagcccctcgtcatcatccgggtcatgcggagctgggtatgggaattcacggcgaaccaggcgcatcggttatcgacacccaaaacagtgcgcaagtggtaaacctgatggtggataaactgctggccgccctgcctgaaaccggtcgtctggcggtgatgattaataatcttggcggcgtttccgtggccgaaatggccatcatcacccgcgaactcgccagcagcccgctgcactcgcgtatcgactggctaattggcccggcctcgctggtcaccgcgctggatatgaaaggcttctcactgacggccatcgtgctggaagagagcatcgaaaaagcactgctcaccgaagtggaaaccagcaactggccgacgccggtcccaccgcgtgaaatcacctgcgtagtgtcatctcacgctagcgcccgcgtggaattccagccttcggcaaacgccctggtggccgggattgtggagctggtcaccgcaaccctttccgatctggagactcatctgaatgcgctggacgccaaagtcggcgatggcgataccggttcgacctttgccgccgcggcgcgtgaaattgccagcctgctgcatcgccagcagctgccgctgaataaccttgccacgctgttcgcgctgattggcgaacgtctgaccgtggtgatgggcggttccagcggtgtgctgatgtcaatcttctttaccgccgccgggcagaaactggaacagggcgctaacgttgtcgaagcgctaaatacggggctggcgcagatgaagttctacggcggcgcagacgaaggcgatcgcacgatgattgatgcgctgcaaccggccctgacctcgctgctcgcacagccgaaaaatctgcaggccgcattcgacgccgcgcaagcgggagccgaacgaacctgtttgtcgagcaaagccaatgcgggtcgcgcatcgtatctgagcagcgaaagcctgctcggaaatatggaccccggcgcgcagcgcctagcgatggtgtttaaagcgctagcggagagtgagctgggctaa

SEQ ID NO: 9712 - protein, 552 aa, Citrobacter freundii
MSQFFFNQRTHLVSDVIDGAIIASPWNNLARLESDPAIRIVVRRDLNKNNVAVISGGGSGHEPAHVGFIGKGMLTAAVCGDVFASPSVDAVLTAIQAVTGEAGCLLIVKNYTGDRLNFGLAAEKARRLGYNVEMLIVGDDISLPDNKHPRGIAGTILVHKIAGYFAERGYNLATVLREAQYAASNTFSLGVALSSCHLPQETDAAPRHHPGHAELGMGIHGEPGASVIDTQNSAQVVNLMVDKLLAALPETGRLAVMINNLGGVSVAEMAIITRELASSPLHSRIDWLIGPASLVTALDMKGFSLTAIVLEESIEKALLTEVETSNWPTPVPPREITCVVSSHASARVEFQPSANALVAGIVELVTATLSDLETHLNALDAKVGDGDTGSTFAAAAREIASLLHRQQLPLNNLATLFALIGERLTVVMGGSSGVLMSIFFTAAGQKLEQGANVVEALNTGLAQMKFYGGADEGDRTMIDALQPALTSLLAQPKNLQAAFDAAQAGAERTCLSSKANAGRASYLSSESLLGNMDPGAQRLAMVFKALAESELG

SEQ ID NO: 9713 - DNA, 1827 bp, Pichia pastoris
  CDS (1)..(1827)
atgtctagtaaacattgggattacaagaaagatctggtactcagccatctggctggattatgtcagtccaacccccatgtaaggctaattgagtccgaaagagtcgtcatctccgccgagaaccaggaggacaagattaccttgatctctggtggaggttcaggacacgagcctctacatgctggctttgtcaccaaggacggtcttttggatgccgctgtggccgggttcatctttgcctcgccatctactaaacagatatttagcgcaatcaaagccaaaccttcgaagaagggaactttgatcatcgtcaagaactatacaggagacattcttcacttcggtcttgccgccgaaaaggccaaggccgaaggtctcaacgcagaactgctgattgttcaggacgatgtctctgttggtaaagccaagaatggcctggtagggcgtagaggtttggctggaacttctttagtgcacaagattttgggtgccaaagcttatttacaaaaggacaacctggaattgcatcagctggtcactttcggtgagaaggtcgttgccaacctggttacaattggtgcttccttggaccatgtcaccattccagccagagcaaacaaacaggaggaagatgattcagatgacgagcacggctacgaagtgctaaagcacgatgaatttgaaatcggaatgggtattcacaacgaaccaggtatcaagaagtcgtcgccaattccaacagtagacgaattggtggctgagctactggagtaccttctttcgactaccgataaggaccgaaattacgtccaatttgacaagaatgatgaagttgtgctactgatcaataacttgggaggaacctcagtgttggaattgtacgctattcagaacattgttgtcgaccaactggcctccaaatattccattaaaccagtccgcattttcactggcactttcaccacatcactggatgggcccggtttttctatcactttattgaatgctaccaagacaggagataaagatatcctaaagtttttagaccacaagactagtgcccctggctggaactccaacatatcagactggtctggcagggttgacaattttattgtggctgccccagaaatagacgaaggagacagttcatctaaggtatctgttgatgctaagctgtatgctgaccttctggagtctggtgtgaagaaggtcatttcaaaagagccaaagatcacattgtatgacactgttgcaggagatggtgattgtggtgaaacgttggcgaatggttccaatgccattttaaaggctctggctgaaggaaagcttgatctcaaagacggtgttaaatcactggtgcaaattacagacatcgtggaaactgccatgggtggaacatctggaggtctgtactccattttcatcagcgctttagcaaagtctttgaaagagaaggaactttccgagggtgcctacacactgacccttgaaacgatctctggatccttacaggcagcacttcagtctctattcaaatacacaagagcacgtactggagacagaactcttattgacgctttggagccatttgtaaaggaattcgccaagtctaaggatctgaaacttgcaaacaaagctgcccatgatggtgctgaagccacaagaaagctcgaagccaagtttggaagagcatcttatgttgccgaagaagagttcaaacaattcgaaagtgaaggtggactacctgatcctggtgctattggtcttgccgctttgatttcaggaattactgatgcatacttcaaatctgaaaccaagttgtag

SEQ ID NO: 9714 - protein, 608 aa, Pichia pastoris
MSSKHWDYKKDLVLSHLAGLCQSNPHVRLIESERVVISAENQEDKITLISGGGSGHEPLHAGFVTKDGLLDAAVAGFIFASPSTKQIFSAIKAKPSKKGTLIIVKNYTGDILHFGLAAEKAKAEGLNAELLIVQDDVSVGKAKNGLVGRRGLAGTSLVHKILGAKAYLQKDNLELHQLVTFGEKVVANLVTIGASLDHVTIPARANKQEEDDSDDEHGYEVLKHDEFEIGMGIHNEPGIKKSSPIPTVDELVAELLEYLLSTTDKDRNYVQFDKNDEVVLLINNLGGTSVLELYAIQNIVVDQLASKYSIKPVRIFTGTFTTSLDGPGFSITLLNATKTGDKDILKFLDHKTSAPGWNSNISDWSGRVDNFIVAAPEIDEGDSSSKVSVDAKLYADLLESGVKKVISKEPKITLYDTVAGDGDCGETLANGSNAILKALAEGKLDLKDGVKSLVQITDIVETAMGGTSGGLYSIFISALAKSLKEKELSEGAYTLTLETISGSLQAALQSLFKYTRARTGDRTLIDALEPFVKEFAKSKDLKLANKAAHDGAEATRKLEAKFGRASYVAEEEFKQFESEGGLPDPGAIGLAALISGITDAYFKSETKL

SEQ ID NO: 9715 - DNA, 1644 bp, Rhizobium sp
  CDS (1)..(1644)
atgagtacgatgaagcactttttcaaccgcagggaaaacatcgttaccgaagcattggacggcctgctgcagaccgcaccggccggtagcctggcgcggctcgacacctatcccgacatcaaggtcgtcctgcgcggcgactgggacaaggcgaaggtcgcggtcatctcaggcgggggggccggccatgagccatcgcatgcgggttttgtcgggagaggcatgttgaccgcggcggtttccggcgagatcttcgcttcgccgagcgtcgaggcggtgctgacggcgatccgcgcggcgaccgggccgaagggctgcctgctgatcgtcaagaactataccggcgatcgcctcaacttcgggctcgcagctgaaaaggcgcgcgtcgaaggctttcgcgtcgagatggtgatcgttgccgatgacatcgcgctcccggatatcgttcagccacgcggtgttgcgggaacgctcttcgtccacaaaatcgccggtcacctcgctgagtgcggcgccggtctcgagaccgttgccgccgccgcccgctcggcggcgcgcgatattgtttcgctcggcgtttcgctctcctcctgctcgattcccggccaggcccatgcggaacggctcgaggcggacgagggggaactggggctcggcatccacggcgaacccggtgtcgaacggatcgccctgcaggaggcgcgcagcatcgttgcgaccatgtccgagcggctttccagagctttgcgcgggggcggcggctatgcgcttctcatcaacaatctcggtgccgtgccgccgatcgagatgggactgatcgctcacacggtcctgtcctcctcactcgccgagcgtgtgaagctgacgataggcccagcgccgctgatgacggcgctcaacatgaacggcttttcgctttccctgatgcggcttgatggggagcgcgaggcagctttgaaagcgcccgtcgggccgcacgcctgggtacccgcagtcgagcggcatgatgtcaccgtgctgccggcgattgccgcgctggccaagcagcccgtgccggccagtcacgatccggccgccgatcggctgatcgcggcgatttgcgatcacctgctctcgctcgaagctgagctcaaccacctcgacgcacgcgccggtgatggcgataccggctcgaccgtggcgacaggctcgcgcagcgtcctggcgcagatcgaaaggctgccgctgaaggacgtcgccgcgacactctcgtcgatcggcagcattctcagcaccagcatgggcggctcgagcggcgtgcttctgtcgatcttcttcaccgccgccgccaaggcctatttggacacgaaggacatggcgggggcgctgctggcgggactggaacggatgaccttttacgggggggcaggggtcggcgaccgcaccatggtggatgctttggacccggcactgcgcgccctcaaggccggcggtctggccgcggccgcttccgcagcgcgcgctggtgccgacgcaacgcgggcgatgaagaaggcgaaggccgggcgcgcttcctatgtcggcgaaagagacctcgacggcatacccgatccgggagccatggcggtggccgcggtcttcgaagtcgcggcggggcttcgttaa

SEQ ID NO: 9716 - protein, 547 aa, Rhizobium sp
MSTMKHFFNRRENIVTEALDGLLQTAPAGSLARLDTYPDIKVVLRGDWDKAKVAVISGGGAGHEPSHAGFVGRGMLTAAVSGEIFASPSVEAVLTAIRAATGPKGCLLIVKNYTGDRLNFGLAAEKARVEGFRVEMVIVADDIALPDIVQPRGVAGTLFVHKIAGHLAECGAGLETVAAAARSAARDIVSLGVSLSSCSIPGQAHAERLEADEGELGLGIHGEPGVERIALQEARSIVATMSERLSRALRGGGGYALLINNLGAVPPIEMGLIAHTVLSSSLAERVKLTIGPAPLMTALNMNGFSLSLMRLDGEREAALKAPVGPHAWVPAVERHDVTVLPAIAALAKQPVPASHDPAADRLIAAICDHLLSLEAELNHLDARAGDGDTGSTVATGSRSVLAQIERLPLKDVAATLSSIGSILSTSMGGSSGVLLSIFFTAAAKAYLDTKDMAGALLAGLERMTFYGGAGVGDRTMVDALDPALRALKAGGLAAAASAARAGADATRAMKKAKAGRASYVGERDLDGIPDPGAMAVAAVFEVAAGLR

SEQ ID NO: 9717 - DNA, 984 bp, Rhizobium sp
  CDS (1)..(984)
atgaaccgagccgagacgttggttgctgagagcctggcgggccttgtgtcggcccacgaacggctggtgaccttcggagccgacgggaagttcgttcgccggcgcagccttcggccgggcaaggtctcgctcatctcgggcggcggtgccgggcacgagccgatgcatgtcggctttgttgggagaggtatgctggatgccgcgtgtaccgggcatgtcttcacttctccaacgccagaccagattgttgccgcgatccgggaaacggaccggggcgagggatgtctgctcatcgttaagaactatgacggcgatgtcatgaatttcgagatggccgccgaactcgtcgcggcggagcaccggatcgccaccgtcgtggtgcgcgacgacgtcgatcccggcgggtcgaagcgcagccaaggcaggagaggagttgcaggaaccgttgtgatggagaagctgctcggggcggcggcggaggccggctggcggctcgatgaactgagcgcgctcggcgagagcctgaacggtcgcatccgcacgatgggggtttcgctgcgtggtgttaccgtgcccgacacggagcgggagaccttcgttctccctgaggatgaaatggagatcggggtaggcatccatggagagccgggacgcgcacgggtcaagttcgccaccgccgacgaaattgtggaaaccatgctggaggcaatcttaggcgagttggcatcggaacgtgatgaaaatctccttatgttcatcaacggctacggtggtacaccggcatcggagctttacctcgtatacaattctgcgaaagcgcagtgcgagcgcctcggccttacgatcgcccggccgctggtcgggacctacgtgacctctttggacatggcggggctgtcaatcaccgtcgcgcgtcttgcggaacgagagctttcgctgtgggacgcgccggtcgacaccgcggcgctgcgctggggaggttaa

SEQ ID NO: 9718 - protein, 327 aa, Rhizobium sp
MNRAETLVAESLAGLVSAHERLVTFGADGKFVRRRSLRPGKVSLISGGGAGHEPMHVGFVGRGMLDAACTGHVFTSPTPDQIVAAIRETDRGEGCLLIVKNYDGDVMNFEMAAELVAAEHRIATVVVRDDVDPGGSKRSQGRRGVAGTVVMEKLLGAAAEAGWRLDELSALGESLNGRIRTMGVSLRGVTVPDTERETFVLPEDEMEIGVGIHGEPGRARVKFATADEIVETMLEAILGELASERDENLLMFINGYGGTPASELYLVYNSAKAQCERLGLTIARPLVGTYVTSLDMAGLSITVARLAERELSLWDAPVDTAALRWGG

SEQ ID NO: 9719 - DNA, 1008 bp, Treponema denticola
  CDS (1)..(1008)
atgaaaaaaatattaaatagacctgaagaatttgtagatgaaatggtggaaggaattttatacgcctatccagataaaataatgccgttaaatggggataagcgggttattcttaataaaacaaaaaaagacaataaggtcggtattgttactgcgggcggcagcggtcatctacctgtgtttctcggttatgtaggtgatggaatgcttgacggatgtgccgtaggtaatgtttttgcttctccgtctgccaataaaatgtatgagatgattaaagcctgtaatttcggaaagggtgtattgtgtctgtatggaaattacggaggagataaactcaattttgaaatggcaatgtctatggctgaaatggacagtatacaggtcaaagaaataagagtgatggatgatattgcttcatcaccgattgagacaaaggataagcggcgaggagttgcaggaatggtttttgcctacaaagttgcaggcgctgcagctcaaaaaggttatgatcttgaaaaacttgtttcggttacggaaaaggctcttgataacatacgcacgatgggtatagctttatcaccatgtatagttcctgaagtcggcaaaccaactttttcaatcaaggatgatgaaatggaaataggaatgggtattcacggagaggtaggtatagaggtttcaaaactgaaaacttcagccgaggttgcaaaaatgatttttgataaaattgcaaccgaaatttctttttcgaaaaacgatgaagttgccgtaatgattaacggtcttggcgccactcctatggaagagttatttattgtctatcgggatttatttaatattttaaatggtctgggtgtaaaagtaataagccctcatgtaggggaatttgcaacatcaatggagatggcagggctttctatcacaattatgaaattggatgatgaattaaaaaccttgcttctccatgatgcaaatacgcccttctatacaaatgcgaataaaaaatag

SEQ ID NO: 9720 - protein, 335 aa, Treponema denticola
MKKILNRPEEFVDEMVEGILYAYPDKIMPLNGDKRVILNKTKKDNKVGIVTAGGSGHLPVFLGYVGDGMLDGCAVGNVFASPSANKMYEMIKACNFGKGVLCLYGNYGGDKLNFEMAMSMAEMDSIQVKEIRVMDDIASSPIETKDKRRGVAGMVFAYKVAGAAAQKGYDLEKLVSVTEKALDNIRTMGIALSPCIVPEVGKPTFSIKDDEMEIGMGIHGEVGIEVSKLKTSAEVAKMIFDKIATEISFSKNDEVAVMINGLGATPMEELFIVYRDLFNILNGLGVKVISPHVGEFATSMEMAGLSITIMKLDDELKTLLLHDANTPFYTNANKK

SEQ ID NO: 9721 - DNA, 999 bp, Bacillus cereus
  CDS (1)..(999)
atgaaaaagattatgaatgatgtacaaaatatcgttcaagatatgctgcatggcttttattttgaacataacgacaaagtaaattatgacgaaacaaataacatcatttatgtaaaagatatcgaaaaaatgaagcaagacgtcgctattataagtggcggtggtagcggacatgaacctgctgatattggttatgtagggaaaggtatgcttacagcggcagtaaacggcagtattttcactccgcctacagtggaacaaattgtgacggcaactcgcctcgtgccaaaagataaaagtatactattcatcatcaaaaactttaaagatgacgttgagaactttctagcggctgagcagatcgctaaagaagaaggaaaaaaaattgaccatatcatcgtaaatgacgacgtttcaattgaagatgatgcttcttttaataaaagaagacgcggcgtcgctggcactgttttcgttcaaaaaatacttggtgcggctgctcttgaaggtcattctttagaagaactaacaacactcggccgttctgttaccgagaacttacacacattaggagtcgccctttcacctgccaacgatccagtgaaaggacaagcttcattcacattaaacgaagatgaagtcttttacggcgtcggcattcacggagaaaaaggttaccgcaaagaagcattatcctcttctgaaatattagcgattgaactaatgaacaaactaaaaagcatttatcgctggcgaaaaggtgacaacttcgccatccttattaatggactcggcgcaacacctttaatggaacaatacattttcgcaaacgacattcgtcgtttgtgtgagctggaaggattacagattacattcgtaaaagttggtacactgctaacttctttagatatgaagggtgtttctttaagtttacttaaggtagaggacttgaactgggtgaagtggttgaaagaaaatacggaaactgctagttggtaa

SEQ ID NO: 9722 - protein, 332 aa, Bacillus cereus
MKKIMNDVQNIVQDMLHGFYFEHNDKVNYDETNNIIYVKDIEKMKQDVAIISGGGSGHEPADIGYVGKGMLTAAVNGSIFTPPTVEQIVTATRLVPKDKSILFIIKNFKDDVENFLAAEQIAKEEGKKIDHIIVNDDVSIEDDASFNKRRRGVAGTVFVQKILGAAALEGHSLEELTTLGRSVTENLHTLGVALSPANDPVKGQASFTLNEDEVFYGVGIHGEKGYRKEALSSSEILAIELMNKLKSIYRWRKGDNFAILINGLGATPLMEQYIFANDIRRLCELEGLQITFVKVGTLLTSLDMKGVSLSLLKVEDLNWVKWLKENTETASW

SEQ ID NO: 9723 - DNA, 1767 bp, Ashbya gossypii
  CDS (1)..(1767)
atgtctgttaataaatcttttgagttagataattcgctgcgctacagtctccatgggttttcattggccaacccatctgtaactctaattgaaagggagaagatcctatacaggaaattaacaaaggagtctgtggcactagtttcgggtggggggtgcggacatgagcctgcgcacagcgggtatgttggggagggcatgttagccgcggctgtcgcaggagacatttttgcgtcgccgtcgacggctcagattttgactgcaataaggattgctacaaagcaagcagctggagcattgctgatcgtgaagaactatactggcgacgttcttcactttggcctggcagctgagcgtgctcggtctatgggcattgattgccgcgtggttattgttggtgatgacgtagctgttggtcgtaccaagggtgcaggagttggacgtcgggggctggcggggactgtgctcgtgcacaaaatcgcaggggagtttgccagaagctattctgcggactatgggctagacgaagtcgctaatgtcgcggagatagtcaatgacaatttagttacgatcggcgcgtctctatcccactgcaaggtgcccggcagagacttcgagtccagtttgacggattctcagatggaacttggcatgggcatccacaacgagcccggcgttcaagtactcgagccaattccgtccacagatgagctaatagaagaacacatgttgccgaagttgttgagtaaggatgacaatgagagatactatgtcgacttttcacccgatgacgaggtcattctgttggtcaataatttgggcgggatctctaactacatgatggcagcccttaccgccaaggtgtccgaatccttagccaaatatggcatacgtcccgttcgtaccgtgtacggctccgtaatgaccgcgttcaatgggaacggctttagcattaccttgttgaatgtgactcgcagtgaggcaaggttgcaggacttgttgcagtctccaatctcattactcgagctgtttgatgcacccacctctgctcctgcttggccgcggatagataccggcaacgacgcccacgcttccggggaaactgacctggtgctcaacactccatctgctgcaccttttgggcgctttgactacgatttttttgccgcactagttagagcaggcagcaagcaggttcgcgaaagcgagccgcacattacccatttagacaacattgtcggtgacggggattgtggaactacacttgccgccggcgctcaggctatagaggatgccctggagcaactacgcggtctttcgttttctgaggcgataggccaagcttcccagatcatagaggcctcaatgggtggcacctcgggtgccctatattctattttgctttccggaatttgccacgagattgcagaactttgtagcagccctgatgatgaagtaacgctggagcttcttggggccgctttgcaacgtgctctgcatgccttgtacaagtattcaggtgcccgtcccggcgattgcactatgatcgatgcactagaacctttcattagcagcttgtaccaagaaagggactttgccaaggccgttgaagcagcggaagagggtgcccgggctacggccaagatgtctgctaagtttggccgagcatcctacgtctctgacactactgacgttcctgatcctggggcagtagggtttgtcgcatttttacgtggtatgcgcgccgctttcgagaaatggaactga

SEQ ID NO: 9724 - protein, 588 aa, Ashbya gossypii
MSVNKSFELDNSLRYSLHGFSLANPSVTLIEREKILYRKLTKESVALVSGGGCGHEPAHSGYVGEGMLAAAVAGDIFASPSTAQILTAIRIATKQAAGALLIVKNYTGDVLHFGLAAERARSMGIDCRVVIVGDDVAVGRTKGAGVGRRGLAGTVLVHKIAGEFARSYSADYGLDEVANVAEIVNDNLVTIGASLSHCKVPGRDFESSLTDSQMELGMGIHNEPGVQVLEPIPSTDELIEEHMLPKLLSKDDNERYYVDFSPDDEVILLVNNLGGISNYMMAALTAKVSESLAKYGIRPVRTVYGSVMTAFNGNGFSITLLNVTRSEARLQDLLQSPISLLELFDAPTSAPAWPRIDTGNDAHASGETDLVLNTPSAAPFGRFDYDFFAALVRAGSKQVRESEPHITHLDNIVGDGDCGTTLAAGAQAIEDALEQLRGLSFSEAIGQASQIIEASMGGTSGALYSILLSGICHEIAELCSSPDDEVTLELLGAALQRALHALYKYSGARPGDCTMIDALEPFISSLYQERDFAKAVEAAEEGARATAKMSAKFGRASYVSDTTDVPDPGAVGFVAFLRGMRAAFEKWN

SEQ ID NO: 9725 - DNA, 1065 bp, Desulfovibrio vulgaris
  CDS (1)..(1065)
atgaagaaactgatcaatgcggtggagaatgtggtgcgcgagcaattgcagggcatggctgccgcccaccctgagcttcgggtgaacatcgacccgcattacatatgcagggctgacatccccgacggcaaggtggccatcgtctctggtggcggcagcgggcacgaacccatgcacgggggcttcgtaggccgtggcatgcttgacggcgcctgtcccggcgaggtgttcacatctcccaccccagaccagatgtatgaatgcgccaaggcagtcgaccgtggcgcgggtgtactgttcatcgtcaagaactacaccggcgacgtgatgaacttcgaaacggccgctgaactgtgccatgccgacggcatcaaggtgcagaacatcctcatcgatgacgacgtggccgtgaaggacagcctgtacacggctggacggcgtggcgtgggaaccaccgtgctggccgagaagatagtgggtgccgccgccgaggcggggtacgacctcgacaggtgcgccgacctgtgccgcaaggtgaaccggtatggtcgctccatgggcatggcactcacgtcgtgcacggtacctgccgcagggaaacccaccttcgaactcgccgaggacgaaatcgagatcggcatcggcattcatggtgagccgggaacacagcgcgcagccatgatgaccgtggatgaactcgtggaggtcatggctaccgccatcatcgacgatcccgcgtacacccgcaccgtgcgcgaattcgaccgcgctgccggcgactgggtggagaagtcgctgacggacgaacccttcgccaagggcgaccgggtcatcgccttcgtcaacagcatggggggcacgccggtgagcgaactgtacgccgcctaccgtaaactggcggaaatctgcgacaggcgtggcatcgtcatcgtgcgcaacctcatcgggccgtatatcacctcactcgagatgcaaggcttctccatcaccctgctgaaggtcgacgacgaaatgctcgcgttctgggatgcgaaggcggtcacacccggcttgcgcatggggtaa

SEQ ID NO: 9726 - protein, 354 aa, Desulfovibrio vulgaris
MKKLINAVENVVREQLQGMAAAHPELRVNIDPHYICRADIPDGKVAIVSGGGSGHEPMHGGFVGRGMLDGACPGEVFTSPTPDQMYECAKAVDRGAGVLFIVKNYTGDVMNFETAAELCHADGIKVQNILIDDDVAVKDSLYTAGRRGVGTTVLAEKIVGAAAEAGYDLDRCADLCRKVNRYGRSMGMALTSCTVPAAGKPTFELAEDEIEIGIGIHGEPGTQRAAMMTVDELVEVMATAIIDDPAYTRTVREFDRAAGDWVEKSLTDEPFAKGDRVIAFVNSMGGTPVSELYAAYRKLAEICDRRGIVIVRNLIGPYITSLEMQGFSITLLKVDDEMLAFWDAKAVTPGLRMG

SEQ ID NO: 9727 - DNA, 996 bp, Corynebacterium diphtheriae
  CDS (1)..(996)
atgaagaaactcattaatgatccacatgatgtggtcgcggaaaccattgcgggtttcgtggccgcacataaggatgtggtgacctccgatggccagtttgttgagcgtgctgaacctaaggcacagggcaaggtcgggatcatttcgggtggtggttctgggcatgagccgctgcatgctgggtttgttggctatggcatgttggatgccgcggtgccagggcctgtgtttacgtctccgccaccggatccgattgtggctgctactaaggctgcggatcatggggcgggtgtgctttatattgtgaagaattacaccggcgatgtactgaattttgatacggctgcggagcttgctgagtttgatgacattgaggtgtcgcaggtgattgtcgatgatgatgctgcggtggaggattctctttatactgcgggtcgtcgtggtgttgctggcacggtgttggtggagaagattgcgggtgctgcggcggagcggggcgataatcttgcggaggttactgcggttgctactgaggtggtgaagaatacgcggtcgatgggggttgcgcttacgtcgtgcacggttccgcatgtgggtaagccgtcttttgatcttggtgattctgaggttgagattggtattggtattcatggtgagccgggtaggcgtcgtgagccgatgagttctgcggatgccattactgatcagttgttggatcctgttgtggaggatctggggctttgtgcgggggagcgggttatcgctttggttaatggtatgggcggtacgccgtcgtcggagttgtatatcgtgtatcgccgagtggcggagcgtcttggccagttgggcgtggttgttgagcgttcgttggtggggaattatgtgacgtcgttggatatgcagggggcgtcggtgacgttgatgcgggtgtctgatgagttgcttgagcttttcgacgccccggttaatactgtggctttgaggaagggaatgtag

SEQ ID NO: 9728 - protein, 331 aa, Corynebacterium diphtheriae
MKKLINDPHDVVAETIAGFVAAHKDVVTSDGQFVERAEPKAQGKVGIISGGGSGHEPLHAGFVGYGMLDAAVPGPVFTSPPPDPIVAATKAADHGAGVLYIVKNYTGDVLNFDTAAELAEFDDIEVSQVIVDDDAAVEDSLYTAGRRGVAGTVLVEKIAGAAAERGDNLAEVTAVATEVVKNTRSMGVALTSCTVPHVGKPSFDLGDSEVEIGIGIHGEPGRRREPMSSADAITDQLLDPVVEDLGLCAGERVIALVNGMGGTPSSELYIVYRRVAERLGQLGVVVERSLVGNYVTSLDMQGASVTLMRVSDELLELFDAPVNTVALRKGM

SEQ ID NO: 9729 - DNA, 999 bp, Mycoplasma mycoides
  CDS (1)..(999)
atgaaaaagttaataaatagtcctgaaacattagttaatgaaatgttagaaggtttagttaaagcttatccaaataaattaaaaagagttgaaggttttgatgtaattattagaaatgatgatattaaaaaagataaagtagctttagttagtggtggtggttctggtcatgaaccagcacatgctggatatgttggatatggaatgttagatgcagctgttgctggagctgtatttacttcaccaactccagatcaagtttatcaagcaattaaaagtagtaatgctaataaaggagtattattaattattaaaaactatactggagatattttaaattttgaaatggctcaagatatggcaagtatggaaggtattgaagttgatagtgtagttgttaatgatgatgtagctgttgaagatagtttatatactgctggaagaagaggagtagctggtactgtttttgttcataaaatagctggtgctaaagctgaaatgggagctagtttacaagaagtaaaaaatacagctttaaaagttattaaaaacgttagaactatgggaatggtaatatctccatgtattgttcctgctgctggtaaatctaatttttcattaaatgaagatgaaatggaaattggaattggaattcatggtgaacctggagtttatagagataaattaaaaccagtagatcaaattgtagatactttaactgataaaattttaaatgatatacaaattaataaagatgaacaagtagcagttatgattaatggaatgggtgccactcctgaaatggaattacttgtaattaataatcatttaaatgatgttttaactaataaaggtattaaaatttataaaacttttgttggtaactttatgacttctattgaaatgggtgggttttcaatttcaattttaaaattagataatgaattaaaagaattattagattacaaagcagatacaccaggtttaaaagttttttaa

SEQ ID NO: 9730 - protein, 332 aa, Mycoplasma mycoides
MKKLINSPETLVNEMLEGLVKAYPNKLKRVEGFDVIIRNDDIKKDKVALVSGGGSGHEPAHAGYVGYGMLDAAVAGAVFTSPTPDQVYQAIKSSNANKGVLLIIKNYTGDILNFEMAQDMASMEGIEVDSVVVNDDVAVEDSLYTAGRRGVAGTVFVHKIAGAKAEMGASLQEVKNTALKVIKNVRTMGMVISPCIVPAAGKSNFSLNEDEMEIGIGIHGEPGVYRDKLKPVDQIVDTLTDKILNDIQINKDEQVAVMINGMGATPEMELLVINNHLNDVLTNKGIKIYKTFVGNFMTSIEMGGFSISILKLDNELKELLDYKADTPGLKVF

SEQ ID NO: 9731 - DNA, 1068 bp, Photobacterium profundum
  CDS (1)..(1068)
atgaaaaagatgattaatcagattgatcaagtggttaaagagcaacttcaaggtattgcgaaggctcattctgaactcgacgtacacttagatcctatgtatatcgtgcgaaaagagcgggaaaaaaccaaggttgcacttatctctgggggaggaagcggtcatgaacctatgcacggcggttatgtaggaaaaggcatgcttgatggtgcttgtcctggtgaaatgtttacatcacctacacccgatcaaatgtacgaatgtgcacaaaaggtcgacaccggtgaaggtattctctttcttattaaaaactataccggggatgtactgaactttgaaacagccgttgaactccttcacggtgagggattaaaagtacaagcgacactgattgatgatgatgtagcagtgaaagatagcctgtataccgcaggacgacgtggcgttgcgaccactgtactggcagagaaaatcctaggggcagcggccgaagagggctatgacctcgataaaatgagtactttagctaaacatattgctaaccgtggacgttcatttggtgttgcactttctgcttgtactgttcctgcggctggtaaaccaagttttgagttaactgataatgaaattgaatttggtgttggtatccatggggaacccggtatcgaacgtcgcgcctttactgatggcgacactatcactaccgatatgatgagtgagatattagataacactccctatgaacgtattgttcgccgctgggataataatttaggtgaatggcaagacgaatcttggatcacagagtctctcaattctggcgataaagttattgtgctcgtgaacaacctaggggcaacaccacaatctgagctctacatagtatatcgaaaagttgctgaaatactggaaaaccatgagatacaaattgaacggaaccttattggtagctattgcacatcattagatatgcaagggatttcgatctcagtgctaaaagtcgatgatgaaatgttatctctgtacgatatgcccgttaacacaccagcaatgcgctggggctgctaa

SEQ ID NO: 9732 - protein, 355 aa, Photobacterium profundum
MKKMINQIDQVVKEQLQGIAKAHSELDVHLDPMYIVRKEREKTKVALISGGGSGHEPMHGGYVGKGMLDGACPGEMFTSPTPDQMYECAQKVDTGEGILFLIKNYTGDVLNFETAVELLHGEGLKVQATLIDDDVAVKDSLYTAGRRGVATTVLAEKILGAAAEEGYDLDKMSTLAKHIANRGRSFGVALSACTVPAAGKPSFELTDNEIEFGVGIHGEPGIERRAFTDGDTITTDMMSEILDNTPYERIVRRWDNNLGEWQDESWITESLNSGDKVIVLVNNLGATPQSELYIVYRKVAEILENHEIQIERNLIGSYCTSLDMQGISISVLKVDDEMLSLYDMPVNTPAMRWGC

SEQ ID NO: 9733 - DNA, 26 bp, Primer
atgtctcacaaacaattcaaatcaga

SEQ ID NO: 9734 - DNA, 24 bp, Primer
ctagtacccagcagctgtaacaaa

SEQ ID NO: 9735 - DNA, 2643 bp, Saccharomyces cerevisiae
  CDS (4)..(2613)
tgaatgactgaaagtgctatagatgaccaaaggtttaatcttacaaaggagttacaacgacactcatgcagagatcaagggaaaataacacaaaaggatgatgctttagattttataagttacagttcttttcaatcctcttttaatactgaccaaaaaagcgcgaacaatggaagtactgtgagaagaagcataaggtcgatttttagaagagcagccgaattgcctagagtccatatggggcctcttacttattcacatgggataaatgagcttgttaacaagaaattaagaaaagactgtgatctcagcacgctatgtcgcgtattgcaaagaggaatcaggatgattaggatgacaagaagaagaaggaagttctatgaatttaaattaatcaataacaacgggcaaataatatggaaagatggttcgaagtatctggaattagactccgttaaagacatcagaatcggtgatacggcgagtacttatcaagaggaagtagatccgaaaagattgagatcggacagtaaactttggattgctattatttataaggtttccaacaaattgaaagcgttacacgtagttgctttgaatgaattggactttaacacattcttaagctgcatttgcggtttagtgaagttaaggagggaattaatggaaagcatacttttgcctgataattcgcaattcgctaggatacattggcaaattactgtttctgaaaaagaggaagatgagaaaaaggacacattgagctttgcagatgtgaagaaactatgtgataaatttcatatttatgtgtcaactggtcaattgttagagtttttccaattagcagacatcaatcataacggactattaaattattttgaatttgaaaagttcattaaaatcttaaagaataggaaagaggtaaatatgatttggtctaaatttacaaaacctccacactcccacttatcatttgaaaatttttttcaatttttaattacagagcagcatgagcaagtggatcgtcaaactgcatggtcatattttattaagtacagagaaccgactcagctgacgatggggcaagatggttttaccaagttcttgaaggagcaaccatatttggtggaggttaaagaggagttatattcaaagccattaaaccattattttattgcatcttcacataatacttatttattggggaaacaaattgcagaaactccatctgtggagggatatattcaagtcctacaacaaggttgtaggtgcgtagaaattgatatatgggatggtgaaaatgggccagtggtatgccatggatttttaacgtcagctattcccttaaaaacagttatacgcgtgataaagaagtacgcttttataacgtctccgtatcctttgattatttcactggaaataaactgtaacaaggataatcaaaaattggcaagcctgataatgagagaggttttagcagaacagctgtactttgttggcacaagaactgataaactgccatcaccaagggaattaaaacataaaatactgttgaaatccaagaagacgagtgaagcaactagaggtcttagcgttaatgagccatttccatcttcttttagttcttcttacgaatcagctaatgaacaggaattaagaatgaaagatgactccacgaacagtagtagcgcaacaaattcttctagtatgcaacgcatcaaaagaattggattaaaaaagcacgctgatataattaatgatgtttctaacatttctggaatacatggcatcaagttcaggaatttctctttaccagagtccaaaacgatagcgcattgtttttcactgaatgagcgcaaagtagaatacatgataaaagacaaacacttaaaattatcgttggataaacataatagaagatatttgatgagagtctatcctcacgttttacgatacaaatcatcaaattttaacccaatacctttttggaaggccggtgtacaaatggtggctacgaattggcaaactaatgatattggacagcaacttaatctggcaatgtttcaaatattagatcaccaacctgatggaagttttaaatcaggatacgtgctaaaaccaaaaaagttgctacctgtagtaacaaaggcgaaaatgattccattaatttacgaacattttgaaaatggtagtgatcctgttactgttaaaattcgaattttatctacacagttattgcccagattgaatgatacatcgccaagcagaaataacaccaattcctttgttaaagtggagtttcataccgatgacgagccgacaatgcccatctcaatcgataagggtacaaggatttctgccactgaagcatccactaagagttctcaagggaatggattcaacccaatatgggatgctgaagtttctatcacattgaaagatacagacctcacatttataaaattcatggttatctctgaagagacccagattgcatctgtttgccttaagctgaactatttgaggatgggatatcgtcacattccgttgtttaacatggagggggaacaatacatattttgcactttatttattcatacacaaattttataggcgatctttttccggccaaatacacatatt

SEQ ID NO: 9736 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDTASTYQEEVDPKRLRSDSKLWIAIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHADIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 9737 - DNA, 4321 bp, Rattus norvegicus (Norway rat)
  CDS (201)..(3998)
aaagcagaagtaagagcgcggctgagcaagacgtgccctgccggactgcctgggacccaggcggttgctgcacgagggacccctgagtcccccccacccgtggctggcaggcccagggattgtgcgggtggctgtgctccggtggtaccgccagcctccggatttctcctgcttcttccctctccctggagcggctgacaatgaccaccatggtcaacgtggacacccttccagaatatgagaagagtcagatcaagagagccctggagctagggacggtgatgaccgtattcagtgcccgcaaatccaccccagagcggaggacagtacagatgatcatggagacccggcaggtggcatggagcaagacagcagataagatcgaaggcttcttggacatcatggaaataaaggaaatccggccagggaagaactccaaggactttgagcgagccaaggctgtccgtcacaaggcagactgctgcttcaccatcttctacggcacccagttcgtgctcagcactctcagtctggcaaccgactcaaaggaggatgcagtgaagtggctctctggcttgaagatcttacaccaggaagcgatgaacgcatccactcccacaatgattgagagttggctgcggaaacagatttattcagtagatcaaacccgaagaaacagcatcagcctccgggagctgaagaccatcttgcccctggtcaacttcaaagtgagcggcatcaagttcctcaaggacaagctggtggaaattggcgcccagaaagatgagctcagttttgaacagttccatctcttctataaaaaactcatgtttgagcagcagaagtcgatacttgacgaattcaaaaaagactcctccgtgttcatcctagggaacacagaccggcctgatgcctcagccgtctacctgcaagacttccagaggtttcttttacatgaacagcaggagctatgggctcaggatctgaacaaagtccgggagcggatgaccaagtttatcgatgacacaatgagggagaccgcagagcccttcttgtttgtggatgagttcctcacgtatctgttctcacgggagaacagcatctgggacgagaagtacgatgccgtggacatgcaggacatgaacaaccccttgtcccattactggatctcctcttcccacaacacgtacctcactggagaccagctgcgtagcgagtcctccacggaagcgtatatccgctgtctgcgtgctggttgtcgctgcatcgagttggattgctgggatgggcctgacgggaaacccataatctatcacggttggacacggaccaccaagatcaagtttgatgatgttgttcaggccatccgggatcatgcctttgttacctccagctttcccgtgattctgtctatcgaggagcactgcagtgtggagcagcaacgtcacatggccaaggtcttcaaggaagtgttaggagacctgctgttgacgaagcccacggaggccagtgctgaccagctgccctcacccagccagcttcgtgagaagatcattatcaagcataagaagctgggcccccgaggtgatgtcgatgtcaatgtggaggacaagaaagatgagcacaagacccagggcgagctgtatatgtgggactccatcgaccagaaatggactcgccactactgtgctattgcggacgccaagctgtccttcagtgacgacattgaacagactgtggaagaggatccggtccaggacactccccccacggagctacattttggggagaaatggttccataagaaggtggagagcaggaccagtgcggagaagctgctgcaggagtactgtgccgagactggggccaaggatggcaccttcctggtgcgggagagcgagaccttccccaacgactacacactctccttctggcggtctggccgggtgcagcactgccgaatccggtctaccatggagggtggggtcatgaagtactacctgactgacaacctcacgttcaacagcatctacgccctcatccagcactaccgggaggcacacctgcgctgtgcggagttcgagctgcggctcacagacccggtgcccaaccccaacccacatgagtccaagccgtggtactatgacaggctgagcaggggggaagcagaggacatgttgatgcggattccccgagatggagccttcctcattcggaagcgggaggggaccgactcttacgccatcaccttcagggccaggggcaaggtgaaacattgccgtatcaaccgggacggacgtcactttgtgctggggacctctgcctactttgagagcctggtggagctcgtcagctactatgagaagcacgcactctaccgcaagatgaggcttcgctaccccgtgaccccggagctcctggaacgatataatatggaaagagacatcaactctctctatgacgtcagcaggatgtatgtggacccaagtgagatcaacccttccatgcctcagaggactgtgaaagcactctatgactacaaagccaagcgcagcgatgagctgaccttctgccgaggtgccctcatccacaacgtctccaaggagccgggaggatggtggaaaggggactatgggacccggatccagcagtatttcccatctaactacgttgaagatatctcggcaggcgatgctgaggagatggaaaagcagattattgaagacaaccccctcgggtctctctgcagaggcatattggatcttaatacctacaatgtggtgaaggccccccaggggaaaaaccagaaagccttcgtctttatcctggagcctaagaaacagggggaccctcctgtggagttcgcgactgaccgtgtggaggaactgtttgagtggtttcagagtatacgagagatcacttggaagatcgacaccaaggagaacaacatgaagtactgggagaggaatcagtccattgctattgagctctctgacttggttgtgtactgcaagccgactagcaaaaccaaggaccatttggaaaatcctgacttccgggaaattcgctcttttgtggagacaaaggcagacagcattgtcaggcaaaagcccgtggatctattgcggtacaaccagaagggcctgacccgtgtctaccccaagggacagagagttgactcttccaactacgaccccttccgtctgtggctgtgtggctcccagatggtggcgctcaatttccagactccagacaagtacatgcagatgaaccatgcattgttttcgctcaatgggcggacaggttacgtcctgcagcccgagagcatgcggtctgagaagtatgacccgatgcccccggagtcccagaggaagatcctgatgacactcactgtcaaggttcttggtgcacgccacctccctaaactagggcggagtatcgcctgtccctttgtagaggtggaaatctgtggggccgagtatgacagcaacaaattcaagacgacggttgtgaatgacaacggtctcagccctgtctgggctccaactcaggagaaggtgacatttgaaatttatgacccaaaccttgcgttcctacgctttctggtctacgaagaagacatgttcagtgaccccaacttcctggctcatgccacataccccattaaaggcatcaaatcaggatttagatcagtccctctgaagaacgggtacagtgaagacatcgagctggcatccctcctggttttctgtgagatgcggccagtcctggagagtgaagaagaactctattcctcctgtcgccagctgcggaggcggcaggaagagctcaacaaccagctcttcctgtatgacacacaccagaacctgcgaggagccaaccgggatgccctggtgaaggagttcaatgttaacgagaatcagctgcggctgtaccaggagaagtgtaaccggaggctgagagagaagagagtgagtaacagcaggttctactcctagaagctctgtgcgcgcacatgcgtgcggtgttcatgagcgcatccggatacaggcgagccttataatcagttcccaggaagaggttcatctgtgacattcattgtcctctctccgagccactcaccatagagatgacatttctgaagacgtcccccccatgggcaggaggagttgagaccttcctgctgtttttccaccttggacaacttaacttatactccttatagaggattcccccaactgtgtgcctcacgtttgtccttccctgttctcagcctctttgaataaaggcaagagtttcatgccattaagctttctatctg

SEQ ID NO: 9738 - protein, 1265 aa, Rattus norvegicus (Norway rat)
MTTMVNVDTLPEYEKSQIKRALELGTVMTVFSARKSTPERRTVQMIMETRQVAWSKTADKIEGFLDIMEIKEIRPGKNSKDFERAKAVRHKADCCFTIFYGTQFVLSTLSLATDSKEDAVKWLSGLKILHQEAMNASTPTMIESWLRKQIYSVDQTRRNSISLRELKTILPLVNFKVSGIKFLKDKLVEIGAQKDELSFEQFHLFYKKLMFEQQKSILDEFKKDSSVFILGNTDRPDASAVYLQDFQRFLLHEQQELWAQDLNKVRERMTKFIDDTMRETAEPFLFVDEFLTYLFSRENSIWDEKYDAVDMQDMNNPLSHYWISSSHNTYLTGDQLRSESSTEAYIRCLRAGCRCIELDCWDGPDGKPIIYHGWTRTTKIKFDDVVQAIRDHAFVTSSFPVILSIEEHCSVEQQRHMAKVFKEVLGDLLLTKPTEASADQLPSPSQLREKIIIKHKKLGPRGDVDVNVEDKKDEHKTQGELYMWDSIDQKWTRHYCAIADAKLSFSDDIEQTVEEDPVQDTPPTELHFGEKWFHKKVESRTSAEKLLQEYCAETGAKDGTFLVRESETFPNDYTLSFWRSGRVQHCRIRSTMEGGVMKYYLTDNLTFNSIYALIQHYREAHLRCAEFELRLTDPVPNPNPHESKPWYYDRLSRGEAEDMLMRIPRDGAFLIRKREGTDSYAITFRARGKVKHCRINRDGRHFVLGTSAYFESLVELVSYYEKHALYRKMRLRYPVTPELLERYNMERDINSLYDVSRMYVDPSEINPSMPQRTVKALYDYKAKRSDELTFCRGALIHNVSKEPGGWWKGDYGTRIQQYFPSNYVEDISAGDAEEMEKQIIEDNPLGSLCRGILDLNTYNVVKAPQGKNQKAFVFILEPKKQGDPPVEFATDRVEELFEWFQSIREITWKIDTKENNMKYWERNQSIAIELSDLVVYCKPTSKTKDHLENPDFREIRSFVETKADSIVRQKPVDLLRYNQKGLTRVYPKGQRVDSSNYDPFRLWLCGSQMVALNFQTPDKYMQMNHALFSLNGRTGYVLQPESMRSEKYDPMPPESQRKILMTLTVKVLGARHLPKLGRSIACPFVEVEICGAEYDSNKFKTTVVNDNGLSPVWAPTQEKVTFEIYDPNLAFLRFLVYEEDMFSDPNFLAHATYPIKGIKSGFRSVPLKNGYSEDIELASLLVFCEMRPVLESEEELYSSCRQLRRRQEELNNQLFLYDTHQNLRGANRDALVKEFNVNENQLRLYQEKCNRRLREKRVSNSRFYS

SEQ ID NO: 9739 - DNA, 5751 bp, Drosophila melanogaster
  CDS (563)..(4501)
cggaaccctctccgggtccccagaatccgtatccgtatctgcagcagccgagtgcgtgtgtgtttctccgtatctgtgcgttgtgactaagccgacagttaaaaactatagctaaactaaaataggagagcgaatccaataaaaaatcccattaccaccggagaggttatcttcgtttgccagcgggtgcaaaatctgaaattgaaatttcgctgcttacgaaatacaaattccactcaacgaagttttcatctgaaagtcaaaaactttggcacagaaaacagccagaacttttaatcagtcccagaatgcagtccaaagagctcgcatgcggtgcaaagtcaataccgctctaacgtgtccaggaccatgtcgatgattcggataccaaccaggactatggcgtcatttgtatgcggtgtggctattctgcgacaactaagggaaaggaaatgaggagccgcggctaatccaagaatcgcacagaaagtaaacagaaagcgttcatcagtgggtcagtagcagcccgtaaacgagattttaaacccaaaaatttgtgaggatgatgagcgccggaggaacctacatctccaccgccagcgtggaggtgccacaagctctgcaagatggcgagaagttcattcgatgggatgatgactcgggcactggaacaccggttacaatgcgcgtcgatgccaagggcttcttcctctactgggtcgaccagaacaacgagctggatatccttgatatagccaccatacgcgacgttcgcacaggacagtacgctaagcgaccaaaggacaacaagctgcgccagattgtgacgctgggcccccaggacacgctcgaggagaagacagtgacggtatgccacggctcggacttcgtcaacatgacgttcgtcaacttctgctgcacccggcgggacatagcccagctctggaccgacggactcatcaagttggcctacagcttggcccagctcaatggctcggcgattatgttcctgcagaaggcccataccaaactgtgtctccaggtggacaaaagcggccgcataccagtgaaaaacatcataaaactttttgcccaaaacaaggaggatcgcaaacgtgtcgagaaggcgctggacgtgaccggtttgccgtcgggaaaggtcgatagcatatcggtgtccaaatttcaattcgaggacttttacaatttgtacaaatatctcacgcagcgttcggaggtagaacgcctctttgacagcatcgttggcaactcgaagcgcaagtgcatgtccatcgctcaactggtggagttcctgaacaagacacagcgtgatccccgcctgaacgagatcctctacccttatgcgaatcccgcccgcgccaaggagctcatccagcaatatgagcccaacaagttcaacgcgcaaaagggccaactcagcctggatggctttttgaggtacttaatgggcgacgacaatcccatcatggcgcccagcaagctcgatctctgcgatgacatggaccagccgatgtcgcactacttcatcaactcctcgcataacacctacttgacgggacaccagctgaccggcaagtcgtccgtcgagatttacaggcagtgtctcctggcgggatgcagatgcgttgagctcgacttctggaacggacgcaccgaggagccagtcattgtccacggctatacgttcgtgcccgagatatttgccaaggacgtgctggaggccatcgcagagagtgcatttaaaacatccgaataccctgtgatattgagctttgagaatcactgcaaccctaggcaacaggcgaaaattgccaactattgtcgcgaaatatttggcgatatgctgctcgataagcctctagactctcatccgctggagccgaacatggacttgccaccgccggcgatgctgcgccgcaagattataatcaagaacaagaagaagcatcaccaccaccatcaccatcatcaccacaaaaagccagcgcaggtgggcacgccggcagccaacaacaaactgactacagcgaattcagtggatgccaaggcggcgcaacaagtcgctttgtcggcctcgcatgaggatgggggcgtgaccaggagcaccgccaacggtgacgttgccactggaacaggaaccggaagtgctgctgggacagcaggacacgcgccgccgttgcaacaaatccgccaaagctccaaagacagcactggatcctccgattcggacagctcttcggaggatgaatccctgcctaacaccacgcccaatttgcccagcggcaacgaacctccgccagaaaaggctcaaaaggaaacggaggcgggagcagagatttcagctttggtcaactatgttcagcccatccattttagctcttttgagaatgcggaaaaaaagaatcgatgctacgaaatgtcttcgtttgatgaaaaacaggcgacaacattattgaaggagcgaccgattgaatttgtgaactacaacaaacaccaattatctcgtgtctatccggcgggcactcgctttgatagctccaactttatgccgcagttgttctggaatgccggatgtcagctcgtggcacttaacttccaaaccctcgatctggccatgcaactcaacttggggatctttgagtataacgctcggtccggttatctacttaagccggagtttatgcgccgatcagatcgcagattggatcccttcgcggaaagcactgtggatggcatcatagcaggcacagtatcaatcacggttctatctggtcagtttctcacggataagagggcgaacacttttgtggaagttgatatgtacggtttgccagcggacacggtgagaaagaagtttcgcaccaagacagtgcgggataatggaatgaatcccctttatgacgaggagccgttcgtgtttaagaaggtggttctccccgagttggcgagcattcgaattgcagcatatgaagagggtggcaaactcattggtcaccgcgttttgcccgtaatcggtctttgccctggttaccgacatgtgaatctccgatctgaagtgggtcaaccaatagcccttgcctctcttttcctgtgcgtggtggtcaaggattatgtacccgatgatctttccaatttcgcagaggcgctagctaaccctattaaataccaaagtgagctagagaagcgcgatattcaactatctgttttgaccgacgaagccgaagcgctgggcagtgcggacgaggatctctccaagtcgtgtggccaaaaaaaggagctgcgtccggttgaatcgcttgcgacttcgccgaagcataggccgagcatctcggccgccgcagcaatgagtgttgacgttaccgtggatcggaccgatggcggaaggggagaagatagcatctctattgtagcaccctcaatacagcatcagcactctctagaccagtccgtaagcacctccatccgacaggtggagtcctcgcagtttgatgtcgatcttgtgttggcggagccgctggaaaagatattggatcacaagtccgtcaaggaaaagcgtctcgagatggaaaagaagctggagtcactgcgaaagaagcatgacaaggaaaagattaagatcgccggccagaaatccagtccgctagagggcaagaagccgaagtttgccatcacgaataagctggtgaagcggctaagcaacaagagtcttaattgtctttctccgcacagcgagcctggtgtagagatccccgcctgccctctggatctgggcgatagcagcgaggagagtgcagccgcggatgccggtgaggacttagccggtgggagcagcagtctggatggcagaactcaagagtcgcgattacgcagtgcctgccgggagtacacttcccagtaccgtgagctgcaggagaagtaccatgaggcaatttacagtgcagccgagaaggtgctgaagacatcgcaaactgggcaaacaaagcagttaaaagcatctctggacaaggtcactggagaggttatgcaccagctgcaggaggcccgccgcaacgaggttaagaatctggccaccgtgcaccgggatcgtgatgagctgatcagaatgaaacgcgaggtggcaagctccgttgtggaacgtggcgtagctgaacgtgtgcggctgaagcagacctttgaccggagaacggatgaacttcagaagcagcacgactcagtgcgcaatgccctggcagagcaccgctccaaggctcgtcaaattctcgacaaggaggcagaatcgcgaagctgtgtatccagcaatggcttcttggtcctcttccatggacctcatcaccatggctgtacgggctccggctcgtcagccctttcaggcaataatctcactctaaatctggacgcgggggctgccggtagtcattcagccatttcgccggcaaagtcgcacaacagcatcgcagcagcggccgagatgaagacgtaaatgggccacgccgtataggtttttctccccgcccaaattatccctaggattaattgtggttctaaagttgttagtcttcagtatttacagcagaaacataggaatgaaaagtcttcgtagtatataagcagtggaggagtagtccctatcctcccacacctatttgacgggaactgacctcgattagatcttaggacctttgaccctaggcattgtaaatcccactgctaaggggaatccaagcaaacacgttttctaactgaacaaactagatgtaaatctatcgcatgtatgatgtacttgtagcgtaactgttgacgtatccgtactttacagtactttatctgtatactgaacggtgtatttctatggtgttaatggaggttgatccatcacactcccgtcaaaccgtacggtttcttcctattcgaacttcgctgaaactctgagtgtctaattaagcaagcaaatgtaacagaagcagaaaataagtataatttatttgtctatacgaaggagactgagtgctccatttgtctaatgctaattgtggttgtgtgtattttacatcagttttaatcgatataatttatacaattagtttaagcctctcacacaaactgtggattgaatctcgtgcgcacacaaggcggatgctagagcggatgccaaagcacaagtctaggccaacaattagtcatttatttctcggttggttgctatttattcttgatttagtcactattcttacgtttacctagtcgttacaaagctccaataaaattctatacggattgtttttccccacttatacctacacatattttactttattcccaatttaattcggtccaatgcatacacacacacgcacagacggcgtcgcacataacctacaacaccaaaaataacaaaatacgatcggcgattttgcagtttgcgggagctaacataccgatccgggttaccctgaaattgtcgacttgtgccacattctcaagacaatcaaacaataaaatatgcaaatttattgagtgtatttaacctatgttgtagacaagacaccactccttaggtaatcaaacaaaaaaaaaaaaatttacttacatgtaggacgaggaatttattacggttcatataaatttactccaacttgattaattggagtaattattttatttttagtaataggaacagcttttataggatacgtattaccttgaggacaaatatcattttgaggagctact

SEQ ID NO: 9740 - protein, 1312 aa, Drosophila melanogaster
MMSAGGTYISTASVEVPQALQDGEKFIRWDDDSGTGTPVTMRVDAKGFFLYWVDQNNELDILDIATIRDVRTGQYAKRPKDNKLRQIVTLGPQDTLEEKTVTVCHGSDFVNMTFVNFCCTRRDIAQLWTDGLIKLAYSLAQLNGSAIMFLQKAHTKLCLQVDKSGRIPVKNIIKLFAQNKEDRKRVEKALDVTGLPSGKVDSISVSKFQFEDFYNLYKYLTQRSEVERLFDSIVGNSKRKCMSIAQLVEFLNKTQRDPRLNEILYPYANPARAKELIQQYEPNKFNAQKGQLSLDGFLRYLMGDDNPIMAPSKLDLCDDMDQPMSHYFINSSHNTYLTGHQLTGKSSVEIYRQCLLAGCRCVELDFWNGRTEEPVIVHGYTFVPEIFAKDVLEAIAESAFKTSEYPVILSFENHCNPRQQAKIANYCREIFGDMLLDKPLDSHPLEPNMDLPPPAMLRRKIIIKNKKKHHHHHHHHHHKKPAQVGTPAANNKLTTANSVDAKAAQQVALSASHEDGGVTRSTANGDVATGTGTGSAAGTAGHAPPLQQIRQSSKDSTGSSDSDSSSEDESLPNTTPNLPSGNEPPPEKAQKETEAGAEISALVNYVQPIHFSSFENAEKKNRCYEMSSFDEKQATTLLKERPIEFVNYNKHQLSRVYPAGTRFDSSNFMPQLFWNAGCQLVALNFQTLDLAMQLNLGIFEYNARSGYLLKPEFMRRSDRRLDPFAESTVDGIIAGTVSITVLSGQFLTDKRANTFVEVDMYGLPADTVRKKFRTKTVRDNGMNPLYDEEPFVFKKVVLPELASIRIAAYEEGGKLIGHRVLPVIGLCPGYRHVNLRSEVGQPIALASLFLCVVVKDYVPDDLSNFAEALANPIKYQSELEKRDIQLSVLTDEAEALGSADEDLSKSCGQKKELRPVESLATSPKHRPSISAAAAMSVDVTVDRTDGGRGEDSISIVAPSIQHQHSLDQSVSTSIRQVESSQFDVDLVLAEPLEKILDHKSVKEKRLEMEKKLESLRKKHDKEKIKIAGQKSSPLEGKKPKFAITNKLVKRLSNKSLNCLSPHSEPGVEIPACPLDLGDSSEESAAADAGEDLAGGSSSLDGRTQESRLRSACREYTSQYRELQEKYHEAIYSAAEKVLKTSQTGQTKQLKASLDKVTGEVMHQLQEARRNEVKNLATVHRDRDELIRMKREVASSVVERGVAERVRLKQTFDRRTDELQKQHDSVRNALAEHRSKARQILDKEAESRSCVSSNGFLVLFHGPHHHGCTGSGSSALSGNNLTLNLDAGAAGSHSAISPAKSHNSIAAAAEMKT

SEQ ID NO: 9741 - DNA, 4519 bp, Homo sapiens (man)
  CDS (165)..(3710)
cagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaa

SEQ ID NO: 9742 - protein, 1181 aa, Homo sapiens (man)
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 9743 - DNA, 2487 bp, Dictyostelium discoideum
  CDS (511)..(2487)
atggatactttaacaaattcccaagattattcaaatgtcgatttatcattagaatcattagcagaagaattatataatattcaatcatttaataaagatgtaattttagatagttttgatattgatggtaattattactgaaaaaaaaaaaaaaaattttaaattactaaaaatttcttttttttttttttatttattatttatatagattatgatcatactcaattagatacaacaattgattttaataaatttaaaattggattaacaattttaaagatttcatcaaaaggtaaaccacaaaaaaagaaattaatatttgatttagcaagaaatcaaattgtatgtggtaaaaagaaaaaagtgaatttctcagagattgatgagattagggttggtcacaagaccaacattttcaatcaatttaaatcatcaaagaatttaaaagaggatatcgaatcgattcaacaatcattttcaattctattcagtggtaatcttagaaagacaatggatttcgtttgtagtgatattccagaacgtagacaaatagtgtcggcattgtatcatgtggttcaagaatcaaagagtgtcaataacgaatacaatttcgttaagcgtgaatgggatagagttggcaaagattccatcgatttctcgacattgaagaagatattggccagactcaacttcaccacctctgacgccgttctccacaatcttatgaaattcagcgattccaatagcgactaccatttggacttttctgaattttccaatcttcttaaactactccgtagtcatccagagatgaaacctgtattctataaatataatggtggcaatggtgaatgggtgccaattcaaggtatgattgatttctttagaattgagcaatctgaagtgtggactgttgaacagtgtagagatttaattaaaaagtatcatcacgagagattggattgtatttcatttgaaaatttcgaggagtttatttgtggtgaagcaaacttggcacaatacccacacacaagtactgtctatcaagatacttccaaaccgttgtcctactatttcataaattcatcccataacacctacctttcaggccaccaattgaaaggtctttccaccagtgaaatgtatacaaatacactcagacagggttgcaaatgcgttgaattggacgtttgggatggtaatgatggtgatccaatcattttccatggtaatacattaacaagtcaaattaaattctctcatgtttgtgaaaccattaaagctagaggatttgaaacttcaccatatcctgtcatactcagtttagaagttcattgttcagtacctcaacaaatcatgatggcaaatcatatgaaagaaatttttggtgaaatgttaccaactccattaccagagggtacaaaagaattaccaacattagactcattaaaatataaaattttattgaaaggtcatacttctcatactcatgtgagtgctgttggtaattcatcagcatcatcatctcaatcaaatattcaaactgatgacaatgatgatgatggtgctgttgatttaacagaatatgatgaagttgatgatagaagtgcatcatcatcatcctcatcattctctttatcatttggtagtagtggtaaaaagaagaaaattacaaaaattaaaattgcaccagaatttgaagaattaatttatttagtttcacatggatttaaatctggtaatactacaaaagaaattccatcatataaaattcattcattggttgaggagaaagttaaacaattggtacaatctgaaccaagagaggtcgttgaagcatcacaaaatcatttacttagagtttatccaagaggtactcgtttcgatagtagcaattttgatccaatgccaggttggagtattggttgtcaattggcagctttgaatcaacaaacttcatcggaaccaatgtggatcaatgatggtatgttctcagataatggtggttgtggctacgttttaaaaccaccttgtcttttaccaggtgaatgtgaaacttatgaccctacctcaccagagagaatcaagtcaagtaaatactcaagactcatagtaaatgtaattagtgcaagacaattaccaaagtatactaaatcaactaaaggtgaagtcattgatccttatgttaccctatcaatcgttggcactcatttcgatcaaaaagttgaaaaaactaaagttatcgacaataatggtttcaatccacattggggtgaagaatttgaattcccactttacaattctcaattatcaatgttattaattcgtgttgatgataaagataaagttggtcacaatagaattggtcatcattgtattagagttgaaaatattagaccaggttatagaatcttaaaattaaaaaataattttaatagaacaattccattagctaatttattatgtaaatttacatttgttgaataa

SEQ ID NO: 9744 - protein, 658 aa, Dictyostelium discoideum
MDFVCSDIPERRQIVSALYHVVQESKSVNNEYNFVKREWDRVGKDSIDFSTLKKILARLNFTTSDAVLHNLMKFSDSNSDYHLDFSEFSNLLKLLRSHPEMKPVFYKYNGGNGEWVPIQGMIDFFRIEQSEVWTVEQCRDLIKKYHHERLDCISFENFEEFICGEANLAQYPHTSTVYQDTSKPLSYYFINSSHNTYLSGHQLKGLSTSEMYTNTLRQGCKCVELDVWDGNDGDPIIFHGNTLTSQIKFSHVCETIKARGFETSPYPVILSLEVHCSVPQQIMMANHMKEIFGEMLPTPLPEGTKELPTLDSLKYKILLKGHTSHTHVSAVGNSSASSSQSNIQTDDNDDDGAVDLTEYDEVDDRSASSSSSSFSLSFGSSGKKKKITKIKIAPEFEELIYLVSHGFKSGNTTKEIPSYKIHSLVEEKVKQLVQSEPREVVEASQNHLLRVYPRGTRFDSSNFDPMPGWSIGCQLAALNQQTSSEPMWINDGMFSDNGGCGYVLKPPCLLPGECETYDPTSPERIKSSKYSRLIVNVISARQLPKYTKSTKGEVIDPYVTLSIVGTHFDQKVEKTKVIDNNGFNPHWGEEFEFPLYNSQLSMLLIRVDDKDKVGHNRIGHHCIRVENIRPGYRILKLKNNFNRTIPLANLLCKFTFVE

SEQ ID NO: 9745 - DNA, 4721 bp, Xenopus laevis (African clawed frog)
  CDS (83)..(3715)
ttctccctctctctctttcgctgcctcctcctcttcctcgttattttgcccccctagttgccccctgccctgttccccaaacatggcgggggcacggcctggggttcactctcttcaactggagcccgtgaaagtgccggagactcttatcaaagggagcaagttcatcaagtgggatgaggagtccagcagcaaatccctggttactctgcgtgtggatacaatggggttttatctttactggacctgtccaaatatggaggttgatattttggatatcagcgtaataagagacacccggacaggaaaatatgcgaaaattccaaaggatataaaaatgagggagattttgggattcacaggcccagagcagcgccctgaggataagcttgttacagtggtatatggcaatgatattgtgaatatcagcttcctcaactttatggctgtgcaagaagatacagcaaagatttggacagaagagctttttaaattggcacataatattctggcacagaactcatctcggaacaccttcctgcagaaagcatacaccaaactaaagctgcaagtgaatcaagatggacgaattccagttaagaatatcctaaagatgtttgcagctgataagaaaagagtggaaacagcactggaatcttgtggcttgaactttaacaggggggattctattaaaccagaggaatttacactagatattttcgaacgcttcctgaacaagctgtgtctgcgtccagatattgataagatccttctagaacttggagccaaagggaagccatatctgactctggagcaactaatggacttcctaaatcagaaacaaagggacccccggctcaatgagattcttttccctccactaaaaagagaccaagtgcggcagctcattgagaagtatgagcccaacaggcagttcctggacagagaccagatgtcgatggaaggtttcagccgctttttaggtgggcatgagaacagcattgttcccccggagatccttgatctaagtgatgatatgaaccagccgctcagcagctactttattaactcctcccataacacctacctcacagctggccagctaactggaaattcatcagtggagatgtacaggcaagtgctgttgactggctgccgctgtattgagctagattgctggaagggtcgtccgcaggatgaagaaccattcataacccatggattcactatgaccaccgaaattccttttaaggaagtaattgaagcaatagcagaaagtgcctttaaaacatcgccgttcccagtcattttgtcatttgaaaatcatgttgactcttcaaagcagcaagcaaagatggccgagtactgcaggaacatcttcggagatgcgttgttaatagacccgctggagaagtatcctctccagcctggagttgcacttcctagtccccaggaacttatgggtaagatcctagtgaagaataaaaaaagacacaaagtggcagtaaaaggcccagaaggcagtgtaaaaagaagggtcagcgaacaaacctccaatacttacagtgactcatccagtgtttgcgagtcttctgctacaggtctaccaccttcagaatcagctgatgtttcattgacactttccaatggggatgaaaaaatcgaggagaaaccccctaaatatacaaagccacggaaatcgattgatcatgatgcttatagtgaggaggaagaagaagaagagccgtcagatcccaagaaatctgatgagggtacagcaagtagtgaggtgaatgccacagaggagatgtccacacttgtgaattatgtagaacctgttaagttcaagtcatttgatgcggccaaaaaaagaaataagtattatgagatgtcctcatttgttgaaaccaaggcattggagcagctcactaaatccccaatggaatttgtggaatataacaagaagcagctcagccgtatttacccaaaaggaactcgggtagattcctcaaattacatgccccagctcttctggaatgcaggatgtcaaatggtggctttgaactttcaaacgctggatcttccaatgcagctgaatgtgggcatttttgagtataatagacgcagtggttacctcctcaaaccggaattcatgtgcaggacagacaagcattttgatccttttactgaaaatatcgtcgatggaattgtcgcaaatacggttaaaatcaagattatatcagggcagttcctatctgaaaagcgagtaggcatattcgtagaggtcgatatgtttggtctgccagttgataccaagaggaaatttcgcacaaaaacatcccaaggaaactcatttaatcctgtctgggatgaagagccatttattttgcctaaggttgtactccccacacttgccactctccgcattgctgtctttgaagaaggtggaaagtttgtaggtcatcgaatcctgcctgtctcagctatccgaccaggatatcactacatttgccttagaaatgagcttaaccagcctgtctgtctcccagcgctgcttgtttacactgaagtaaatgattatattcctgatgaccaccagggctatgcgaatgccttaactaaccccatcaagcacatcagcctcatggaccaaagggcaaagcaactggcagctctaatgggagagaatgagcaaccattcaacaaagacaagattgattgggatccaatatcaaagcccccaataagatcccgcgatgataccccagagaagattaaaatacccattattcctgtgccttccccaccagcgcaacgagatgaccacattgccagtgtgctgacagacatacaagccccctccatggaagagctgaaatctcaaaagagctttgagaaattgatttgccgccagtaccgagaactgcgtcaactacgccgcaagcacctgcgcaaggtgtcgtctctgtgcaaggagcagagcacttgggtgacacctctgcagagtcttcgcaggaggaagccatttggaagaagccatagaggagtgtctggggcagatcaggatgctgagcagaagttaatggatatgcagcgggaccaacaaaaacgtctcctggaactaagggaaattcaacatgagcaggaacgcaaactgaaacacagccacttactgcaggctgttcagaagctccaggaagtggccatttcttatcattccactcaactcaagaagttaaaggaaatcaatgaaaaggagaagaaagagctgcagaagatcctggacagaaaaagacataacagcattacagaggccaagtcacgggagcggcagaaaaaggacgtggaactgacagaaattaacaggcggcacattaacgagtccgtaagctccatacgaaggctggaagaggcccagaaaaggcgtcaggagaagctgcagacggctcaccaggaaacattgcaaaggataaaggatgaggaaccaaagctgcaggcacagttagatgaagcatgccaggctgagttctgccagctaccccaagaagtccgccgttacctgcaggaagatggttgggttggaagtggttcaggtcccccctcatcttcgcacagcagcccaccctcaatcacccggagctgggggtcggagtctggcgaaaaagattctcttcattccccgggagattcaagtgatgaagccaccaggctctgaccccccaccccctaaaaatatagaaataaacttttttactttcagaagctaatcttggaatccaatcggaattccggaagcacccaagtctgtggactggcgtaagaaaggctatgtaacaccagttaaagaccagggacaatgtggttcatgctgggcacccagtacaacaggtgcattagaaggtcagcactacaggaagactagtaaactgatttctctaagtgagcaaaatcttgtagactgctccagagctcaaggaaacgaggggtgcaacggtggtttaatggatcaagctttccagtatgtaaaggacaatggcggcatagattctgaagactcctacccatacactgctaaggatgaccaggaatgtcactatgatccaaacaacaattccgcaaacgacactggtttcgttgacgttcaatctggatgtgagaaagatctcatgaaggcagtagcttcagtgggaccagtctctgttgcaattgatgcaggacatcagtcgttccagttttatcagtctggaatttattatgagcctgaatgcagcagtgaggacctggatcatggtgtacttgttgtgggttatggatttgaaagtgaagatgtggatgggaagaaatactggattgtcaaaaacagctggagtgagaaatggggcgacaatggatacatcaacattgccaaggatagacacaaccactgtggaatagcaactgctgccagttatcctctggtttaatataaacattgtatatggacctcattagaactattatgtgcacatgttgtaatcctccacttttagcaagtactggactgtttcgtttttttttttttacctgatggaattctgctcaaggctgtcttttaaacttgtgttgaaagttgacgtcccacattgaagctgggttgttttagtattgtttacatgttgattttaatggtggttttatgtcatcttaagcttttataatgtaaaataaaaactataattgtg

SEQ ID NO: 9746 - protein, 1210 aa, Xenopus laevis (African clawed frog)
MAGARPGVHSLQLEPVKVPETLIKGSKFIKWDEESSSKSLVTLRVDTMGFYLYWTCPNMEVDILDISVIRDTRTGKYAKIPKDIKMREILGFTGPEQRPEDKLVTVVYGNDIVNISFLNFMAVQEDTAKIWTEELFKLAHNILAQNSSRNTFLQKAYTKLKLQVNQDGRIPVKNILKMFAADKKRVETALESCGLNFNRGDSIKPEEFTLDIFERFLNKLCLRPDIDKILLELGAKGKPYLTLEQLMDFLNQKQRDPRLNEILFPPLKRDQVRQLIEKYEPNRQFLDRDQMSMEGFSRFLGGHENSIVPPEILDLSDDMNQPLSSYFINSSHNTYLTAGQLTGNSSVEMYRQVLLTGCRCIELDCWKGRPQDEEPFITHGFTMTTEIPFKEVIEAIAESAFKTSPFPVILSFENHVDSSKQQAKMAEYCRNIFGDALLIDPLEKYPLQPGVALPSPQELMGKILVKNKKRHKVAVKGPEGSVKRRVSEQTSNTYSDSSSVCESSATGLPPSESADVSLTLSNGDEKIEEKPPKYTKPRKSIDHDAYSEEEEEEEPSDPKKSDEGTASSEVNATEEMSTLVNYVEPVKFKSFDAAKKRNKYYEMSSFVETKALEQLTKSPMEFVEYNKKQLSRIYPKGTRVDSSNYMPQLFWNAGCQMVALNFQTLDLPMQLNVGIFEYNRRSGYLLKPEFMCRTDKHFDPFTENIVDGIVANTVKIKIISGQFLSEKRVGIFVEVDMFGLPVDTKRKFRTKTSQGNSFNPVWDEEPFILPKVVLPTLATLRIAVFEEGGKFVGHRILPVSAIRPGYHYICLRNELNQPVCLPALLVYTEVNDYIPDDHQGYANALTNPIKHISLMDQRAKQLAALMGENEQPFNKDKIDWDPISKPPIRSRDDTPEKIKIPIIPVPSPPAQRDDHIASVLTDIQAPSMEELKSQKSFEKLICRQYRELRQLRRKHLRKVSSLCKEQSTWVTPLQSLRRRKPFGRSHRGVSGADQDAEQKLMDMQRDQQKRLLELREIQHEQERKLKHSHLLQAVQKLQEVAISYHSTQLKKLKEINEKEKKELQKILDRKRHNSITEAKSRERQKKDVELTEINRRHINESVSSIRRLEEAQKRRQEKLQTAHQETLQRIKDEEPKLQAQLDEACQAEFCQLPQEVRRYLQEDGWVGSGSGPPSSSHSSPPSITRSWGSESGEKDSLHSPGDSSDEATRL

SEQ ID NO: 9747 - DNA, 2627 bp, Homo sapiens (man)
  CDS (95)..(2365)
ttctggtcgcactccgctcggaccccaggccgccggtgctgtcgctactcaagtgagtcccgcggtgcccctcccgccgcgccgcccgacgggcatggactcgggccgggacttcctgaccctgcacggcctacaggatgatgaggatctacaggcgctgctgaagggcagccagctcctgaaggtgaagtccagctcatggaggagagagcggttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggcccaggggagactctgtcggtggatcagttagtgacgttcctgcagcaccagcagcgggaggaggcggcagggcctgcgctggccctctccctcattgagcgctacgagcccagcgagactaccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctcccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatatacccggctggatggagaacagactcctccaactacagccccgtggagatgtggaatgggggctgccagatcgtggccctgaatttccagacacctgggccagagatggacgtgtaccaggaccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaacccagtggggtcccccctgagtgggctgggccctctgtccacatgtggggacagggctggtgtgcctgctcccagcctcttgctcagagctaggcccccaaattgccttcagccctaacatagtgtctgctgctgcctccctggggaccaggagctagcccagtccctggagctgtccttcattccgttaggaataacaatgcagccctctccaccctccggccagcgagtggtcaaggatttttataaaaa

SEQ ID NO: 9748 - protein, 756 aa, Homo sapiens (man)
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGPGETLSVDQLVTFLQHQQREEAAGPALALSLIERYEPSETTKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQDRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 9749 - DNA, 3705 bp, Homo sapiens (man)
  CDS (1)..(3705)
atggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccggtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctga

SEQ ID NO: 9750 - protein, 1234 aa, Homo sapiens (man)
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 9751 - DNA, 4565 bp, Homo sapiens (man)
  CDS (204)..(3197)
gaattccgggcagcatcatcaaggcacatagattctctctttgaacaatgcagctgctgcaggggatggggaagggatggcactggcaattcaagactgcctttcctacttcttcagtgcctctttcaccaatatgaagttaaaaccaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttacaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctcaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtgtgtgtgtggcagagagagagaaagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatacatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggctactctgaaacacactgaaagctctgttgcaattaggatttgatgtgacataatattgttgtataatttcgagatttgtaggaaggtctcattcttccaagctgagagtctagcactcattttctataacagatatggcagcttagaggtgttggctttgtttggatgtaattttaggggtactaaaatttaaaatttaaagataattgttcaacaatatcatatcatcacattgagctgatataaattctgtgggtccgataatatctttgtgataatttaagagctaaccagttaccacacatctatgatataaccctaacacacacagaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctat

SEQ ID NO: 9752 - protein, 997 aa, Homo sapiens (man)
MPSEKKISSANDCISFMQAGCELKKVRPNSRIYNRFFTLDTDLQALRWEPSKKDLEKAKLDISAIKEIRLGKNTETFTNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAQMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEKESSEENGKL

SEQ ID NO: 9753 - DNA, 4344 bp, Bos primigenius taurus (cattle)
  CDS (33)..(3908)
cctgcgccgccgccgcccccggcacccgagccatggcgggcgccgcgtccccctgcgccaacggctgcgggcccagtgcgccctcggacgccgaggtggtgcacctctgccgcagcctcgaggtgggcaccgtcatgactttgttctactccaagaagtcgcagcggcccgagcggaagaccttccaggtcaagctggagacgcggcagatcacgtggagccgaggcgccgacaagatagagggggccattgacattcgtgaaatcaaggagatccgcccagggaagacctcacgggacttcgatcgctaccaagaggatcctgcttttcgaccggaccagtcccactgcttcgtcatcctgtatggaatggaattccgcctgaagaccctgagcctccaagccacgtctgaggacgaagtgaacatgtggatcaggggcctgacttggctgatggaggacacgttgcaggcagccacacccctgcagattgagaggtggctgcggaagcagttctactcagtggaccggaaccgtgaggaccggatatcggccaaggacctgaagaacatgctgtcccaggtcaactaccgggtccccaacatgcgcttcctccgggagcggctgacggacctggagcagcgcaccagtgacatcacctacgggcagtttgcacagctgtaccgcagcctcatgtacagcgcccagaagacgatggaccttcctttcctggaagccagcgccctgagggcgggggagcggccggagctgtgccgggtgtcccttcctgagttccagcagttcctcctcgagtaccaaggggagctgtgggcggtggaccggctccaggtgcaggagttcatgctcagcttcctccgagaccccttgcgagagattgaggagccttacttcttcctggacgagttcgtcaccttcctgttctccaaggagaacagcatatggaactcgcagctagacgaggtgtgccccgacaccatgaacaaccccctgtcccactactggatctcctcctcgcacaacacgtacctgaccggggaccagttctccagcgagtcctccctggaagcctacgctcgctgcctgcggatgggctgccgttgcattgagttggactgctgggacggcccggatgggatgccggtcatttaccatggacacactctgaccaccaagatcaagttctcagacgtcctgcacaccatcaaggagcacgcctttgtggcctcagagtacccggtcatcctgtccatcgaggaccactgcagcattgcccagcagaggaacatggcccagtatttcaaaaaggtgcttggggacacactcctcaccaagcccgtggatattgcagccgacgggctcccctcccccaaccagctcaagaggaagatccttatcaagcacaagaagttggctgagggcagtgcctacgaggaggtgccaacatcggtgatgtactctgagaacgacatcagcaactccatcaagaatggcatcctctacctggaagaccctgtgaaccatgagtggtacccccactacttcgtcctgaccagcagcaagatctactactcggaggagaccagcagcgaccagggcaacgaggatgaggaggagcccaaggaggccagtggcagcacagagctgcactccaacgagaagtggttccacgggaagcttggggcgggccgggatgggcggcacatcgccgagcgcctgctcacggagtactgcattgagaccggggcccccgacggctccttccttgtgcgcgagagcgagacctttgtgggcgactacactctgtccttctggcggaatggcaaagtgcagcactgccggatccactcccggcaggacgcaggcacccccaagttcttcctgacggacaacctcgtcttcgactccctctatgacctcatcacgcactaccagcaggtgcccctgcgctgcaacgaatttgagatgcgcctctcagagccggtcccgcagaccaacgcgcacgagagcaaagagtggtaccacgccagcctgaccagagcgcaggccgagcacatgctgatgcgtgtacccagggacggggccttcctggtgcggaaacggaacgagcccaactcctacgccatctccttccgggctgagggcaagatcaagcactgccgcgtccagcaggagggccagaccgtgatgctgggcaactcagagtttgacagccttgtcgacctcatcagctactacgagaagcacccactgtaccgcaagatgaagctgcgctaccccatcaacgaggaggctctggagaagatcggcacagctgagcctgactacggcgcgctgtacgagggccgcaaccctggcttctatgtggaggcgaaccccatgcccacgttcaagtgcgccgtcaaagctctcttcgactacaaagcgcagcgggaggacgagctgacattcaccaagagtgccatcatccagaacgtggagaagcaggagggaggctggtggcggggtgactacggcgggaagaagcagctgtggttcccttcaaactatgtggaggaaatggtcagcccggcggccctggagcccgagagggagcacttggacgagaacagcccactcggggacttgctccggggggtcctggatgtgccagcttgtcagatagccgtccgtcccgagggcaagaacaaccggctgttcgtcttctccatcagcatggcctcggtggcacactggtccctggatgtggctgccgactcgcaggaagagctgcaggactgggtgaagaagatccgggaggtggcgcagacagcggatgccaggctcaccgagggcaagatgatggagcggaggaagaagatcgccctagagctctcagagctcgtcgtctactgccggcctgtccctttcgacgaagagaagattggcaccgaacgggcctgctaccgcgacatgtcgtccttcccggagaccaaggccgagaagtacgtgaacaaggccaaaggcaagaagttcctccagtacaaccgcctgcagctctcccgcatctaccctaagggccagcggctggactcctccaattacgaccccctgcccatgtggatctgcggcagccagcttgtggccctcaacttccagaccccagacaaacccatgcagatgaaccaggccctgttcctggccggcgggcactgtggctatgtgctgcagcccagcgtcatgcgcgatgaggccttcgatccctttgacaagagcagcctccgcgggctggagccgtgcgccatctgcatcgaggtgctgggggcccggcacctgccgaagaacggccgaggcatcgtgtgtccttttgtggagatcgaggtggccggagccgagtatgacagcatcaagcagaagacagagtttgtggtggacaatggactgaaccccgtgtggccagccaagcccttccacttccagattagtaaccccgagttcgccttcctgcgcttcgtggtctatgaggaggacatgtttagtgaccagaacttcctagctcaggctaccttcccagtgaagggtctgaagacaggctacagagcggtgcctctgaagaacaactacagtgagggcctggagctggcctccctgctcgtcaagattgacgtgttccctgccaagcaggagaacggcgacctcagccccttcgggggtgcgtccctgcgggagcggagctgtgacgcctcgggcccgctgttccacggccgggcccgggagggctcctttgaagctcgctaccagcagccctttgaggacttccgcatctcccaggagcatctcgcagaccattttgacggtcgggatcgcaggaccccacgcaggactcgggtcaacggagacaaccgcctgtagccgtgccacagcctcgcggagagcagcaggcgccgtgccacgcacggaggggggccgtgggctgggctccgggaagtggcgtatggggccgcccttctggcctcgccgcctagagcccagattccagccgtggacactagacgaaaagcacgccattaatgagatgtattcctgttttgggcctccacgccccagctctgggtgaaggcaaaaaactgtactgtctagcctttaagcacacacgcctggccctgccctctggagatggagccttccaccttgggaccactgcggcactgcctctcggagagagaggctgcctcagctgggggcacaggaggctctgaggagccggggacattcctgagaggggcggaacagcagtagccttgctgggctcgggagtcaacgtttaaagctgcaggactgtgtaaac

SEQ ID NO: 9754 - protein, 1291 aa, Bos primigenius taurus (cattle)
MAGAASPCANGCGPSAPSDAEVVHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIRGLTWLMEDTLQAATPLQIERWLRKQFYSVDRNREDRISAKDLKNMLSQVNYRVPNMRFLRERLTDLEQRTSDITYGQFAQLYRSLMYSAQKTMDLPFLEASALRAGERPELCRVSLPEFQQFLLEYQGELWAVDRLQVQEFMLSFLRDPLREIEEPYFFLDEFVTFLFSKENSIWNSQLDEVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVDIAADGLPSPNQLKRKILIKHKKLAEGSAYEEVPTSVMYSENDISNSIKNGILYLEDPVNHEWYPHYFVLTSSKIYYSEETSSDQGNEDEEEPKEASGSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFTKSAIIQNVEKQEGGWWRGDYGGKKQLWFPSNYVEEMVSPAALEPEREHLDENSPLGDLLRGVLDVPACQIAVRPEGKNNRLFVFSISMASVAHWSLDVAADSQEELQDWVKKIREVAQTADARLTEGKMMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFLAGGHCGYVLQPSVMRDEAFDPFDKSSLRGLEPCAICIEVLGARHLPKNGRGIVCPFVEIEVAGAEYDSIKQKTEFVVDNGLNPVWPAKPFHFQISNPEFAFLRFVVYEEDMFSDQNFLAQATFPVKGLKTGYRAVPLKNNYSEGLELASLLVKIDVFPAKQENGDLSPFGGASLRERSCDASGPLFHGRAREGSFEARYQQPFEDFRISQEHLADHFDGRDRRTPRRTRVNGDNRL

SEQ ID NO: 9755 - DNA, 2700 bp, Schizosaccharomyces pombe
  CDS (1)..(2700)
atgaattgtgaaatggtaacgtcgcctgaatcggtcaacttaggagactccaacagagcagtaagtccattttgcctgcccgattgctcagaaaacgcagttgctcagacgaggagtaaaaccttagataatgctgctttggatctcccatatgttggcaataggaagaaatcggagcaggatttctttaagatgctatcatcaagggatcgcgatgctcatagtactctacgtaaacgatcaaattctttatcttcttttctgagtacgaaatcgacatcagcttcagaaaataaattccatggaggattgaattggctttctctgaagttaaatcttttgctacgcttgcaaggtcgaatgaattctgcgagaacaaatacttcaatgaacccttactcatgcgatagtaacgaaaacttatctactctgagctcggtgaatcaaaactttaattctcgacagctattagctactatagtccctgaatctattcaaaacggatgctctttacttcgtataaccaagaaaaaggtgcgccaacgtaaagtctctttagaccctatatctggatatcttatgctggacaagaatactggtaaagcttataagaagctttgtgttgatgacattaaagaaattcgacagggccgcgatgctcgtaattatagagaacagtacaaaatttcttctgagaacgagaaacgctggttcacaattatatattgtgctgataataaattaaaggctatgcatatgatatctccaactttagatgcgcataatcaatggattatggctttagaaggtctaaaaacttatcgattgaatgaatttattattggacttaatctcgtttgccatcaaggtgaaaaaatgatagattattcagagaatttaaatccctgggaaaagttagaaaaggagcaaagtgcacagttggatctaggagacgtgcatcgcatgtgccaaatgctacatttgaatgcatcaatggagtttttagaagaaacatttcaaaaggcagatgctgatcattctggaaagctaagttttgaagaatttcagcattttgtaagccttttaaaaacaagatccgagattgtagatatttttaaagaatatacatctggctctgacaagatgtctttggaacagtttcgtcactttctatcaacttctcaaaaggctcgtttggatagtgactcaattaggactttgtatgtctctttttgctcaaatgatgattcaaaaatgggtttgatagaatttacttcctttctactttctcctcataattctccagtagttcctgtgatacaagatatgtcgcgaccactgaatgaatacttaatttcttcgtcgcataacacttatttactaggtaagcagtttggtggagaaagttcaattgaaggttatatccgttcgctacagcgtggctgcaagtgtattgaaatcgattgctgggatggaccgaatggtcctgtagtttgtcatggacatacatttacttctatgataaaatttaatgatgttattgatgctatacgaaaatatgctttcgtcgtttcaccttatccattattcatttctttggaaattcattgctgccctgaccaacaacgtcaaatggttagttacatgaaacaagcatttggggatactttggtgatgaaacccgttaccgctaacgaatcagttcttccttcacccgaagatttactgaacaaaattttgctgaaagtcaaatgttcagcaacaccattgcaccaattttcgacagacatactgaaggttgggataactgattcttcgactgatactaccgaatcatcggagctagaaaattcagaattaacagggttaaggaaaggtaaaagacggatgaaaaatatcattgtgcaggaattgcaacagcttgcaccttatgcccgatcattgaaatttcgaaatttttctttaccggaatcaaaaacgtatagccacatattctcattttcggaaaggactataaaaaagcatggaaaagctatggttccaagacttagcaaacataatttacgctatttgtgtcgtgtataccctggcccattgagagtaggaagtacaaattttaatcctcaggtgtattggcgcctgggtgtgcaaatggttgctctaaactggcaaacttatgatacaggtcttcaaataaatgatgctttgtttatagctgatcctccgactgggtacttgttaaagccaccttgtcaacgaataattggtacaacagttggcgaagaaggacttcctcgtaaaataaaattaacaatagatgtcatatctgggcaacaacttagaagagctagagaactttctaattctgaaactctcagcccttatgttgagatccaagttcattcaatggaagaatctccttttcgttggtgttccaaagttgtgcacgaaaatggatttcgacctttttggggagaaaccatggtttatgagagtataattagtgatgacttttattccatgatccgatttctcgtccatcatcgaggaagtaatggaaatgactctatatttgctaattttacttgtccgattgacagactgcaacaaggctatagacatattcgtttattggatatgcaaggcgaaaatttgttattttcgagtttgtttttgaaaattaaaaaagaagacatttag

SEQ ID NO: 9756 - protein, 899 aa, Schizosaccharomyces pombe
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQRGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 9757 - DNA, 5233 bp, Rattus norvegicus (Norway rat)
  CDS (467)..(3757)
aggcagccgccgccgcacttcctgaggccgccgctccgcgtcggcgggcaggtggctggtggccggtccgcagtcgccgctcgggccgcgcgcgtccaggcttcggagggttcggaggctccgggctccggcgcccgctgtcttttgtctgcgcagagccggcgctcgcctcccctcgccggtacctcccgctgcttttcgcctgcttctccctcccgctcacatcttctccccgcccccgccgccggtccgcgccggccgctgacctcctggaccacagcccgaggacgcctctgcccgagtgatgtctcctctctacaaagttgcggccgccgctgcagccgccgtcgcgcgctgaaacaaagtctagcggcgtttccttctggtgcctgagcgcacccttactcagggctggacgccgctggcggtcgtgctgtctcgccgggagcctagaacgtgcttggccatggctgagggcgcggctagcagggaggctccggcgcctctcgacgttgcggggggcgaagacgaccctcgagccggcgccgatgctgcctccggggacgctgcacccgaggcctcggggggccggatgagggaccgtcgcagcggggttgcgctgccgggcaatgcgggggtccccgcggatagcgaggctggcctcctggaggcggcacgagcgaccccccggcgcacgagcatcatcaaggatccttcaaaccaaaaatgtggtggcagaaagaaaacagtgtctttcagcagcatgccatcggagaagaagattagcagtgcccatgactgcattagcttcatgcaggctggctgcgagctgaagaaagtgcgaccgaactctcgcatctacaaccgatttttcaccctagacactgacctccaggctctacgctgggaaccttccaagaaagacctcgaaaaagccaagctggacatttctgccatcaaagagatcaggctggggaagaacacggagacattcagaaacaatggccttgctgaccagatctgtgaagactgtgccttctccatactccatggggaaaattacgagtctctggacctagttgccaattcagcagatgtagcaaacatctgggtgtcggggttacggtacctggtctctcgcagtaagcaaccacttgactttatggagggcaaccagaacacaccacggttcatgtggctgaaaacggtgtttgaagcagcagatgttgatgggaatgggattatgttagaagatacctcggtggagttaataaaacaactcaaccctactctgaaggaatctaagatcaggttaaagtttaaagaaatccagaagagcaaagaaaaactaactacccgggtaacagaagaggaattctgtgaagcgttctgtgaactttgcactagaccagaagtgtatttcttacttgttcagatatctaagaacaaagagtatctggatgctaatgacctcatgctctttttagaagttgagcaaggggtcacccatgtcactgaggatatgtgcttagacatcattaggagatacgaactttctgaagatggccgccagaaaggcttccttgcaattgatggctttacccagtatttattatctccagaatgcgacatttttgatccagagcaaaagaaggttgcccaagacatgacccaacccttatctcactactatatcaatgcgtcccataatacctacctgatagaagatcagttcagggggccagctgatatcaatgggtatgtgagggctttgaagatgggctgtcgaagcattgagcttgatgtaagtgacggtccagataatgaacccatcctgtgcaataggaacaacatggccatgctcctttcctttcgaagtgttctggaggtgataaataagttcgccttcgtcgcttcagagtacccactcattctctgcttggggaatcactgttccctgccacagcagagggtcatggttcagcagatgaaaaaggtgtttggcaataaactttatacagaagcacctctgtcttcagaatcctacctcccgtcgcctgaaaaactaaaacatatgatcattgtgaaaggaaagaaattgccttcggagtcagatctgttagagggagaagtgaccgacgaggatgaagaagctgagatgtcccggagggtgtcgggagattacaacggtgagcagaaacatatctggctctgccgagagctctctgacttggtatccatctgtaaatccgttcagtacagggattttgaactgtctatgaaaacccagaactactgggaaatttgttcatttagtgaaacattggccagccggatcgcaaatgagtatccagaggatttcgtgaattataacaagaagttcttatcaagggtctaccctagtgccatgaggatagattccagtaatttgaacccacaggacttctggaattgtggctgtcagattgtggcaatgaattttcaaactcctggtccaatgatggacctccacaccggctggtttcttcaaaatgggggctgtggctacgtcctcaggccatctatcatgcgagatgaagtttcgtactttagtgcaaacacaaagggcattgtccctggagtgtctcccctgcttcttcacatcaagatcatcagtggtcagaacttcccaaagcccaaaggagcttgtgccaaaggggatgtcatagacccctacgtttgtgtagagattcatggaattccagctgattgctccgagcaaagaactaaaactgtacaacagaacagcgataatcccattttcgatgaaactttcgagtttcaagtcaaccttcccgagctgaccatggtccgttttgtcattttggatgatgattacattggagatgagttcattgggcaatacacgataccgtttgaatgtctgcaacctgggtaccggcatgtccccttgcgctcctttgtgggggatatcatggaacatgtgaccctttttgtccacatagcaataaccaatcggagtggcggaggaaaagcgcagaagcgaagtctttccgtgagaatggggaagaaagttcgagaatacaccatgctcagaaatatcggtcttaaaaccatagatgatatcttcaaaatagcagttcatcctttgcgagaagccatagatatgagagaaaacatgcagaacgccatagtgtctgttaaggagctgtgtggactcccaccgattgccagtctgaaacagtgcctgttaaccctgtcctctcgtctcatcaccagtgatagtactccctccgtgtctctggtgatgaaggactgctttccttacctggagcctctgggcacaattccagatgtgcagaagaggatgctggctgcatatgatctgatgattcaagagagtcgggtcctcatagaaatggctgacacagtccaggaaaaaattgtacagtgtcagaaagcagggatggaattccatgaagaacttcataatctaggggcaaaggaaggcttgaagggaagaaaactcaacaaggccatcgagagcttcgcttggaatattactgtattgaagggacaaggagacctgctgaagaatgccaagaatgaagccgtagagaacataaagcagatccagctggcctgtttgtcttgtggactgagtaaaggccctggcagcgctgcagaggccaagggcaagcgcagcttggaagccatagaggagaaggaaagcagtgaagagaacgggaagttgtgagctgggcagtgcgcaggcccttgtccaacactctggtttctcattcttctcgttttgttttgtttttacattcttcagatgttcacagaaatgatgccctttgcggggtgttgtacataaacatatattttcacagtgtcagtattttactgtagttaatttatctaagttaaaacttttagtagcagtgttttaaactttgagctgtgagtatatacttacatgtggctgcctgtgtgtgtgtgtgtgtgtgtgtttgtgtgtgtgtgtgtgtgtgtgtgtgtgtgtgtgagagagagagagagagagagagagagagagagagagagagagagtaagagttcctgttaaaatattctctgtcgcattgttggttttaataagttattcttttatctttaagatcatttggggatagttgataatctgaattctaatgagcatttattataaccccttgctgtcgttagttttacctctctgcctttgtcatataatttggagatctcagcacagcttatgattgaagaaaaccaaatttataagagcaaaggcgttttatagattacatagagatttaaaagttcctaaacattacattagaaatgaaagtgaatagaaaaatcttttaaaatcataattctggaaagataaacaaattcatttcttcattagcaaaatctttgagatatttattaactaaaatcacatttaggaagtttctgtagctgtttactgagcatgtggtttcggtagaagagctgagtgcagagaacctgtagccactgggcagtactttgaagcccactaaatgctctactgaactagcactgttgatgtgaccataacactcagttgtgcaatttcaaggtttgcagaaagacctcattctcctgggccgggagtatggaattcattttctattaccagtggtgggcagatccaagtgcttggccaggactagatctagtatagattactaaatttaagtgtcaacaccttgttaaaataatatattatcatgttgagctggcataaattctgtaagtccgataacatctttctgatgatttgagaactaactaattagacaacatgtatggtataattttaaaacatacagtaaaaaccaagagcaagtggctaattagggtacatttataattatatctagataatcttaccctaatgtcttcataaacttcttaaatgtcatgttcattcattaccaccaacagaactaaatgttctatgattatgaaagaatatatttgtttaaaacattgcttttattttgaaaagcttcttaattaatttgattaacaaatatattaatttgggggagcctagagaagataatcattgaaattttgcaaatataaacatcctctacagctactatgttatttctgactgttcttaatactactctgttcttgtcgcacattaccaaaagagtaaagatactgaaaacag

SEQ ID NO: 9758 - protein, 1096 aa, Rattus norvegicus (Norway rat)
MAEGAASREAPAPLDVAGGEDDPRAGADAASGDAAPEASGGRMRDRRSGVALPGNAGVPADSEAGLLEAARATPRRTSIIKDPSNQKCGGRKKTVSFSSMPSEKKISSAHDCISFMQAGCELKKVRPNSRIYNRFFTLDTDLQALRWEPSKKDLEKAKLDISAIKEIRLGKNTETFRNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKESKIRLKFKEIQKSKEKLTTRVTEEEFCEAFCELCTRPEVYFLLVQISKNKEYLDANDLMLFLEVEQGVTHVTEDMCLDIIRRYELSEDGRQKGFLAIDGFTQYLLSPECDIFDPEQKKVAQDMTQPLSHYYINASHNTYLIEDQFRGPADINGYVRALKMGCRSIELDVSDGPDNEPILCNRNNMAMLLSFRSVLEVINKFAFVASEYPLILCLGNHCSLPQQRVMVQQMKKVFGNKLYTEAPLSSESYLPSPEKLKHMIIVKGKKLPSESDLLEGEVTDEDEEAEMSRRVSGDYNGEQKHIWLCRELSDLVSICKSVQYRDFELSMKTQNYWEICSFSETLASRIANEYPEDFVNYNKKFLSRVYPSAMRIDSSNLNPQDFWNCGCQIVAMNFQTPGPMMDLHTGWFLQNGGCGYVLRPSIMRDEVSYFSANTKGIVPGVSPLLLHIKIISGQNFPKPKGACAKGDVIDPYVCVEIHGIPADCSEQRTKTVQQNSDNPIFDETFEFQVNLPELTMVRFVILDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSVKELCGLPPIASLKQCLLTLSSRLITSDSTPSVSLVMKDCFPYLEPLGTIPDVQKRMLAAYDLMIQESRVLIEMADTVQEKIVQCQKAGMEFHEELHNLGAKEGLKGRKLNKAIESFAWNITVLKGQGDLLKNAKNEAVENIKQIQLACLSCGLSKGPGSAAEAKGKRSLEAIEEKESSEENGKL

SEQ ID NO: 9759 - DNA, 3354 bp, Loligo forbesi (northern European squid)
  CDS (585)..(3212)
cttttttatccaaactacaacgctttctttttttttaaaattggagtgtgtgactgcttcttgctttgtgtaaattacattccaaagcagaaaaggaaggacggtacttctggttgacccgggtttaaaaaaaaaaattactcccgtgaatatacagtcacccaaaacaagcgcacaaaattatatatatccctctttctttcagtttctctctctatctttcatttttaacttatttaaatcattttattttatcacctccacttagaccttacacatttttttaaaagtttacacacaaaaaaacaattttaaaaaaaccttttcaggaagtcgcccttttctttcttttttcaccaagacatttttttttttttgcaaaagaatttaaaaaaaaaagaatctctaagcagggaaaaagtgatcgtttggtttttttttttttttaccaaagaatgattttttaattctaacgattgaaagaaagaacaacaaacacaagaggagtgattgctcaaaaccttatgtggatttcttttccgaaataaaagtcttcaaagtcttgtgagcgaaataatctcaccatggcgggagtagaaactgcggtgcgacaaattgaattaaaatggcccaacgtacctgagcagataattaaaggtgataaatttctgaaatgggaagagggttcatcaagttttactgaaatccttcttagagttgaccccaagggatatttcttgtactggaaaattgaaggaaaggaagacactgaactcttggatttggcttatctccgagatatccgagctggaaaatatgcaaaacctccaaaggataagaaaataaaagaagctggcacaaattatggttcgtcaaacataccgcttcaagataaatgtgttacaatttgtcacggctataactacatagatttggaatggatacatctggttgcagaaaattcttctgtagcatcgaaatgggcagaagaagtgttcagttacgcctacaacttgttatccctcaacaaaaaccaattgggtgaatgggagaaactctatttccgattcaccacggttgaaatggaaaaaaataaaatcccagtaaaaactattcaaaaatgtctttccaaagacaaagatgacagagcaagagttgcaaaagcaattgaaaaaattggttggccttctggaaagaacgatgccattgagatcaaagcctttgattttgataccttcttcaagttttacctttccctccttgaacgatctgaaattgagggtatcttcaaagagctatcccagaataaaggcaacatcacaaccgttatgttccgagatttcttaaatgatatacagagacatccaagtttgcataagacacttttcccactttacaccgattcccagtgtgaagcattaatcaacgaatatgaaagtgctgtcaacaaaaagggaaaaaaaaaaggacaacttaccaaggaaggcttgctctatttccttatgtgtgaagaaaacaatctcacacctatgcatcgattggatttgggcgccaacatgaaacttcccctggcagcttattatattaattcatcccacaacacttatttgactggtcatcaattgactggcaaatcatccgttgaggtttaccgccaagttttactgactggatgtcgaagtttggaattggattgctgggatggaaaagatggggaaccaatcattactcacggtttcactatgtgtaccgaagttttgttcaaggatgtggtcaccgcaattggagagagtgcctttaaagtgtctgattacccagtaatcttatcatttgaaaaccattgttcagtacctcaacaaaagttacttgcacaatactgtcatgaggctttcggagatctgcttctcgacaaagctatcgatggacaccctcttaaaccaggtatttctttaccaacaccctacgacctgagaaagaaaattcttatcaagaacaagaaaattcacaaaggtgctggggatgatgacgaattggcaggactgacagaagaagagaagaagaaaattgaaaaagaaaagaaagatgccggaactgcagccaaagaagctgaagcagccgaagaaatgtcagcccttgtgaattacattcaaccagttcatttcacaacatttgaacaagcccaaaagaaggacagacattatgaaatgtcttccatggtagaaacccaggctttgaataaactggaagataatcctgaggactttgtagattataacaagaaacaactgaccaggatttaccccaagggtaccagagtggactccagtaactatgtaccccagatctattggaacgccggttgtcaattggtagccttaaacttccaatgctttgacgttgccatgtgtgtcaatctgggtgtatttgaatacaatggatgttcaggttatttactcaaacctgaatttatgagaaaactggacaagagatttgaccctttcacagaatccactgtcgatggtgttgtagcaggaactattgaaattaagatcatctctgctcagttcttatccgataagcagatctcatcctatgttgaagttgagatgtatggtttgccaactgacacagtgaggaagaagtttaaaacaaaaactgttaataacaatggaatggatccttactataatgagaacactttcgtattcaagaaggttgtattgcctgatttagccgttgtccgcgtcattgtaaatgaagataatggcaaattcatcggacatcgtctcatgcctctggatggtatcaaaccaggttacaggcatattccccttcgaaatgagagcaacagacctctcggtttggcttcagtgtttgcacacattgttgccaaggattatgtatcagatgcattcgcagattttgctgatgccctgctcaatccaattgcttatcaatctgcacaagaagcaagatctgctgccttgtgcgcttttgaagatgatccagacgcagccttagatgctgctaaaccagtaaaaggaaagagccctaaggctggtaaaaaggcatggggagcagcaggaaagaaggtcagtcatggtaatattgccaaagctgctatgactggaggagccaaaaaacctgcaggtggaggagctggaaaaagcagctacgcctgcaagtccaccaccacccccagcagcagctgattctgaatttattgccaattcaaagatgaaggaggaatcggctgtcactctgcccaaattggatgccttaaaacaaaacaaagcttataccaaaattatttcaaaacgagataaagaagttgattctatcaaaaaaaaaaaa

SEQ ID NO: 9760 - protein, 875 aa, Loligo forbesi (northern European squid)
MAGVETAVRQIELKWPNVPEQIIKGDKFLKWEEGSSSFTEILLRVDPKGYFLYWKIEGKEDTELLDLAYLRDIRAGKYAKPPKDKKIKEAGTNYGSSNIPLQDKCVTICHGYNYIDLEWIHLVAENSSVASKWAEEVFSYAYNLLSLNKNQLGEWEKLYFRFTTVEMEKNKIPVKTIQKCLSKDKDDRARVAKAIEKIGWPSGKNDAIEIKAFDFDTFFKFYLSLLERSEIEGIFKELSQNKGNITTVMFRDFLNDIQRHPSLHKTLFPLYTDSQCEALINEYESAVNKKGKKKGQLTKEGLLYFLMCEENNLTPMHRLDLGANMKLPLAAYYINSSHNTYLTGHQLTGKSSVEVYRQVLLTGCRSLELDCWDGKDGEPIITHGFTMCTEVLFKDVVTAIGESAFKVSDYPVILSFENHCSVPQQKLLAQYCHEAFGDLLLDKAIDGHPLKPGISLPTPYDLRKKILIKNKKIHKGAGDDDELAGLTEEEKKKIEKEKKDAGTAAKEAEAAEEMSALVNYIQPVHFTTFEQAQKKDRHYEMSSMVETQALNKLEDNPEDFVDYNKKQLTRIYPKGTRVDSSNYVPQIYWNAGCQLVALNFQCFDVAMCVNLGVFEYNGCSGYLLKPEFMRKLDKRFDPFTESTVDGVVAGTIEIKIISAQFLSDKQISSYVEVEMYGLPTDTVRKKFKTKTVNNNGMDPYYNENTFVFKKVVLPDLAVVRVIVNEDNGKFIGHRLMPLDGIKPGYRHIPLRNESNRPLGLASVFAHIVAKDYVSDAFADFADALLNPIAYQSAQEARSAALCAFEDDPDAALDAAKPVKGKSPKAGKKAWGAAGKKVSHGNIAKAAMTGGAKKPAGGGAGKSSYACKSTTTPSSS

SEQ ID NO: 9761 - DNA, 4819 bp, Meleagris gallopavo (common turkey)
  CDS (362)..(3997)
tctgaacagcgcgctttgcaacggagctctgaggagcagatccctcctggaggggacagagtgtgtgcatgtgtgaccacacgggcatctccactcgtcgcaagctttccctccaggtgacctcgtgcctgtttggagagctgttgatttacaatgcagattcatctgtcctcgcctgtttgttgttgcctctcctgaatttgactgggacataagaggctgtttgctctctgatgccaacactggcgatggcagagagccctgccatgtgagaggcagagatagaggagagggggtgaaggaggagtaaactgtgtgactcctattgcttctggtagctgaggagcacatctacaggacaatgtcaatgcttactcctgtcctgcagcccccagaggtgaaggagtatctgtccaggggcgagcgcttcatcaaatgggacgatgaaacagcaagtgcttctcctgtgattcttcgggtggatccaaagggcttttatttatactggacgtatcagaacaaggagatggaaattctggatataaccagcatccgagatacccgagtagggcgatttgccaaaatccccaagtgccagaagctccgcgaggtttttaacttggattaccctcacagcacctttctgctgaaaactctgacgattgtatctggccctgacatggtggacctcactttccataactttgtgtcctacaaggagaatgttggcaagagctgggctgaggatattatggccattgttcagaatcctctcacatacaacgcttcccggtacaccttcctagagaaaatcctggtgaagttgaagatgcagctgaatgcagagggaaagattcctgtcaggaatatttttcagatgtttcctgcagacaggaagagggtggaagcagcattaaatgcttgtcatcttccaaaaggcaagaatgatgccatcaacccagaggacttccctgagactgtgtataaaactttcctcatgaatctgtgtccacggcctgagattgatgagatatttacttcacaccatttcaaagcaaaaccctacatgaccaaagaacacttggcaaagtttatcaacaagaagcagcgagactctcgcctcaatgacatccttttcccaccagcaaaacctgagcaggtgcagagcctgatagagaaatatgagcccagcgtcattaacatccagagagggcagttgtctccggagggaatggtctggtttctctgcggccctgagaacaatgtaatagcactggacaaattggtgctgtatcaggacatgacacagccactctcacactacttcatcaattcatcgcacaacacttatttaacagctggccagttttctggtatctcatctcccgaaatgtaccgtcagacgctgctagctgggtgtcgctgtgtggagctggactgctggaagggccgtcccccagatgaggagcccatcatcactcacggattcaccatgacaactgaaatcctcttcaaggatgcaattgaggccattgcagaaagtgctttcaaaacatctctttaccctgtcatcctctcttttgagaaccacgtggactcgcccaagcagcaggcaaagatggctgagtactgccgaaccatatttggagatatgctgctgacagagcctctggagaaatacccactgaagccaggagttcctctgccaagtcctaaggatctcttagggaaaatcctaattaagaacaaaaagaaacagtttgtatctgagaagaggcagagttctatgaagaagggaaagaacgtggaaccagaaatcattgagcagccagcttttaccgatgctgaagatactgtctgggcaggtgatgtggctgaggaagaaccagaggaagaggatgatcagctaggaaacctggatgaagaggaaatcaaaaagatgcagtcagatgagggcactgctggtttggaagtaacagcgtatgaggaaatgtccagcctcgttaattacatacagcccatcaaatttgactcctttgaagtctctgcccagaagaaccggagttacgtaatttcttccttcactgagctgaaggcttatgatctgctgaccaagttccctatgcagtttgtagaatacaacaaacgccagatgagccggatttaccccaaaggcacccggatggactcctcgaattacatgccccagatgttctggaacgttggctgtcagatggtggcactgaacttccagaccatggatgttcccatgcagcagaacatggctctgtttgagttcaatggccagtgtggctatctgctcaagcacgaattcatgcggcgtccagacaagcaatttgaccctttctcagtggaccgcattgatgtggtggtggcaagcacagtgtctgtcacgatactttctggtcagttcctctcagaccgcagtgtgaagacatatgtggaagtggagctgtttgggttgccaagggacacgaagcgcaaatacagaaccaaactgacctccactgccaattccataaatcctgtttggaaagaagaaccttttgtttttgaaaagatcgtgatgcctgagctggcatcactcaaaattgtggcttttgaggaaggagggaagttcattggtcaccgtgtcattcccattattgcagtgcactcaggctatcaccatgtttgtctccgcagtgaaagtaacatgccactcaccatgccctctctatttgtgtacctggaagtaaaggattacgtccctgatgcctgggcagatctgactattgctctctccaacccaattaagttcttcaatctgcaagaaaagagatcagttaatctaaaagatggctcagaggtggagaggcctgacatgcagaggaacttttcatttcctgaaaataatgggataccagaatccaccaggatattcagcactccttttgcaaacgggcctgcaggagcagcagctctggtcaaggatggaaacatgaaggaagtgacacagcttccagagcctcagacagccagccttgcagaactgcagcagatgaagctgttcctgaagctgctgaagaagcaggagaaagagctgaaggagctggagcggaagggaagtaaacggagagaagagttgctacagaaatactctgttctctttttggaacctgtctaccccagaggcaaaaaaagatccatgcactccaggaaaacccagaagaagaggagtttgacgacaggtgatgttggtacctgcatgcaacctgtagaaatggcagaaaagcttgatagccaagttgtggaactgaaagagaggctggagatggagcttatccacctgggggaagaataccatgatggaattcgaagaaggaaagagcagcatgccacagagcaaacggccaagattacagagctagccagagagaagcagatagctgagctgaaggcactgaaggagtcatcagaaagcaacattaaagacattaagaagaagctggaggcgaaacgattagacagaatccaagtcatgatgaggagtactagcgacaaggctgctcaggagaggttgaagaaagaaattaataactctcacatccaggaagtggtccaaacaatcaaactgctgacagaaaagacagccaggtatcagcagaagctggaagagaaacaggcagagaatctgagagcaattcaagagaaagaaggccagctccaacaggaggcagtggcagaatacgaggagaaattgaaaactctgactgtggaggtgcaggagatggtaaagaactatatgaaagaagtctttcctgatgggccagagattcaaaaggaagcagttctgagcattcctgtagaagaacaaggttctacaaagcaactggaagagaagatcccaggggcagaggtgccaagactgacagcagctacgactgagcctccaggagctgaaacagacatcaatattgaggaaagcatactgtgagcaatgcttcccttgctgttccacttcagacatgtttatggacatgtgtagtgatgttaaagaccagcttgacaaactactctttctttccatgctggataactcctgaaatccttcaggaatttactactttgtcattctaggaattggaaacagtctgaggagctcaccttcagcgagtacttcactctccttagcactaaggtgtatttcaccagcggagctgaagacaagctggttgttgacactgacaacagcatctacattaatattttggcctgggttcagttgccagttttcaaagcaagatccctcattgcccattatgttcacatcatagcaatctcagaactagatccctctaaacaaaacataactctccaacagttcactgacagtgctcaaccagctgagagccagcctggaaaaaagcccctgaactgcatgcagtggaagtgccagaggctcaggagaaactgttgctcccgaaagtggcattccacctggcaacagtaccttctaacaggtttctgtcttttctggaaaagtgagctcaatcgtggtgaacctacagcatgcagtggttgtcacatgagagctgttacacctcgaaactgcactggggaatgcatcgtgaagtgctgctataaaaaccagctcaagtaggtatgagatgagatgtttcaaacctggtctggcatgcaagaagagaccatacctccctgtgatgttaacttcgtactggaatagtgtattgtacattgctgatgtatttattttctaaaataataaaacactgcttaccaaaaaaaaaaaaaaaaa

SEQ ID NO: 9762 - protein, 1211 aa, Meleagris gallopavo (common turkey)
MSMLTPVLQPPEVKEYLSRGERFIKWDDETASASPVILRVDPKGFYLYWTYQNKEMEILDITSIRDTRVGRFAKIPKCQKLREVFNLDYPHSTFLLKTLTIVSGPDMVDLTFHNFVSYKENVGKSWAEDIMAIVQNPLTYNASRYTFLEKILVKLKMQLNAEGKIPVRNIFQMFPADRKRVEAALNACHLPKGKNDAINPEDFPETVYKTFLMNLCPRPEIDEIFTSHHFKAKPYMTKEHLAKFINKKQRDSRLNDILFPPAKPEQVQSLIEKYEPSVINIQRGQLSPEGMVWFLCGPENNVIALDKLVLYQDMTQPLSHYFINSSHNTYLTAGQFSGISSPEMYRQTLLAGCRCVELDCWKGRPPDEEPIITHGFTMTTEILFKDAIEAIAESAFKTSLYPVILSFENHVDSPKQQAKMAEYCRTIFGDMLLTEPLEKYPLKPGVPLPSPKDLLGKILIKNKKKQFVSEKRQSSMKKGKNVEPEIIEQPAFTDAEDTVWAGDVAEEEPEEEDDQLGNLDEEEIKKMQSDEGTAGLEVTAYEEMSSLVNYIQPIKFDSFEVSAQKNRSYVISSFTELKAYDLLTKFPMQFVEYNKRQMSRIYPKGTRMDSSNYMPQMFWNVGCQMVALNFQTMDVPMQQNMALFEFNGQCGYLLKHEFMRRPDKQFDPFSVDRIDVVVASTVSVTILSGQFLSDRSVKTYVEVELFGLPRDTKRKYRTKLTSTANSINPVWKEEPFVFEKIVMPELASLKIVAFEEGGKFIGHRVIPIIAVHSGYHHVCLRSESNMPLTMPSLFVYLEVKDYVPDAWADLTIALSNPIKFFNLQEKRSVNLKDGSEVERPDMQRNFSFPENNGIPESTRIFSTPFANGPAGAAALVKDGNMKEVTQLPEPQTASLAELQQMKLFLKLLKKQEKELKELERKGSKRREELLQKYSVLFLEPVYPRGKKRSMHSRKTQKKRSLTTGDVGTCMQPVEMAEKLDSQVVELKERLEMELIHLGEEYHDGIRRRKEQHATEQTAKITELAREKQIAELKALKESSESNIKDIKKKLEAKRLDRIQVMMRSTSDKAAQERLKKEINNSHIQEVVQTIKLLTEKTARYQQKLEEKQAENLRAIQEKEGQLQQEAVAEYEEKLKTLTVEVQEMVKNYMKEVFPDGPEIQKEAVLSIPVEEQGSTKQLEEKIPGAEVPRLTAATTEPPGAETDINIEESIL

SEQ ID NO: 9763 - DNA, 2164 bp, Arabidopsis thaliana (mouse-ear cress)
  CDS (175)..(1920)
aaaaaatctctttgtctttgcagatgcgacacgcaaaacgacgattctgatctcgcttgtctgatttcaaaaacaatgagaagatagttctgattatataacacacaaaccctacttcattccttcatcatcgtctccaatcattacccaaagatccgtctttttctttacttcatgtcgaagcaaacgtacaaagtgtgtttctgctttcgccggaggtttcgttacactgcatcggaggcaccgcgtgagatcaagaccattttcgaaaagtactcagagaatggagttatgaccgttgatcatctccacaggtttctgatcgatgttcagaaacaagataaagccaccagagaagatgcacagtcaattatcaattctgcatcttctcttcttcatcgtaatggtctccatcttgatgctttcttcaagtacctctttggtgataataaccctcctcttgctctccataaggtgcatcatgacatggatgctcctatatcgcattatttcatattcactggtcataattcttatctgactggtaatcagctgagcagtgactgtagtgaggtacctattattgatgcgttgaagaaaggtgttagagtcattgaattggatatatggcccaattccaacaaagacgatattgatgttcttcacggaatgactctcactacacctgtggggttgatcaaatgtctcaaagctatcagagcacatgcctttgatgtatctgactatcctgttgttgtaactcttgaagatcatcttactccagatcttcagtctaaagttgctgagatggttactgagatatttggggaaattctgtttactcctcctgtgggagaatctttgaaggagttcccatcgccaaactctttaaaaagacgtattatcatctcaaccaaacccccaaaagagtacaaggaaggaaaagatgtggaagtggtgcagaaaggtaaagacttgggggatgaagaagtttggggaagagaagttccgagctttattcagaggaacaaaagtgaagctaaggatgacttagatggaaatgatgatgatgacgatgatgatgatgaagacaagtctaagattaatgcaccaccccagtataaacatttgattgcaatccatgctgggaaaccaaaaggcggaattactgagtgtttaaaggtagatcctgacaaggttagacgccttagcttaagcgaagaacaacttgaaaaggcagcagaaaaatatgcgaagcagattgtgaggtttactcagcacaatttgctgaggatatacccaaaaggaactagagtcacatcatcaaattacaacccgttggttggctggagccacggtgctcaaatggtggctttcaatatgcaggggtatggaagatcattgtggctaatgcagggaatgtttagagccaatggcggatgtggctacatcaagaaacctgaccttctgctgaaaagtggttcggatagtgacatatttgacccaaaagctactctacctgtgaaaacaacacttagggtaactgtatacatgggagaaggctggtactttgatttccgccacacacactttgaccaatattcaccgcctgacttctatacaagggttgggatagctggagttccaggggatacagtaatgaagaagacgaaaacactggaggataattggataccagcttgggatgaggtgtttgagttcccattaaccgttccagagctggccctgctacgattagaagtgcatgagtatgacatgtcagagaaagatgattttggaggacagacatgcttaccggtttgggagctaagcgaaggaataagagcatttcctttacatagccggaaaggagagaagtacaaatccgttaagcttctcgtgaaggtggagtttgtgtgagacatgattaagaaagatacagcatttaaacttgtctggtaggtttgagtgccacagagtttgtgaatttggaggatttgtatgtgtgagagagaatgtatgcttgatttgttgtttgtaatattatgtacataaaagacgaaagtgagagagagagagacggtcttgtatcgtgtgttgttgtattattatgtagtagtctcgtgtaacacttgaatcgtatgatgatttgtggtttttgtgt

SEQ ID NO: 9764 - protein, 581 aa, Arabidopsis thaliana (mouse-ear cress)
MSKQTYKVCFCFRRRFRYTASEAPREIKTIFEKYSENGVMTVDHLHRFLIDVQKQDKATREDAQSIINSASSLLHRNGLHLDAFFKYLFGDNNPPLALHKVHHDMDAPISHYFIFTGHNSYLTGNQLSSDCSEVPIIDALKKGVRVIELDIWPNSNKDDIDVLHGMTLTTPVGLIKCLKAIRAHAFDVSDYPVVVTLEDHLTPDLQSKVAEMVTEIFGEILFTPPVGESLKEFPSPNSLKRRIIISTKPPKEYKEGKDVEVVQKGKDLGDEEVWGREVPSFIQRNKSEAKDDLDGNDDDDDDDDEDKSKINAPPQYKHLIAIHAGKPKGGITECLKVDPDKVRRLSLSEEQLEKAAEKYAKQIVRFTQHNLLRIYPKGTRVTSSNYNPLVGWSHGAQMVAFNMQGYGRSLWLMQGMFRANGGCGYIKKPDLLLKSGSDSDIFDPKATLPVKTTLRVTVYMGEGWYFDFRHTHFDQYSPPDFYTRVGIAGVPGDTVMKKTKTLEDNWIPAWDEVFEFPLTVPELALLRLEVHEYDMSEKDDFGGQTCLPVWELSEGIRAFPLHSRKGEKYKSVKLLVKVEFV

SEQ ID NO: 9765 - DNA, 1843 bp, Arabidopsis thaliana (mouse-ear cress)
  CDS (111)..(1691)
cggagagtttcaaagtgtgcttctgttgcagcagaagctttaaggagaaaacgaggcagccaccagtgagcatcaagagactcttcgaagcttactcaagaaacggcaagatgtctttcgatgagcttctaagatttgtgagtgaagtccaaggagaacggcacgcagggttggactacgtgcaagatatcttccacagcgttaaacaccacaacgtttttcatcaccatggacttgttcatctcaacgccttctatcgctacctcttcagcgataccaactctcctcttcccatgtctggccaggtgcatcatgacatgaaggcgccgttatcgcattactttgtgtacacgggacataactcttacttgactgggaaccaagtgaacagcagaagcagcgtagaaccgatcgtgcaggctctcagaaaaggcgtaaaagtgatcgagctcgacttatggcctaatccttcagggaacgctgctgaagttcgtcatggcaggacgcttacttcgcatgaagatttgcagaaatgtctaaccgccattaaggataacgcgtttcatgtgtctgactatccagtcatcatcactctcgaagatcatttgccacccaagcttcaagcgcaagttgctaagatgttaactaaaacatacagagggatgctgtttcgtcgtgtctcagagagttttaagcattttccatcaccagaagaacttaaggggaagatcctgatctctacgaagcctccaaaggagtatcttgagagcaaaactgtacacaccacaagaactccaacggttaaagagacttcgtggaacagagtagcgaacaagattcttgaagaatataaagatatggagagtgaagctgtaggatatagagacttgatagcaatccacgctgcaaactgcaaagatccttcaaaggattgcttgagtgatgatccagagaagcctatacgggtcagcatggacgagcagtggctagacactatggttaggaccagaggaacggatcttgtcaggtttacacagaggaatctggtgaggatatatccaaagggcacaagagtggactcgtcaaactacgatcctcatgttgggtggacacacggtgctcaaatggttgcttttaacatgcaaggacatgggaagcaactatggataatgcaaggaatgttcagggggaatggtggatgtgggtacgttaaaaagcctcgcatcttgctagacgagcacacactcttcgacccttgcaaaaggtttcccattaagaccactcttaaggttaagatttacactggcgaaggatgggatttggatttccatcatacacactttgatcaatactctcctccagatttcttcgtcaagattggaatagcaggagtaccgagagacacggtctcatacagaacggaaacagctgtcgatcagtggtttcctatatggggcaacgacgagttcctgtttcagctgtctgttccagaactggcgcttctgtggttcaaagtccaagactacgacaatgacacccagaatgatttcgcaggacagacatgtcttcctctgccggaactgaagtccggagttagagccgtccggcttcacgatcgaacaggcaaggcctacaagaacacgaggcttctcgtcagcttcgccttggatcctccttatacgtttcgttgaatctcgttttctttccgaaataagccacacagtgtgtatctctgtttgcacgtttataaatttataatgtacaattatttgcgccctagctagaacgggataaagtgtgacaacatataaatactattaaagattcgatatttgatgactgt

SEQ ID NO: 9766 - protein, 526 aa, Arabidopsis thaliana (mouse-ear cress)
MSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPLPELKSGVRAVRLHDRTGKAYKNTRLLVSFALDPPYTFR

SEQ ID NO: 9767 - DNA, 1894 bp, Glycine max (soybean)
  CDS (76)..(1737)
gaattcggcacgagggcccctccgccggacgtcaaggaggccttctccgccttctccgacgccgctgccgcatccatgtccgccgaccagctcctccgcttcctgcacgatcaccagcgcgaaacggactgctccgctgaggattccaaccgcatcctcgacagcatcattcaatcgcgcaaacaaaacgacaccaatgccgaatgcgaccaccacaccgacaacaacaacaatggtctcagcctcgacgagttcttccgtttcttgttcctcgtcgatttcaacgatcccctcaaatcccaggtacatcatgatatgaatgctccgttgtcacattatttcatatatacagggcacaattcctacctgactgggaatcagctgagcagcgattgcagtgatgtgccaatcataaaggctttgcaacgaggtgtgcgagtaattgaactagatttatggccaaattcaactaaagatgatatcgacgtagttcatggaaggacacttactgctcctgtctcacttatccaatgtttaaagtccataaaagagtatgcttttgttaaatctgactacccagtcatcataactttagaggaccaccttacaccattccttcaagctaaagttgcagagatgatagctcaagtatttggagacatgctctattttcctcaggcagattctctgacagaattccccacaccagaatcgttgaaaggtcgaattcttatatcaaccaaaccaccaaaagaatatcttgaatccaagcaattcaaggatagtgacagtgagagggaatcaactgaagaaggatcattatccccatgtgttatccctgaattggaggctgttgatgagaagttaaatggaagtgatcttgatgaggaaggcttgaatgctcgtgataaaaaatcagaccaacagagtgcacctgagtacaaacgtttgattacaatccatgctgggaagccaaagggtcatgtaaagcaccacttgaacaatgttgggggcgtgaagcgcttgagcttgagcgaacaggaacttgaaaaggcttctgctacttatggatcagatattgttagatttacacagaagaatattatcagggtgtatccaaagggaacacgtgttacctcctcgaattacaggccacatataggatggatgtatggagctcagatggtggcatttaacatgcaggggcatggaaaatcactctggtacatgcaaggcatgtttagagcaaatggcgggtgtggttatgtgaaaaagcctgcatttctaatagaaaaaggtccacataatgaggtttttgatcctaaaagagcattgccagtgaagaaaacattgaaggtgaaagtatatatgggaaatgggtggagctcagatttcagcaaaacacactttgattccttctctccaccggacttttacacaaaggtttgcattgttggagtaccagctgataaagccaataagaagaccaaggtaattcaagacaactggtttcccgtctgggacgaagagtttgaatttcccttgactgttccagaactagctttgctccgaatagaagttcgagaatatgataagcatgaaaaggatgactttggtgggcaaacatgtttgccaatctctgagttaagatctggtttccgtgcagtccctctatttgatcagaagggcgagcaattaaaatctgtaaagcttttaatgcggtttcagttcaaatgaactacaaagattagccattatttaggcatgtaacatgatataatattcctaggtggttttccttttgactagtgtgactaggggcatcaagaagattgttttaactatattatgggcttaagaggtttatttaaaaaaaaaaaaaaaaaaactcgag

SEQ ID NO: 9768 - protein, 553 aa, Glycine max (soybean)
MSADQLLRFLHDHQRETDCSAEDSNRILDSIIQSRKQNDTNAECDHHTDNNNNGLSLDEFFRFLFLVDFNDPLKSQVHHDMNAPLSHYFIYTGHNSYLTGNQLSSDCSDVPIIKALQRGVRVIELDLWPNSTKDDIDVVHGRTLTAPVSLIQCLKSIKEYAFVKSDYPVIITLEDHLTPFLQAKVAEMIAQVFGDMLYFPQADSLTEFPTPESLKGRILISTKPPKEYLESKQFKDSDSERESTEEGSLSPCVIPELEAVDEKLNGSDLDEEGLNARDKKSDQQSAPEYKRLITIHAGKPKGHVKHHLNNVGGVKRLSLSEQELEKASATYGSDIVRFTQKNIIRVYPKGTRVTSSNYRPHIGWMYGAQMVAFNMQGHGKSLWYMQGMFRANGGCGYVKKPAFLIEKGPHNEVFDPKRALPVKKTLKVKVYMGNGWSSDFSKTHFDSFSPPDFYTKVCIVGVPADKANKKTKVIQDNWFPVWDEEFEFPLTVPELALLRIEVREYDKHEKDDFGGQTCLPISELRSGFRAVPLFDQKGEQLKSVKLLMRFQFK

SEQ ID NO: 9769 - DNA, 2134 bp, Glycine max (soybean)
  CDS (27)..(1829)
gaattcggcacgagagacagcaagtgatgacgtcgaaacagacatacagcgtgtgcttctgctggcggcggcggttcaagctggcgctggcggaggcgccgtcggaaatcaagaccctattcaatgagtactccgagaatgagctcatgacaccttcgcatcttaagagattcctggtcgatgtgcagaggcaagagaaggccactgaagaagacgcgcaagccatcatcgatagcttcaggcatttccatcgcagaggcgctggcctcaatctcgaaactttcttcaagtacctcttcagtgacgataatcctcctcttcttccttctcatggggtgcaccatgatatgactttacccttgtcacattatttcatatatactggccataattcctatttaactgggaatcagctgagcagcgactgcagtgacgtccccatcataaatgcactgaagaaaggtgtgcgggtgattgaattagacatatggcctaatgcatcaaaggatagtatagatgttcttcatggaaggacattgactactcctgtagagcttatcagatgtttgaggtctattaaggatcatgcctttgtggcatcagaatatccagttgtaataaccctagaagaccaccttacaccagatcttcaggctaaagtggctgagatggttacccaaacatttggagacatactatttactcctaactcagaaagtgtgaaggaattcccttctcctgaatcacttaagaagagaattattatatcaaccaaaccacctaaggagtaccttgaggcaaaagaaaaggaaaaaggggatgattcacagcacgaaaaggagaaaggggatgattcagagcatggaaaggcatcaggtgaagatgaagcttgggggaaggaagtcccaagcttgaaaggtggtactatagaggattacaaggacaacaacgtggatgaagatcttaatgatgaggaagaatttgatgaatcagacaagtcacatcataatgaagctccagaatatagacacctaattgccattcatgctgggaagcctaaaggtggattagtggaatgcctcaaagtggatcctgaaaaagtgagacgtctaagtttaagtgagcaacagcttgaaaaggctgctataaattatggacaacaaattgtcaggtttactcagcggaatatactgagggtgtatccaaaaggtactcgcattgactcatcaaattataacccattaattgggtggatgcatggagctcagatggttgcatttaatatgcaggggtatgggagatctctttggttgatgcatggaatgttcagagccaatggagggtgcggttatgttaaaaaaccaaattttctattggagactggtccagatgacgaggtcttcaatcctaaagctaagttacctgtgaagactactttgaaggtgactgtatatatgggggaaggatggtactatgatttcaagcatacacactttgatcaatattcacctccagacttctacacaagagtggggattgctggagtccctaatgatactataatgaagagaactaaggcaatagaggataattggttacctacatggaatgaggcatttgagttccctctcactgttccggagttggccttgcttcgcatagaagttcacgagtatgacatgtctgagaaagatgactttggtggacaaacatgcctacctatctgggagcttagaagtggcattcgagcaattccactgcatagccaaaagggagataaatacaacactgtaaagcttctcatgcgctttgagtttattaataattgattctgtgcaatgtgcatccttctgctccccattattattattattattatgtacagccattaagatgtgttagcagcaagagtttgtatgtagcagctggatgatatcgtgaattatgtgccccgctaaatgatgtaagaaaaaaaatgtgttgtgtattttgttttcttgaggagacttgttggtcttgtaaggcttgtcaatatatactacttatatatatatatataaacataaggaaattgctcgtgttttgtatgagaatactttttaagtcatctgtactcaaatgttggttttgatca

SEQ ID NO: 9770 - protein, 600 aa, Glycine max (soybean)
MTSKQTYSVCFCWRRRFKLALAEAPSEIKTLFNEYSENELMTPSHLKRFLVDVQRQEKATEEDAQAIIDSFRHFHRRGAGLNLETFFKYLFSDDNPPLLPSHGVHHDMTLPLSHYFIYTGHNSYLTGNQLSSDCSDVPIINALKKGVRVIELDIWPNASKDSIDVLHGRTLTTPVELIRCLRSIKDHAFVASEYPVVITLEDHLTPDLQAKVAEMVTQTFGDILFTPNSESVKEFPSPESLKKRIIISTKPPKEYLEAKEKEKGDDSQHEKEKGDDSEHGKASGEDEAWGKEVPSLKGGTIEDYKDNNVDEDLNDEEEFDESDKSHHNEAPEYRHLIAIHAGKPKGGLVECLKVDPEKVRRLSLSEQQLEKAAINYGQQIVRFTQRNILRVYPKGTRIDSSNYNPLIGWMHGAQMVAFNMQGYGRSLWLMHGMFRANGGCGYVKKPNFLLETGPDDEVFNPKAKLPVKTTLKVTVYMGEGWYYDFKHTHFDQYSPPDFYTRVGIAGVPNDTIMKRTKAIEDNWLPTWNEAFEFPLTVPELALLRIEVHEYDMSEKDDFGGQTCLPIWELRSGIRAIPLHSQKGDKYNTVKLLMRFEFINN

SEQ ID NO: 9771 - DNA, 2170 bp, Glycine max (soybean)
  CDS (92)..(1747)
gaattcggcacgaggtttcaggatccccgtgtcggaggccccgccggagataaggacccttttcgacggttactccgatgagaatggcgtcatgacagccactcacctccgaagttttctggctgaggtgcagagggaggacaatgccactgaggaggaagcacaagccatcatcgatggtcacaagcatctcagtatcttccaccgaagtggtctcaatctcgagagtttcttcaactatctttttagtcaccataataacccacctctcttaccttctcttggggtgcaccaagatatgtcttcaccgttgtctcattacttcatttataccggtcataattcctatctaactgggaaccagcttagcagtgactgcagtgacgtccccatcatcaatgcactggagaagggtgtaagggtgattgaattagatatatggcctaatgaatcaaaggataatgtagatgttcttcatggaaggactttgacttctcctgtggcactcatcaaatgtctgaggtctattaagcagcatgcctttgttgcctcagaatatccagttgtaataaccttagaagaccatctaactcccgaccttcaggccaaagtggctgagatgattactcaaacatttggagacatactatttgctcctacctcagaaagcttgaaggaatttccttctcctgaatcacttaaagggaggattattatatcaaccaaaccacctaaggagtaccttgaggcaaaagaagtacaggaaaaggaggaggaatcacaacaggaaaagcctgcagatgatgaagaagcatgggggaaggaagtccctagtttgagaggtggcactatctctgattacaagaacattgaggatgatgatgttcttgatgatgaggaagatattgatgaagcagaaaagtcacgtcaggatgcagcggacgaatacagacgtttaattgccattcatgctgggaagcctaaaggcggattaacggaatgtctcaaagtggatcctgataaagtgagacgtctaagtttaagtgagctacagcttgaaaaggctgctgaaactcatggaaaagaaattgtcaggttcactcagcggaatatactgagagtgtatccaaaaggtactcgcattacttcgacaaattataacccattgattgggtggatgcatggagctcagatggttgcatttaacatgcaggggtatggtagatctctttggttgatgcagggaatgttcaaagccaatggcggatgcggttatgttaaaaaaccagatcttctattaaaggttggtccaaataatgaggtctttgatcctagatctcatttgcctgtgaagacaaccctgaaggtgactatatatatgggggaaggatggtttcttgatttcaaacatacacactttgataaattctcacctccggacttctacgcaagagtggggattgctggagtccctaatgatactgttatgaagaaaaccgagaaagtagaggataattggtcaccttcatggaatcaagtattcaagttcccacttgctgttccggaacttgctctgcttcgtgtagaagttcacgagtatgacatgtctgagaaggatgattttggtggccaaacgtgcttacctgtgtgggaactaagaagtggaatccgagcagttccactgtattcccgcaaaggagataagtatgccaatgtgaagcttctcatgcactttgaattcatttgattttgtgcatccttatgctccatgtttttgtacagtcattgctatatgttgtagcaagagtgtgtatgtatgtagctgtgtaatattgtaaatgttgcttatttggagtgatgctttttatttatgttgtcttttactgaaaatataaatgtgagtgagagtgagactaatgtatttgggggatattgatgctgtctgtcacaaggagtgattttccacggattttgaataatgctgtgaagaaataagatgtgtatactatacacctggttttgttttcttgaggagacatgaaggagctgttatttatgttgtaacttgtaaggattgtccattttatgtatcataaacgagagttctatggtttgaaaggctggctagtacttcaatacattactgtttcgtaaaaaaaaaaaaaaaaaa

SEQ ID NO: 9772 - protein, 551 aa, Glycine max (soybean)
MTATHLRSFLAEVQREDNATEEEAQAIIDGHKHLSIFHRSGLNLESFFNYLFSHHNNPPLLPSLGVHQDMSSPLSHYFIYTGHNSYLTGNQLSSDCSDVPIINALEKGVRVIELDIWPNESKDNVDVLHGRTLTSPVALIKCLRSIKQHAFVASEYPVVITLEDHLTPDLQAKVAEMITQTFGDILFAPTSESLKEFPSPESLKGRIIISTKPPKEYLEAKEVQEKEEESQQEKPADDEEAWGKEVPSLRGGTISDYKNIEDDDVLDDEEDIDEAEKSRQDAADEYRRLIAIHAGKPKGGLTECLKVDPDKVRRLSLSELQLEKAAETHGKEIVRFTQRNILRVYPKGTRITSTNYNPLIGWMHGAQMVAFNMQGYGRSLWLMQGMFKANGGCGYVKKPDLLLKVGPNNEVFDPRSHLPVKTTLKVTIYMGEGWFLDFKHTHFDKFSPPDFYARVGIAGVPNDTVMKKTEKVEDNWSPSWNQVFKFPLAVPELALLRVEVHEYDMSEKDDFGGQTCLPVWELRSGIRAVPLYSRKGDKYANVKLLMHFEFI

SEQ ID NO: 9773 - DNA, 1981 bp, Solanum tuberosum (potato)
  CDS (56)..(1846)
tattttgtcttccacttctctctgcctttcgctttgtaaccaaaattcaacagaaatgtctaaacaaacatacagaatctgttgtttccaaagaaaattcaagttgaaagaagctgaagcacctgatgagatcaaagacttgtttgaaagattttcagaaaatggcatcatgacagcagaacatttatgcaaattcttgaaagatgtgcaaggtgaagaaaatgttacaaaagaagaagctgaaactgtgatggaatctgcactcaaacttgttcatgaacatcttaatattgttttccatagaaaaggtctcaatcttgatggattttttcgatatctcttcagtgatcttaatgtttctatctccacagacaaaaaggttcaccatgacatgactgctccattgtctcactatttcatttacaccagtcacaatacctatctcactgggaatcaactcaatagtgattgcagcgacgtgcctataatcaaggcactccaacaaggcgtacgagtgattgaattagacatgtggccaaattcatcgaaagacaatgtggatatccttcacggagggacactaacacctccggtggaacttatccaatgtttgaaatcaataaaggaacatgcatttgtggcatctgaatatcctgtaattataactctagaagaccacctcacccctgatcttcaggctaaagcagctgagatggtcactcaagtatttggagatatactgttcacctgtggggcagaatgcttgtcagaattcccgtctccagaatctttgaaggggcggattatcatctcaactaaaccgccaaaagaatatcttgaaagtaagaaaccaagtgagaaagataatggttctcagaaggggaagaaatcatcagaggagaaagcatggggagcagaaatttctgatctttctcaaaaaatgatagcttattctgagaataaagacaatggagaatgtcaagacgatgaagctgattctcatcatgagaaccccaatatacagcagaatatagctcctgagtataaacacttgattgctatccaagcaggaaaatcaaaaggtccaacaagtgagtggctaaccgtggatcctattaaggtgaaacgtattagcttaaatgaagaaaagctcataaatgttgccctcaatcatgggaaagatttaatcaggtttactcagagaaatttgctgagaatatatccaaaaggtatgcgagtcgactcttccaattacaatccactaatgggatggatgcatggagctcagatggttgcattcaacatgcagggacatggaaggcctttgtggttaatgcaagggatgttcaaagcaaatggtggctgtggctatgtcaagaaaccagagcttctcttgaagactgatgcaaataatgaggtccatgatcctaaaaggcttttatcagtgaaaactacactgaaggtgaaagtatacatgggaaaaggctggcatttggacttcaaacgtacacattttgatgcatattctccaccagacttctacgtcaagattggtattgctggagtcgctgcagattcaagagttaagaaaaccaaggcaatagaggacaactggataccaatatggaatgatgaatttgagttcccattgacagttccagagctagcattgcttcgcgtagaagttcatgaatatgatatgtcagagatcgatgattttggtggacaaacttgcattcctgtttcagaactcagaacaggaattcgagctgtgcctatttacaatgaaaaaggagagaaatatccttctgttaagctacttatgcgcttcgaatttgtaaaataatgttacatgtatagactagaaaactgcaccttccatcgtaaactcggaatatgtactggaattcaaattacttatcaagacagactatatcctaaagttgttcttaaagtggcacagtttcaactgctttatccg

SEQ ID NO: 9774 - protein, 596 aa, Solanum tuberosum (potato)
MSKQTYRICCFQRKFKLKEAEAPDEIKDLFERFSENGIMTAEHLCKFLKDVQGEENVTKEEAETVMESALKLVHEHLNIVFHRKGLNLDGFFRYLFSDLNVSISTDKKVHHDMTAPLSHYFIYTSHNTYLTGNQLNSDCSDVPIIKALQQGVRVIELDMWPNSSKDNVDILHGGTLTPPVELIQCLKSIKEHAFVASEYPVIITLEDHLTPDLQAKAAEMVTQVFGDILFTCGAECLSEFPSPESLKGRIIISTKPPKEYLESKKPSEKDNGSQKGKKSSEEKAWGAEISDLSQKMIAYSENKDNGECQDDEADSHHENPNIQQNIAPEYKHLIAIQAGKSKGPTSEWLTVDPIKVKRISLNEEKLINVALNHGKDLIRFTQRNLLRIYPKGMRVDSSNYNPLMGWMHGAQMVAFNMQGHGRPLWLMQGMFKANGGCGYVKKPELLLKTDANNEVHDPKRLLSVKTTLKVKVYMGKGWHLDFKRTHFDAYSPPDFYVKIGIAGVAADSRVKKTKAIEDNWIPIWNDEFEFPLTVPELALLRVEVHEYDMSEIDDFGGQTCIPVSELRTGIRAVPIYNEKGEKYPSVKLLMRFEFVK

SEQ ID NO: 9775 - DNA, 1940 bp, Solanum tuberosum (potato)
  CDS (128)..(1825)
caacacattttttttagtaatataaactactcaacgcataggcaaaagtaagtttgtttaaattagttaacacgacgatcggatcctgcctgagcaaaaacgcaaatcgttttccgttctggtaacaatgtcgaaacagacgtacaaagtcggattctttttccggcggcagtttaccatggctgccgccgaagctccggcagacattaagaacctatttaaacgttattccgacgacagcggagttatgagcgtccagaatcttcatcgtttcttaattgagattcagaaggagaaaaatgcgagcttagataacgctgaagccattatcaataatcacggcggcgactccaagcagaaaggcctccagctcgatggcttcttcaactgtctcttttctgatgttaatcctcctctcgatcctaaacttgggattcaccatgatatgaatgcacctctgtctcattactacatatacacaggccataattcatatctaactgggaatcaactgagtagtgattgcagtgatatccccataatacaagctcttcagagaagtgtcagagtaattgaattagatatttggccaaattcagacaaagatgatatagaagttctacatggaaggacactgactgctccagtggcgctaatcaaatgtttgaggtctatcaaggagcatgccttttctgcatcggagtatcctgttgtaataacacttgaagatcatctcacgccagatcttcaggaaaaagtggccgagatgatcacccaaacatttggagacatgctgttttctccttcagaaagtctgaaggagcttccttctccggagtcactgagaaagcgtgttatgatatcaactaagccaccaaaagaatacttacaatccaaggaagttaaggaaaaagatgacacaaagaaagaagctgagcaggatgacgttgatgaagaagaagatgaagatgaagatgaagatgatgaagaagatccaaagtcagagaagaaggcagcgtcagaatacaagcgcctaattgccattcatgctggaaaggggaaaggaggactatctgattggttgagggttgacctcaataaagtaagacggctgagtctcagtgaaccagaacttgaaaaagctgtagatactcattcaaaagaaattatcaggttcactcagcagaacttgctgagaatatacccaaagggcatacgagttgactcatccaattatgatccttttgttggttggatgcatggagctcaaatggtagcatttaatatgcagggttatggaagatcactttggttgatgcatggtatgttcagggctaatggtggctgtggatatgttaagaaacctgatctactattgaaagctggtcccaacaacgaggtcttcgatcctacagcaaatttgcctgtcaaaactacactaaaggtgactgtatatatgggtgatgggtgggacaaagacttcgatcagacacacttcgacacgtactcacctccagatttctatgcaaagctaggaattgctggagttcctgctgatgaagtaaagaagagaacaaagacgatggacgacaattggataccaagctgggatgagcagtttgagtttccactaacagttcctgagttggctctacttcgtatcaaagttcttgattataatttgtctgacaaggatgagtttgctggccaaacatgtctacctgtggcagagctgcgacaaggtatccgagcagtaccactctacgatcggaaaggagagaagtacagttctgtgaagcttctcatgcgtttcgagtttatataaccttagggccattgtagttcttgaaatgggagcttcacatactttgctagtttcatctatgtgaagtgtagcaaagtttataaactatatacaaccacatgcaaagttgtaagat

SEQ ID NO: 9776 - protein, 565 aa, Solanum tuberosum (potato)
MSKQTYKVGFFFRRQFTMAAAEAPADIKNLFKRYSDDSGVMSVQNLHRFLIEIQKEKNASLDNAEAIINNHGGDSKQKGLQLDGFFNCLFSDVNPPLDPKLGIHHDMNAPLSHYYIYTGHNSYLTGNQLSSDCSDIPIIQALQRSVRVIELDIWPNSDKDDIEVLHGRTLTAPVALIKCLRSIKEHAFSASEYPVVITLEDHLTPDLQEKVAEMITQTFGDMLFSPSESLKELPSPESLRKRVMISTKPPKEYLQSKEVKEKDDTKKEAEQDDVDEEEDEDEDEDDEEDPKSEKKAASEYKRLIAIHAGKGKGGLSDWLRVDLNKVRRLSLSEPELEKAVDTHSKEIIRFTQQNLLRIYPKGIRVDSSNYDPFVGWMHGAQMVAFNMQGYGRSLWLMHGMFRANGGCGYVKKPDLLLKAGPNNEVFDPTANLPVKTTLKVTVYMGDGWDKDFDQTHFDTYSPPDFYAKLGIAGVPADEVKKRTKTMDDNWIPSWDEQFEFPLTVPELALLRIKVLDYNLSDKDEFAGQTCLPVAELRQGIRAVPLYDRKGEKYSSVKLLMRFEFI

SEQ ID NO: 9777 - DNA, 2009 bp, Solanum tuberosum (potato)
  CDS (23)..(1780)
tttttcctcctttttttcaacaatgtccaaacagtcgtacagagtctgtttctgtttccggcgacggttccgggtactcgccgccgaggctccggcagatgtgaagaatttgttcaatcggtactccgataatggagtgatgagcgcggagaatcttcatcggtttttaattgaggttcaaaaggaggaaaacgctactttagaggatgctcatgctattatgaataatcttcatgatcttaagatcctcaatatttttcatcggagaggtcttcatcttgatgcgttcttcaaatatctctttgctgatatcaatcctcctcttaattctaagcttgggattcaccaagatatgaatgcgcctttgtctcattacttcatatacacaggccacaattcttatttaactgggaatcagttgagtagtgattgtagtgatgtccccataatacaggccctgcacagaggtgtaagagtgattgaattggatatatggccaaattccgctaaagatgatgtggaagttcttcatggaggaacgttgaccactccagttgcgctcatcaaatgtttgaagtctatcaaggaacatgcttttactgtttctgagtatcctgtagtaataacacttgaagatcatctaactacagatcttcaggcaaaaacagcagagatgattactcaaacatttggagatatgctgttttcttccgattcatgtttgaaagagtttccatccccagaatcactgaaaagacgtgttctgatatcaactaagccacccaaagagtaccttcaggcaaaggaagttaatgaaacaggtgcaatgaaaggaacggatcaaactgatacagaagcttggggaagggaagtttcagacattaaagccagatacaatgataaggatgactctgatgaaggtgaagctgacgattctgatgaagaagatcccacctcgcagcaaaatacagcaccagaatacaggcgtttaattgccattcatgctggaaaggggaaaggtggactgtctgattggctgagggttgatcctgataaagtaagacgacttagcttgagtgagcaagaacttggaaaggctgtagttactcatgggaaagaaattatcaggttcactcagaggaacattctgagaatatacccaaagggcatacgttttgactcatccaattacaatcctttcaacgcatggacacatggagctcaaatggtggcattcaatatgcagggctatggaagatcactttggttaatgcatggtatgttcagaggcaatggtggttgtggatatgttaagaaaccagatatactattgaaagcaggtcccaacaatgaggtcttcgatcctgaagcaaatttgccagtcaaaactacattgaaggtcaccgtatttatgggtgaagggtggtattatgacttcgaacacacacactttgatgcatactctcctccagacttctacgcaaggataggaattgctggagtagatgctgatattgtaatgaagaaaacaaagactcttgaggacaattggataccaacttgggatgaacagtttgaattcccattaacagttcctgaattggctctactccgcgttgaagttcatgagtatgatatgtctgaaaaagatgattttgctggacaaacttgtttgcctgtttcagaactaagacaaggtatccgagcagtaccacttcacaaccgcaagggagagaaatacaactctgtcaagctacttttgcgtttcgaatttatctaattgtgagtttgtcttgtcttgttctgttttattctgtttgtggaaataaggattttgccatgatttgcaagcttgcttctgtgtattttgtggtacgttctgtatctttgttgatattatgtgcccagagatgtaaataagtttgtggtaaaatgtgtgcaaatattttttgtaaaatcattcaaatattatgtattatatgctaaggtgtaaatatatgtgtgtttgg

SEQ ID NO: 9778 - protein, 585 aa, Solanum tuberosum (potato)
MSKQSYRVCFCFRRRFRVLAAEAPADVKNLFNRYSDNGVMSAENLHRFLIEVQKEENATLEDAHAIMNNLHDLKILNIFHRRGLHLDAFFKYLFADINPPLNSKLGIHQDMNAPLSHYFIYTGHNSYLTGNQLSSDCSDVPIIQALHRGVRVIELDIWPNSAKDDVEVLHGGTLTTPVALIKCLKSIKEHAFTVSEYPVVITLEDHLTTDLQAKTAEMITQTFGDMLFSSDSCLKEFPSPESLKRRVLISTKPPKEYLQAKEVNETGAMKGTDQTDTEAWGREVSDIKARYNDKDDSDEGEADDSDEEDPTSQQNTAPEYRRLIAIHAGKGKGGLSDWLRVDPDKVRRLSLSEQELGKAVVTHGKEIIRFTQRNILRIYPKGIRFDSSNYNPFNAWTHGAQMVAFNMQGYGRSLWLMHGMFRGNGGCGYVKKPDILLKAGPNNEVFDPEANLPVKTTLKVTVFMGEGWYYDFEHTHFDAYSPPDFYARIGIAGVDADIVMKKTKTLEDNWIPTWDEQFEFPLTVPELALLRVEVHEYDMSEKDDFAGQTCLPVSELRQGIRAVPLHNRKGEKYNSVKLLLRFEFI

SEQ ID NO: 9779 - DNA, 2006 bp, Vigna unguiculata (cowpea)
  CDS (88)..(1737)
gtccgattcttttctgaaacacaccaaatccaagaacgctctctcctctattttattcatgcgattagattaggtttttttttcaccatggccacccacaactacaaagtcttcagctgcttcaacagaaagttcaccatcaccgaaccaaaaccaccgcccgacgtccaaaaagccttttctgaattctctgacggcgcctcctccatgtccgccgaacacctgctccggttcctggcggagcatcagggagaagtggactgcaccgtttccgattccgagcagatcctccagcaatcgaggaaagaggacggggaaactggattcgatctccacgacttcttccatttcctgcaagagaacgatttgaacgtccccttgaaatctcaggtccatcatgatatgaatgctccaatatcacattatttcatatacactgggcacaattcctatctgacagggaatcaactgagcagtgactgcagtgatgcaccaatcataaaggctttgcaacgaggtgtgcgagtaattgaactagatttatggccaaattcaaataaagatgatatcgatgtagttcatggaaggactcttaccactcctgtctcactcctccgatgtttgaagtccataaaagagtatgcctttgttaaatctcagtacccactcgttataactttagaagatcaccttactccagatcttcaagctaaagttgcaaagatggccacccaagtgttcggagaattgcttcattatcctcagacagattccctgacggaattcccctcaccagaatcattgaaaggtcgaattcttatatcaacaaaacctccaaaagaatttcttgaatccagtgaaaaggaatcagctgaggaggtttcctcattgcgagaaaatgctgatgaacaaagaactgataataagagggcacctgagtacaaacgcttgattacaatccatgctgggaaaccgaagggtgaaatacaggatgaattaaaagctgctggtaatgttaggcgcttaagcttgagtgagcaagcacttgaaaaggcttctgaatcttatggagctgatgtagtcagattcacgcacaacaatattctcagagtgtatccaaaaggaacacgtctcaactcctcaaattacaaaccacacatagggtggacgtacggagctcagatggttgcgtttaacatgcaggggcatggtaaatcactttggtacatgcaaggaatgtttagatcaaatggagggtgcggttatgtgaaaaagcctaactttctaatacaaaaaggtccacaagatgaggtttttgatcctaaaatagcattgccagtgaagaaaacattaaaggtaaaagtctacctggggaaaggttggagcttagatttcagcccatcagactttgatagttactcaccaccagacttttacgttaaggtttgtatcgttggagttccggctgatatgatcaagaagaaaacaagtgtaatttcaaataattggtttcctgtatggaacgaagagtttgatttccctttgactgttccagagctggccttgctcggcatagaagttcgagaagatgataagcatcaaaaggatgacttcggtggacagacgtgtttgccagtctcagaactaaaatctggattccgatctgtccctctgtatgatgaaaagggtgacaaatataaatctgtgaagcttttaatgcgatttcagtttagatgaattataccatcagccttataataatctgatataatggatatgaggtcgttgtaatgataattatctttatcattagtcgcttacttgcaattgtatttttggatttactgtgtaatgttttctgcatcatcaaacaacaaacatcgtaaatgagtgtcactcttttacgatgcactactgatctgcttttttcaacattattatggttactacagtggttccaaagattggtctattaccagtatgattgctaaaaaaaaaaaaaaaaa

SEQ ID NO: 9780 - protein, 549 aa, Vigna unguiculata (cowpea)
MATHNYKVFSCFNRKFTITEPKPPPDVQKAFSEFSDGASSMSAEHLLRFLAEHQGEVDCTVSDSEQILQQSRKEDGETGFDLHDFFHFLQENDLNVPLKSQVHHDMNAPISHYFIYTGHNSYLTGNQLSSDCSDAPIIKALQRGVRVIELDLWPNSNKDDIDVVHGRTLTTPVSLLRCLKSIKEYAFVKSQYPLVITLEDHLTPDLQAKVAKMATQVFGELLHYPQTDSLTEFPSPESLKGRILISTKPPKEFLESSEKESAEEVSSLRENADEQRTDNKRAPEYKRLITIHAGKPKGEIQDELKAAGNVRRLSLSEQALEKASESYGADVVRFTHNNILRVYPKGTRLNSSNYKPHIGWTYGAQMVAFNMQGHGKSLWYMQGMFRSNGGCGYVKKPNFLIQKGPQDEVFDPKIALPVKKTLKVKVYLGKGWSLDFSPSDFDSYSPPDFYVKVCIVGVPADMIKKKTSVISNNWFPVWNEEFDFPLTVPELALLGIEVREDDKHQKDDFGGQTCLPVSELKSGFRSVPLYDEKGDKYKSVKLLMRFQFR

SEQ ID NO: 9781 - DNA, 3900 bp, Caenorhabditis elegans
  CDS (1)..(3900)
atgcaacacggctcacttggcccatcatcgtcgtctcgaaagactacagtaaccagcacagcgggctccgttcaccttcatcaccgctcttcaaatggtttctcgacagcatcacgagctcaattgaaccgtcacaatgaaatggattttgggaaaatgtttgcggcaatggagaaaggtcacaaagtgtgcaaaattgcggtgttgaagaaatgggatccagcctataaacaattaacgttggatcggtactcgaggcagatttttctgacaaaattggaactgtcagctgttagaaataaaccgacaattctagatattcgacaaatccgtgaagtacagacattgaattacaaattgaacacaattaaagtagatgataaatggaaaaaggatcgagaaatcgtaaattttgattcaaaagccattctaatcatctcatatggaatgggatttgctctttcctattggattcttttcgttgctcgaaagcatatgaaaccatttgttcaaacctccctccaattcaaagttcaatctgatcagctccaacaagtgacagaagatcaaatgaattctgatcaattcagttttgccagtcgtcaacttatccatgtacctgaactcttctcttcaagattcgctgatcttgctgaaaaacatgaacgaaaaggtcttgtggtgacgtttcaaaattttttgcgatttcttgatggcaaacaattcgatgaacttgcctcgaatcgaacgagagctttggagtttttgaatcgatattttcaagaagatcaagcatattttggagatagaaatgagccttcaatgactgttttcgagttttgtgattttttattttcaagggagaattcgctgtgggacccaacaaatgagaaagttactcatgatatgagcagaccattgtctcattattggattgccagctcgcataatacatacttgacgggtgaccaacttcgatctgaatcttctttggattgttatgctcaagctcttttgatgggttgtagatgcattgagttagattgctgggatggacagaagaagcccgggtcagccgagttcattgatattgtcatctatcacgggtatacgatgacctcaaaaattttgctccgcgacgtgcttcacgtcatccgtcactatgcatttgttacgagtgaatatccagtaattctatcaattgaggacaactgctcggtgccagctcaacggcttctagctcaagaactgaaagatattcttggtgattatttattgacacaaccagcaaatcgtgaagaaaaacaattgccctccccggccgcgttgaagaagaaaattatcgtgaagcataagaagttgccgatagaaagcgaggatttggcagctgtggtgaaaactgatgagttccaagacacggaaatcatatctcgcgaatgtgtaaagaaggggatcctgatggtaaaaaacaacaacagtcacgaatggacatctcatgttttcatattattccctgatcgtctttgctacctgattcaaaccgctgatcctgaaaatccaaatgacgatacagtgagtgtaagtggagatgaagaacgggaagaagagacgccttctggatttggagtgaaacctgaagaaatgcatgtgactgaagaatggttccatggaagatgtgaacgggatgaagcgaaaaaacggattctagagcataaggagaagggaaatggattgtttatgattcgagattcgaatctgttcattggagatttctcactttcgattctacatgacgggaaagttcatcatgttcggataagatccaagattattgataaagagaaaaaatattacttcatggataacaaagtctgcgacactctttacgagttggtctcttactacacccgtcactacctcacaactgctcatttcaaaatggtgctcacgattccatgtcctcaaccacaaccgcatcttaatcagccatggttctctgctactgctgacaaggaaaaagccgaagaacttttgagcttggtgccagaagatggtgctttcctaattcggacgtcatcgactgactcttcagtttacgttctttcgctaaaagtcgacggcgaattctggcattatcgattgaaaagagatggaagaattttcgtggtgaatcaaaaagtattcgagaatttgaatcaaattgttgaattctatgcgaatcgagaatttgttagaggaattagtcttcgattccctgtcaatgagaaggatatatcacacctgacagctgaacttgcagaagctcgtactccaggttgctatatggatctgaaggatttggataaagaagttcaagctcgagcacttcgaccgtatcgaggaacagctgatgatgaactttcgttcccagcgaatgttattatcacagtactccggaaggaagaaggtctttggagaggaagatatggatcgttgactggatggttcccttcggcccatgtacaagagattctaccagagaaagtttcaacttcagaaactagcaactacaacacaatcgagctagctggaacactaattgaacggattcatgatgctgatcgtccgaatgttatcagaatatcacaatcaaatcaacattggatgaacaagcaatattatttgttggctgcttcttcctccgaggaagcagatggttggcaaaacaatctcttcgagctgactcgttcagttaacacaaaaatgagcatactccgaaccaaagaaaaagaaaaacgaattgccgctgagctctcaaatctagtcgtctactgtcaagctgttccattcgacccagcccatatctacaatgacgctttctatgaaatgtgctcatttgtcgagggaaaacttgacaaactggttgaaaaggggcttcttccgtttaattcccgaaaactctcgagggtctatccgaacggaagtcgaatcacatcgaataattatagtccggttccaatgtggaatgcaggatgtcatatggttgcactaaactatcaaaccggtgataaacccatgcagttgaatcaaggaaagtttttggcaaatggaagatgcgggtacctactgaaaccagattatatgttaactgatgacttcgatcctacgaacacggaaaagtttgcaacagcttatcccattcgactgaatgttcaagtgattggaggacgtcatttgtcaagaaaagataagaataaaggaatatgctccccatttgtggaaattgaaattattggaatgccatgtgacacaaaagtttttcaaactaaaactatagcatcaaacggtcttaatccgatctggaatcaaactttcacatttgagatccagtgtcccgaagtagcactgatcagattccacgtggaagacggtgactttgtgggaccaaaaacagatccgttcattggtcaagcagtattccctgttgattcaattagatgtggattccgatcagttccactcaaaaatcagtacagtgaggagcttgagctctcttcactgttagttgatgtacaaatgtgctccagagaaggaactcaattgatcaggtcgtcgtcgcatttcttgcaggcgagtcgtctggctcctgtcttcgctcaccgtaagatcacaaatggcgatagtatccctcgtgagatggcacctcggttacgaacatcagccaccgatcgttcactagactctccaacaaattccgagtcaagagccactcttctgagcggccaacgaggtagccaagactctatggacagcgctgccgaaacatcgtccattgcatctggaacaataagctctcgggatggaaagaagaaacaaaactggctcaagaagttctcatttggaaaaagtagtaaatcatag

SEQ ID NO: 9782 - protein, 1299 aa, Caenorhabditis elegans
MQHGSLGPSSSSRKTTVTSTAGSVHLHHRSSNGFSTASRAQLNRHNEMDFGKMFAAMEKGHKVCKIAVLKKWDPAYKQLTLDRYSRQIFLTKLELSAVRNKPTILDIRQIREVQTLNYKLNTIKVDDKWKKDREIVNFDSKAILIISYGMGFALSYWILFVARKHMKPFVQTSLQFKVQSDQLQQVTEDQMNSDQFSFASRQLIHVPELFSSRFADLAEKHERKGLVVTFQNFLRFLDGKQFDELASNRTRALEFLNRYFQEDQAYFGDRNEPSMTVFEFCDFLFSRENSLWDPTNEKVTHDMSRPLSHYWIASSHNTYLTGDQLRSESSLDCYAQALLMGCRCIELDCWDGQKKPGSAEFIDIVIYHGYTMTSKILLRDVLHVIRHYAFVTSEYPVILSIEDNCSVPAQRLLAQELKDILGDYLLTQPANREEKQLPSPAALKKKIIVKHKKLPIESEDLAAVVKTDEFQDTEIISRECVKKGILMVKNNNSHEWTSHVFILFPDRLCYLIQTADPENPNDDTVSVSGDEEREEETPSGFGVKPEEMHVTEEWFHGRCERDEAKKRILEHKEKGNGLFMIRDSNLFIGDFSLSILHDGKVHHVRIRSKIIDKEKKYYFMDNKVCDTLYELVSYYTRHYLTTAHFKMVLTIPCPQPQPHLNQPWFSATADKEKAEELLSLVPEDGAFLIRTSSTDSSVYVLSLKVDGEFWHYRLKRDGRIFVVNQKVFENLNQIVEFYANREFVRGISLRFPVNEKDISHLTAELAEARTPGCYMDLKDLDKEVQARALRPYRGTADDELSFPANVIITVLRKEEGLWRGRYGSLTGWFPSAHVQEILPEKVSTSETSNYNTIELAGTLIERIHDADRPNVIRISQSNQHWMNKQYYLLAASSSEEADGWQNNLFELTRSVNTKMSILRTKEKEKRIAAELSNLVVYCQAVPFDPAHIYNDAFYEMCSFVEGKLDKLVEKGLLPFNSRKLSRVYPNGSRITSNNYSPVPMWNAGCHMVALNYQTGDKPMQLNQGKFLANGRCGYLLKPDYMLTDDFDPTNTEKFATAYPIRLNVQVIGGRHLSRKDKNKGICSPFVEIEIIGMPCDTKVFQTKTIASNGLNPIWNQTFTFEIQCPEVALIRFHVEDGDFVGPKTDPFIGQAVFPVDSIRCGFRSVPLKNQYSEELELSSLLVDVQMCSREGTQLIRSSSHFLQASRLAPVFAHRKITNGDSIPREMAPRLRTSATDRSLDSPTNSESRATLLSGQRGSQDSMDSAAETSSIASGTISSRDGKKKQNWLKKFSFGKSSKS

SEQ ID NO: 9783 - DNA, 2691 bp, Caenorhabditis elegans
  CDS (1)..(2691)
atggcaacgaaacctactgacattttgcgtgatggtaaattgattttctttaaatatgaggagaattggacaagccgaaatgccgttcgtcttcatgttgatccaacaccttatattttgtattggaggtacaaggatcctaaagttttcaatacaaaggagcttgcttacgagaagaactacatttatctagaacgaatctatgacgttcgtgcaggaaaaccgacagactttgaattagtgcccagcgagagaagttatgagcccaactttttgactattgtcagcgggacaagcatcacgaatctaaagttcactcatttcgtgtgtatggagaagaatgagaaacgcctgcacgagttcgccgccactctatttactgtggtacagcgtgtcaaacgggaagagcacggacttttgtatcattttcgtaaaaagttggctccgaagatgtacgcggcgtttactagaaggtgtattgaagaagatattatgaaggttttcgacaagcatcgaaaaaactcaacgaaaattgaatggacagaggttggaaaactccttccagtgaatcgaaagtctgtcgagatagacgatcagaagctcataaagatcattatgatacttaccaagtttgagggttccaggttggaagctatatttcgaaaaataagcgaggatgaacctgttgccacaaagttagaatttggcgattggcttagaaaaaatcaacacgatcatcgactcaacgacgctaggttcaatcaggtgtcagataggaagatcaactcgattttagaaaactggcagtattctagcgattccgcaatttcacctcaaatgttcacacattggatggtgtccgatgagtgcggagttgcgatttcggcacaaagaatgaagatggatgtgactagtatgagagagccgatcaacaagtatttcattaattcttcacacaacacttattgttctggcaaccaactggtctacgcaattggtcattgctccgctgacgttgagatgtatcgtcaggctcttctaagtggaagtcgatgcgttgagctagatatgtgggataacaaggacaaagatggagaacctgtgataactcatggaccaactgcagttatgggaatgaacgagattggattgaaagaagtttgcgaggcgatcaaggaatgtgcttttaagacatctccctatccagtgattctatccattgagaatcaccttggcagaaaacaacaagagaagatggtgcagatctttcgtcaagtattcggagagctgctgttgactggcccacttccagactaccccctttacgctaaagagggggcaggcgacgttgtgtatccaccgccggaacttttgaagcacaagattctgattaaagccaagaagaaaagattcgagaaacaggagtcaagaagtcgcgatagctcgagcattgatctacagggatcttcaatcgatttgaccgaagatgaagaaatggagaatgaacgattcaatgagctcactgaagaacaaaaagccgcccagctcagcgagctaccagaagaaacaacatgctccgagctgtccgccatcaccaactacatgcaagcctatgagaccagtcgtggagtttccacagttgtcaatctagagaatgctacaaaggacatcgttccatgcatagtatctgctgatgagaataccgtttacaactgtctccgtgcaaattccattgataaagtccaaaatcttaacaaatcaaagatcacaagaatctacccgaaagcctctcgcatctattccaccaactacaacccgatgattcactggctaaccggctcgcaaatggtttcgttaaatattcagacaaattgttcgaacatgcaactgaactacgcaatgtttgagagaaatggaggttgtggatacgtgagaaaacctgattggctcagagcacggaatgttcagctgaggccgttcttgtcgattccattcacgatagcgtatacggtcgaggttgagatcattgccgcatacttcctctcttcaatggattctggcaaatttcgtcgacgaagttcagtttccattcgcctctttgacgtacctgatcagatatccaaagatgatgccgcatcgccatcagtatccacggctgcaaaattcgaatccagctgccgacggcgtactcgagaggaggcttcgtttgtcactaactatgagcgtcatgtatacagtttcgacaaaatcatgttgaatgacatgtcattcattcaattcaatgttcataatgagtcgggtagtgtatttgctcaacgaatacttcatattgatactatgaataatggatatcgctttgtgacacttcgtactccatctaatcagtgtgctgggccagcatgccttttagttagatttgatctttttatgcattcagataggaaaaatttacatgacttgaagcaaatgtacaatccacacgcatttgaaaaggagtctgacaaatgggaacgaagattcagcaatccatttgcagacctggacaagtttgatgacaatgagttccttctagtagagggaacacgcagaggatcagtggagcatgcaccaacaacacccaccacaccaaccaagccaatgtcttttgggaaggagattctggaaaagatatcgttttggaagaagaagtag

SEQ ID NO: 9784 - protein, 896 aa, Caenorhabditis elegans
MATKPTDILRDGKLIFFKYEENWTSRNAVRLHVDPTPYILYWRYKDPKVFNTKELAYEKNYIYLERIYDVRAGKPTDFELVPSERSYEPNFLTIVSGTSITNLKFTHFVCMEKNEKRLHEFAATLFTVVQRVKREEHGLLYHFRKKLAPKMYAAFTRRCIEEDIMKVFDKHRKNSTKIEWTEVGKLLPVNRKSVEIDDQKLIKIIMILTKFEGSRLEAIFRKISEDEPVATKLEFGDWLRKNQHDHRLNDARFNQVSDRKINSILENWQYSSDSAISPQMFTHWMVSDECGVAISAQRMKMDVTSMREPINKYFINSSHNTYCSGNQLVYAIGHCSADVEMYRQALLSGSRCVELDMWDNKDKDGEPVITHGPTAVMGMNEIGLKEVCEAIKECAFKTSPYPVILSIENHLGRKQQEKMVQIFRQVFGELLLTGPLPDYPLYAKEGAGDVVYPPPELLKHKILIKAKKKRFEKQESRSRDSSSIDLQGSSIDLTEDEEMENERFNELTEEQKAAQLSELPEETTCSELSAITNYMQAYETSRGVSTVVNLENATKDIVPCIVSADENTVYNCLRANSIDKVQNLNKSKITRIYPKASRIYSTNYNPMIHWLTGSQMVSLNIQTNCSNMQLNYAMFERNGGCGYVRKPDWLRARNVQLRPFLSIPFTIAYTVEVEIIAAYFLSSMDSGKFRRRSSVSIRLFDVPDQISKDDAASPSVSTAAKFESSCRRRTREEASFVTNYERHVYSFDKIMLNDMSFIQFNVHNESGSVFAQRILHIDTMNNGYRFVTLRTPSNQCAGPACLLVRFDLFMHSDRKNLHDLKQMYNPHAFEKESDKWERRFSNPFADLDKFDDNEFLLVEGTRRGSVEHAPTTPTTPTKPMSFGKEILEKISFWKKK

SEQ ID NO: 9785 - DNA, 2256 bp, Caenorhabditis elegans
  CDS (1)..(2256)
atggccaagagcgtatccccagaggagcaggccgccgcacaagctgctgatgaagagaagacgaaagaagaattagaatgggctgaaaaaggatcgcttttatgtagaattaaaaatcaaaaagtgaaggaaatggcgttggtgacaataaaaagtaaacaattcctcaactattactcaagttattggtttaattttgtgccaaatgctttgaaatcagttgcactatcggaattgttagaagttcgatcgggttatcaaactgacaatctgcaaagagcatcgaaaaaatacgaattccaagagttggctccagagtctagatgtttctccgttattttttctcatgccaagttcttgcacaaatcagtagatttcagtgctgattccaaagaaactagagacaaatgggtttccgtactgacacatctcatatcagttgccaaacatcaaagagttgtattcaacgaaacagcatggttgattgacaaatttcaacaggcggataccaataaaaacggacttcttagttttgacgaagtttggaatcttcttaaacgaatgaatcttcaaataagtgaacgatatgcaaaagcgatattcagagaatcagagtttgagaactcgcgagataataaattgaacgagaaagaatttcttaacttttttgaaagattgactgatcgaccggatcttcgatttgtgatgactcaagcaagttctgataacgtggaaacgctgactgttgctgatttgcaaagatttttaactgaagaacaaggattcgaaaatgttgatttgaaaaaagccgaacaaattctgactacatttgaacaaactgttcaagataagcaaaaagaaaaattgatgggattgatgggaatgcgtcgattaatgcagtcaagatggggaaatgtattcaaaccaggacatgaaagtatcttccaagatatggatcaacctctgactcattattttgttaattcatcacataacacatatttgactggcttgcaagtgaaaggagaagctactgttgaaggttatatttcagctttacgtaaaggagcaaggcttttagaattagacttgtttgatggcgaacacggagagccagtaatcacacataaaagaacctttatcgagtcgattacattgaggaattcgctggaagctattaagagaactgcgtttgaaacatcaccatatcctgtcatcctcaccctcgaaaaccacgtcggatttgtacaacaggctgttatggcagatttattcaaagaaattcttggagattctttatatattccaccaaaagattcacatcgccatccgttatcatctccgaataagctgaaaagaaaattcctattgcgcggaaagaaaattattcttgaagaagacattgaagaaccagatgaagatgattcaccaactgataaggataagcaccatgtacatccacatccagttgcacctgaattatcagctctcattggtttgccgtcagtaaaattgagccataatatttatcaagacgtcaacaaacatccatttgatggaagtccttcgctctcggaaaataaagtatatacaatgtttgaagctgcagttcccatcttcacttacactgcagaaaggcttgtgaagagttatccaaaaggattacgtcaagattcatcaaatatgcatccaatggtttcttggctttgtggaattcaaagtgttgctatgaacttccaaaccgctggtgaagagcttgatttgaatgcaggattattcagaattaatggaaattgcggttacgttctgaaaccaagttgccttctcgatggagtcgatccaagaagtatggccaaaccaaaattgaagcttggtattggacttttctctgctcagtatcttccaaagtcagaacccggaaaagagatcattgatccatacgtcagtgttcagattttcggaattccacgagatgaaacaaaagcaaaaacaagaatcatcaaggacaatggattcaacccagaatggagggataatttctatttcacactctcgtgcccagagctagcaattattcgattctgtgtaaaagattttgactctacatcttcgaacgactttgttggagaattctcaattcctgttatgagtcttcgtacaggtttctcgcaaattcaactaaataccggatatcaacatactctggacccatctgcatctctttttgtacgaattgcaatggaggaagagtactaa

SEQ ID NO: 9786 - protein, 751 aa, Caenorhabditis elegans
MAKSVSPEEQAAAQAADEEKTKEELEWAEKGSLLCRIKNQKVKEMALVTIKSKQFLNYYSSYWFNFVPNALKSVALSELLEVRSGYQTDNLQRASKKYEFQELAPESRCFSVIFSHAKFLHKSVDFSADSKETRDKWVSVLTHLISVAKHQRVVFNETAWLIDKFQQADTNKNGLLSFDEVWNLLKRMNLQISERYAKAIFRESEFENSRDNKLNEKEFLNFFERLTDRPDLRFVMTQASSDNVETLTVADLQRFLTEEQGFENVDLKKAEQILTTFEQTVQDKQKEKLMGLMGMRRLMQSRWGNVFKPGHESIFQDMDQPLTHYFVNSSHNTYLTGLQVKGEATVEGYISALRKGARLLELDLFDGEHGEPVITHKRTFIESITLRNSLEAIKRTAFETSPYPVILTLENHVGFVQQAVMADLFKEILGDSLYIPPKDSHRHPLSSPNKLKRKFLLRGKKIILEEDIEEPDEDDSPTDKDKHHVHPHPVAPELSALIGLPSVKLSHNIYQDVNKHPFDGSPSLSENKVYTMFEAAVPIFTYTAERLVKSYPKGLRQDSSNMHPMVSWLCGIQSVAMNFQTAGEELDLNAGLFRINGNCGYVLKPSCLLDGVDPRSMAKPKLKLGIGLFSAQYLPKSEPGKEIIDPYVSVQIFGIPRDETKAKTRIIKDNGFNPEWRDNFYFTLSCPELAIIRFCVKDFDSTSSNDFVGEFSIPVMSLRTGFSQIQLNTGYQHTLDPSASLFVRIAMEEEY

SEQ ID NO: 9787 - DNA, 1755 bp, Arabidopsis thaliana (mouse-ear cress)
  CDS (1)..(1755)
atgtcgaagcaaacatacaaagtctgtttctgtttccgtcggaggtaccgacacactgtgtccgtagctcctgctgagatcaaaacacttttcgacaattactccgacaaaggtctcatgactaccgatctcctcctcagattcctaatcgatgttcagaaacaagacaaagccacgaaagaagaagctcaagatatcgtcaatgcttcttcttctcttcttcatcgtaatggtctccaccttgatgctttcttcaaataccttttcgctgttaccaactctcctctttcttctcttgaggtgcatcaagatatggatgctccattatcacattatttcatatatacaggacataattcgtatttaacaggtaatcaactaagtagtgattgcagtgaattgcctatcattgaggcattgaaaaaaggtgttagagttattgaattagatatttggcctaactctgatgaagatggtatcgatgttcttcatggaaggactcttacatcacctgtggagctgataaaatgtctaagagctattagagaacatgcttttgatgtatctgattatccagttgttgttactcttgaagatcatcttactcctaaactccaagctaaagttgctgagatggttacagatatatttggagaaatgttgtttactcctccttcaggggaatgtttgaaggagtttccatcgccggcgtttttgaaaaagcgtattatgatctcaactaaacctcctaaagagtataaggcagcaacagatgatgatttggtgaaaaaaggaagggatttgggtgataaagaagtttggggaagagaagttccaagctttattcgaagggacagaagtgttgacaagaatgattcaaacggagatgatgatgatgatgatgacgatgacgatgatgatgatgatggtgatgataagattaagaagaatgcaccaccggaatataagcatctgattgcaatcgaggctgggaaaccgaaaggcggaataactgaatgtttgaaggtggatcctgataaagtaagacggcttagcttaagtgaagaacaacttgaaaaggcctcagaaaaatatgctaaacagattgtgaggttcactcagaggaatttgctacgggtttatccgaaaggaactagaattacttcatcaaactataaccctctgatcgcttggagccatggagctcaaatggtggctttcaatatgcagggacttggacgatcattgtgggtaatgcaaggaatgtttagaggcaatggaggatgtggctacattaagaaacctgatcttttgctgaaatccaacgctgtatttgacccggaagctacattacctgtaaaaacaacactaagggtaactatatacatgggagaaggatggtactacgatttcccgcatacgcactttgatcgatattctccacctgatttctatacaagggtcgggattgctggagttcccgcggatacagtaatgaagaagacgaaaacattagaggataattggataccagcttgggacgaggtttttgagttcccattaacagttccagagcttgctcttctacgtatcgaggtacatgagtatgacatgtctgagaaagacgattttggaggccaaatttgcttgccggtttgggagctgaggcaaggaatacgtgccgttcctctccgtaaccaggatggtgtcaagtgtagatccgtgaagcttcttgtgcggttggagtttgtgtga

SEQ ID NO: 9788 - protein, 584 aa, Arabidopsis thaliana (mouse-ear cress)
MSKQTYKVCFCFRRRYRHTVSVAPAEIKTLFDNYSDKGLMTTDLLLRFLIDVQKQDKATKEEAQDIVNASSSLLHRNGLHLDAFFKYLFAVTNSPLSSLEVHQDMDAPLSHYFIYTGHNSYLTGNQLSSDCSELPIIEALKKGVRVIELDIWPNSDEDGIDVLHGRTLTSPVELIKCLRAIREHAFDVSDYPVVVTLEDHLTPKLQAKVAEMVTDIFGEMLFTPPSGECLKEFPSPAFLKKRIMISTKPPKEYKAATDDDLVKKGRDLGDKEVWGREVPSFIRRDRSVDKNDSNGDDDDDDDDDDDDDDGDDKIKKNAPPEYKHLIAIEAGKPKGGITECLKVDPDKVRRLSLSEEQLEKASEKYAKQIVRFTQRNLLRVYPKGTRITSSNYNPLIAWSHGAQMVAFNMQGLGRSLWVMQGMFRGNGGCGYIKKPDLLLKSNAVFDPEATLPVKTTLRVTIYMGEGWYYDFPHTHFDRYSPPDFYTRVGIAGVPADTVMKKTKTLEDNWIPAWDEVFEFPLTVPELALLRIEVHEYDMSEKDDFGGQICLPVWELRQGIRAVPLRNQDGVKCRSVKLLVRLEFV

SEQ ID NO: 9789 - DNA, 1746 bp, Brassica napus (rape)
  CDS (1)..(1746)
atgtcgaagcaaacgtacaaagtgtgtttctgctttaaccggaggttccggtacaccgcatcggaggcgccgcgtgatgtcaagacccttttcgacaagtactcggagaatggcgtcatgaccgtggatcatctccagaggtttctgatcgatgttcagaagcaagataaagccactaaagaggatgcgcagtcaatcatcaacgccgcgtcttcgcttcttcatagtaacggtctccacctcgatgctttcttcaagtatctttttggtgacagtaaccctccgcttgctcttcatgaggtgcatcaagacatggatgctcctatatcacattatttcatattcaccggtcacaattcatatttaaccggcaaccagctgagcagtgactgcagtgaggtgcctattatagatgcattgaagaaaggtgtcagggtgattgagttggatatatggcctaactcaaacaaaaacgatattgatgttcttcacggaaggactctcacttcacctgtggagttaatcaagtgtctaagagctatcaaaacacatgcattcgaagtatctgactaccctgttgttgtcactcttgaggatcatctcactccagaacttcagtccaaagttgctgagatggttaccgagatatttggagagatcttgtttactcctcctgtgggagaatctttgaaggagttcccatcaccaaactcattaaaaagacggatcatcatctcaacaaagccaccaaaagaatacaaggaaggaaaggatgaggatgtggtgcagaaaggtaaagccttgggtgatgaagaagtttgggggagagaagttccaagttttattgagaggaacaaaagtggtgacaaggatgacttagatgatgaggaggataatgatgaagatgatgatgtagagaagttcaagaagaatgcaccaccgcaatataaacatttgattgcaatccatgctgggaaaccaaaaggtagtattactgcgtgcttgaaggtagatcctgataaggtaagacgccttagcttgagcgaggaacaactagaaaaggcagcagaaaaatatgctaaacagattgtgaggtttacgcagcagaatctgctgaggatttacccaaaaggaactagagtgacttcatcaaactacaacccattggttgggtggagccacggtgctcaaatggtggctttcaacatgcagggatatggaagatcattatggctaatgcaaggaatgtttagagccaatggcggatgtggatacatcaagaaaccagatattctcttaaaaggtggctcagatagtgacatctttgacccaaaaactactctacctgtaaaaacaacactaagggtaaccatatacatgggagaaggctggtactttgacttccgccacacacacttcgatcaatactcacctcctgacttctacacgagggtggggatagctggagttccagcggatacggttatgaagaagacaaagacgctagaggataactgggtgccatcttgggatgaggtgtttgagttcccactaacggtcccagagctggctctactgcggttagaagtgcatgagtatgacatgtcggagaaggatgattttggaggtcagacatgtttgcctgtttgggagctgcaggaaggaataagatcgtttcctttacataaccgcaaagaggagaagtacaaatctgttaagcttctcgtgaaggtggagtttgtgtga

SEQ ID NO: 9790 - protein, 581 aa, Brassica napus (rape)
MSKQTYKVCFCFNRRFRYTASEAPRDVKTLFDKYSENGVMTVDHLQRFLIDVQKQDKATKEDAQSIINAASSLLHSNGLHLDAFFKYLFGDSNPPLALHEVHQDMDAPISHYFIFTGHNSYLTGNQLSSDCSEVPIIDALKKGVRVIELDIWPNSNKNDIDVLHGRTLTSPVELIKCLRAIKTHAFEVSDYPVVVTLEDHLTPELQSKVAEMVTEIFGEILFTPPVGESLKEFPSPNSLKRRIIISTKPPKEYKEGKDEDVVQKGKALGDEEVWGREVPSFIERNKSGDKDDLDDEEDNDEDDDVEKFKKNAPPQYKHLIAIHAGKPKGSITACLKVDPDKVRRLSLSEEQLEKAAEKYAKQIVRFTQQNLLRIYPKGTRVTSSNYNPLVGWSHGAQMVAFNMQGYGRSLWLMQGMFRANGGCGYIKKPDILLKGGSDSDIFDPKTTLPVKTTLRVTIYMGEGWYFDFRHTHFDQYSPPDFYTRVGIAGVPADTVMKKTKTLEDNWVPSWDEVFEFPLTVPELALLRLEVHEYDMSEKDDFGGQTCLPVWELQEGIRSFPLHNRKEEKYKSVKLLVKVEFV

SEQ ID NO: 9791 - DNA, 2394 bp, Nicotiana tabacum (common tobacco)
  CDS (21)..(1838)
cccgttttctccttcaaacaatgtcgagacagacgtacagagtctgtttctgtttccggcggcggttccgggtagtcgccgctgaggctccggcggatgtgaagaatttattcaataaatattccgataacggagtgatgaatgcagagaaccttcaacgattcttaattgaggttcagaaggaggaaaattcgagtatagaggatgctcagggtattatgaataatcttcatgaccttaagatccttaatatttttcatcggagaggtcttcatcttgacgcattttttaagtatctttttgctgatattaatcctcctattaatcctaaacgtgggattcaccatgatatgaatgagcctttgtctcattacttcatatacacaggacataattcctatctaactgggaatcaactaagtagtgattgcagtgatgttcccataatacaagccctgcaccgaggtgtacgagtaattgaattggatatatggccaaattccgccaaagatgatgtggaagttctgcatggaggaacattgaccactccggttgcgctcatcaaatgtctgaggtctatcaaggaacatgctttttctgtatctgagtatcctgttgtgataacacttgaagatcatttaaccccagatcttcaggcaaaagttgcggagatgatcactcaaacatttggagacatgctgttttctcccgattcatgtttgaaaaactttccctccccaggatctctgaaaagacgtgttctgatatcaactaagccacccaaagagtaccttcaggcgaaggaagttaaggaaaaagactcgaagaaaggaacggatgcacctgatacagaagcttggggaagggaagtttcagaccttaaagccagatacaatgataaggatgattctgatgacggagcaggtgtggaagatgatgaaagtgatgaaggagatcccaactcgcagcaaaatgtcgcaccagaatacaagtgtttaattgccattcatgctggaaagggaaaaggtggattgtcagattggctgagggttgatcctgataaagtaagacgacttagcttgagtgaacaagaacttggaaaggctatagttactcatggaaaagaaattatcaggttcactcagcggaacttgctcagcatatacccaaagggcatacgttttgactcatccaattacaatccttttgttgcatggacgcatggagctcaaatggtggcattcaatatgcagggctatggaagatcactttggttaatgcatggtatgttcagatccaatggtggttgtggatatgttaagaaaccagatatattattgaaagcaggtccaaacaatcagatcttcgatcctgaagcaaatttgccagtcaaaactacattgaaggtgaccgtatttatgggtgaagggtggtattatgacttcaatcacacgcactttgatgcatacgcgcctccagatttctatgcaaagataggaattgccggagttccagctgataatgtaatgaagaaaacaaggactcttgagaacaattggataccaacttgggatgaaaagtttgagttcccattaacagttcctgagttggctctacttcgcgtcgaagttcatgtgtatgatatgtctgaaaaagatgattttgctggccaaacttgtttacctgtttcagaactaagacaaggtattcgagcagtttcactacacgaccgcaagggagagagatacaactctgtgaagcttcttatgcgtttcgatatgtctaactctgagtcgagcagtttcgaattcggcacgagtttcaggtaccatggttagcacctctttccttccgaggaaaccagtagtgactagcctgaaagccataccaaatgttgggcaagctctctttggtcttaaatctgagaggggtggtaggattacttgcatggccagttacaaagtgaagcttattacaccagagggaacagttgagtttgattgtccagatgatgtttacattcttgaccaagctgaggaagagggacatgagcttccttacagttgcagagctggttcttgctcttcttgtgctggaaaagttacaggtggaaatgttgatcagtctgatggaaactttcttgatgatgaccaaatggctgatggatttgtgctaacctgtgttgcttacccacagtctgatgttactattgagacccataaggaggaggagctcactggctaagaaaatctcattatttcaaaaaacactttaatctgtttgatgagcatttaatttcatatgtaactcttttgttatcataaaagatgcaatgttgcaacttcaagtcaatgactttgatttgcttagtatatcaaaaaaaaaaaaaaaaaa

SEQ ID NO: 9792 - protein, 605 aa, Nicotiana tabacum (common tobacco)
MSRQTYRVCFCFRRRFRVVAAEAPADVKNLFNKYSDNGVMNAENLQRFLIEVQKEENSSIEDAQGIMNNLHDLKILNIFHRRGLHLDAFFKYLFADINPPINPKRGIHHDMNEPLSHYFIYTGHNSYLTGNQLSSDCSDVPIIQALHRGVRVIELDIWPNSAKDDVEVLHGGTLTTPVALIKCLRSIKEHAFSVSEYPVVITLEDHLTPDLQAKVAEMITQTFGDMLFSPDSCLKNFPSPGSLKRRVLISTKPPKEYLQAKEVKEKDSKKGTDAPDTEAWGREVSDLKARYNDKDDSDDGAGVEDDESDEGDPNSQQNVAPEYKCLIAIHAGKGKGGLSDWLRVDPDKVRRLSLSEQELGKAIVTHGKEIIRFTQRNLLSIYPKGIRFDSSNYNPFVAWTHGAQMVAFNMQGYGRSLWLMHGMFRSNGGCGYVKKPDILLKAGPNNQIFDPEANLPVKTTLKVTVFMGEGWYYDFNHTHFDAYAPPDFYAKIGIAGVPADNVMKKTRTLENNWIPTWDEKFEFPLTVPELALLRVEVHVYDMSEKDDFAGQTCLPVSELRQGIRAVSLHDRKGERYNSVKLLMRFDMSNSESSSFEFGTSFRYHG

SEQ ID NO: 9793 - DNA, 2098 bp, Nicotiana tabacum (common tobacco)
  CDS (106)..(1866)
aaaaaaccgttacttgtaacaatcacataaatcatttctcctcgcctcaaaaaatcatccctctccgttttccgttttccgttttccgttttcctctttcaaacaatgtcgagacagacgtacagagtctgtttctgtttccggcggcggttccgggtagtcgccgccgaggctccggcggatgtaaagaatttattcaatagatattccgataacggagtaatgaatgcagagaacctacaacgattcttaattgaggttcagaaggaggaaaatgcgagtttagaggatgctcagggtattatgaataaccttcatgaccttaagatccttaatatttttcatcggagaggtcttcatcttgacgcattttttaagtatctttttgctgatattaatcctcctattaatcctaaacgcgggattcaccatgatatgaatgagcctttgtctcattacttcatatacacaggacataattcttatctaactgggaatcaactaagtagtgattgcagtgatgtccccataatacaagccctgggccgaggtgtacgagtaattgaattggatatatggccaaattccgccaaagatgatgtggaagttctgcatggaggaacattgaccactccggttgcgctcatcaaatgtctgaggtctataaaggaacatgcttttactgtatctgagtatcctgttgtgataacacttgaagatcatttaaccccagatcttcaggcaaaagttgcggagatcactcaaacatttggagacatgctgttttctcccgattcatgtttgaaaaactttccctccccagaatctctgaaaagacgtgttctgatatcaactaagccacccaaagagtaccttcaggcgaaggaagttaaggaaaaagactcgaagaaaggaacggagtcacctgatacagaagcaaggggaagggaagtttcagaccttaaagccagatacaatgataaggatgattctgatgacggagcaggtgtggaagatgatgaaagtgatgaaggagatcccaactcgcagcaaaatgtcgcaccagaatacaagtgtttaattgccattcatgctggaaagggaaaaggtggattgtcagattggctgagggttgatcctgataaagtaagacgacttagcttgagtgaacaagaacttggaaaggctgtagttactcatggaaaagaaattatcaggttcactcagcggaacttgctcagaatatacccaaagggcatacgttttgactcatccaattacaatccttttgttgcatggacgcatggagctcaaatggtgcatcatatgcagggctatggaagatcactttggttaatgcatggtatgttcagatccaatggtggttgtggatatgttaagaaaccagatatactattgaaagcaggtcctaacaatcagatcttcgatcctgaagcaaatttgccagtcaaaactacattgaaggtgaccgtatttatgggggaaggatggtatatagatttcaaacacacacactttgatgcatacacgcctccagatttctatgcaaagataggaattgccggagttccggctgataatgtaatgaagaaaacaaagacactggaggatatggataccccaacttgggatgaaaagtttgagttcccattaacagttcctgaattggctctacttcgcgtcgaagttcatgagtatgatatgtctgaaaaagatgattttgctggccaaacttgtttacctgtttcagaactaagacaaggtatccgagcagtttcactccacgaccgaaagggagagaaatacaactctgtgaagcttcttatgcgtttcgaatttgtctaactgtgagtcgtttgttttctcttatgtgtctgtgtatgttgtggtaaattctgtgtcaatatgtgtgcgctgagatgtaaataacttatatgtcgtaaaatgtgtgcaaatattttttggaaagtcgtctgtctctttgtaacttctgtaattgacaacatatgctctgagatgtaaatagatgtatggtaatacgtgtgaaattaatttttgaaaaaaaaaaaaaaaaaaa

SEQ ID NO: 9794 - protein, 586 aa, Nicotiana tabacum (common tobacco)
MSRQTYRVCFCFRRRFRVVAAEAPADVKNLFNRYSDNGVMNAENLQRFLIEVQKEENASLEDAQGIMNNLHDLKILNIFHRRGLHLDAFFKYLFADINPPINPKRGIHHDMNEPLSHYFIYTGHNSYLTGNQLSSDCSDVPIIQALGRGVRVIELDIWPNSAKDDVEVLHGGTLTTPVALIKCLRSIKEHAFTVSEYPVVITLEDHLTPDLQAKVAEITQTFGDMLFSPDSCLKNFPSPESLKRRVLISTKPPKEYLQAKEVKEKDSKKGTESPDTEARGREVSDLKARYNDKDDSDDGAGVEDDESDEGDPNSQQNVAPEYKCLIAIHAGKGKGGLSDWLRVDPDKVRRLSLSEQELGKAVVTHGKEIIRFTQRNLLRIYPKGIRFDSSNYNPFVAWTHGAQMVHHMQGYGRSLWLMHGMFRSNGGCGYVKKPDILLKAGPNNQIFDPEANLPVKTTLKVTVFMGEGWYIDFKHTHFDAYTPPDFYAKIGIAGVPADNVMKKTKTLEDMDTPTWDEKFEFPLTVPELALLRVEVHEYDMSEKDDFAGQTCLPVSELRQGIRAVSLHDRKGEKYNSVKLLMRFEFV

SEQ ID NO: 9795 - DNA, 4953 bp, Magnaporthe grisea
  CDS (1900)..(4440)
ggtacctctgttgattcttttttttttttctctctttttttcttcttctttttgggcgaatgcacgcttgccggcctagcaagtccagattgctacattgggaaggaagccacaaaaagccttgatcttgagaaattcaacaaggtcctgagcaatcggcagacgcaaccaaaatccgaacggcgcacatagattcagcgcgtgtgcgagactgcgactcgtatcttcatctgggcactgcagcatatccagaaagacattgaagacgagcccgccgcgcgaactgaacagccgcctgtttgccgcctttggagactcggttaccgccagtgtccccctgacggccttttctgcagccaggtcaggacacctttgtaacttggcgccgggcgaccatcccaaagctggggttctttggatacacggcgcactcaggaaggcgggccactgcattcaccctctgcagcctcggcttgttttgtttcccgcccaagtgcagtgcagactgaagacaggcagataatcagccccgtacagacgcagctggcactcctgcgctgtggagactcgctctcatagtgcatcgcatcagcagcttggttgatatcccaatccagccgcctgcataacaagcctgccacatcatcaatttgccgtcaaatcgcgccgcaccaccttgtaaggcctccgtctgcccaatcgccccagactgttcgacctgtacatgtctgcacctaggtctcgtgccgtaccagtaccaagcagatacctggtcccactttgacaccgagacaggccagagtcggccgccgttctgccagccggctgatcaacaaccccaacgccgatcgccttgcggctgcaacgcaaccccccttgtttatacacacttacttataccgttgctacctcgctcctctggacttcatcagcctcaaaaggcccttgaccccgagctctctccaacaaggccccgcccgcttttcacccaaaacctactactgtcacaactggctttggagaaaatgcattcgcaaaaatcagagcttcatatataaccttcaagccttattctaagctggagcaattctctcattcgcatacccttgtcagctgtaccatccactagccccaacaaagggcagactttcacatgatgacttcctctaccacatccgccgtcatggcggaaagatcaccagctgcttcacccagtagcacaccgtcctcaatgactccccacacatttcccgtgcacccaaggagaatagcccgagcaacctgcaaacaaactttactccagcccccatcaagtggccatcccccccatctgcaatcagtgcttcctcggtttccgtggcatcgagtttgcagggctcgcccgtcttctccctggatgctgcaccaggacttacacaaagcagctcaatacaagcatccccggaaccgttacggggcagagatcctgaacagtacccttcagggtttcaactaccagaaccggtattaccacaatcatcgctgtcgcggaaaacaagcatggggtcactgtatcaaccagcacagccttctggcaactcatctttgcccgaagtcccaaacaagggcctattccgcaggctctcaaacaaggccacaaacaccttcaggtcgccgagaaggcaatcatcagctcacggaaccaaacggggtgccagcgttggacccggacttgccagaccacgccaacgaagtaacagcgatctcacaaaccccttcacagactcggacgacgagccttttattgacctcgacgacaagatctctttcctcaacatttctgttgagtctaatggccgagatttgtcaccaacaagtgccccggcatccatcaacggtagcaattcctctagtggtcctatgactgtcgtcgctggtcccacctatcctctggagctactccaaggaaccaaggttacaaagttcgctaaaaagaggggctccacaaccagccgaaaacagctgatgctggtactggacgcccaatctgccaagatcacctgggacaagagcaaaccttccaagtctatctacatcgacgatattaaagatatccggacggcagaagacattcgccagtacaggctcgactttggcattccggaatccgaggagcccctctgcttctcaatcatctacgccacccacgacgtaaagccgaagacaaagatgatgcaccttgtggctggagatcctgccatcgtggatatgtgggtttcgaccttgcacacaatctccatgcatcgtcaagacatcatgtcttctctcatggcctttaacgataaggccattaggacttactggaaaaacgagctgcacaaacaactgaagaataccagcaacaacggtgaggaaaacatcgatttcctcggtgttgagcgcgtgtgccaaaaccttcatattcacgtatcctccgagactttgaaggagaagtttctggaggcgctagggacttcgtctgttgatgccgatgcatccgttaagaacggtcgtctcaacttcagccagtttcaggagtttgtgcgactcatgaagagacgggccgacattcgccccatctttcgcgaaagggcgtccgatatcgaacgtggcatgacgcttcttgacttcgtcagttttcttacagatgtgcaaaatgaggacgtcgacgccgacagggcctactgggaggccatcttcgctcgctttgctaaacgcaacaagtccaaggatctggagggcgatgatgttccgcgcatcagcgaagctgccctggtcagcttcctgacttcgacctacaatgtccccatcgtcagcgctcccaaaaactacaccctcgaccgaccgatcaacgaatactacatctcgagctcgcataacacctaccttctgggacgtcaagttatgggcttttccagtgtcgagggatacatctcggcgctgatgcgcggttgccgatccgtagaggttgactgctgggacggtggtgatggctggcctcttgtgtctcatgggtggacgatgaccactaacattgcctttcgcgaagtgatgaacgtcatcaataagtacgcttttgtcaagtccgaattcccgctatggatatctctcgaagttcactgcaacccggaccagcagaggaagatggtggcgatcatgaaggaaatctttggggccaggctagtcaccgagcctctggaaggtctccccgccgacaagctcccttcgccatcgcagttcaagaaccgtattctgatcaaggcaaagaagccgggtcacgaggagcccaacccggagcggaccggacgccgacgaggcaacagtctcacatctccctacacgaagccagtcatgcttgacaactcaaccatcccttcccagtcgcttccgcacagccccctgcttactcctacgcactcgcaaattcgccgcatgggagccaagactcgcgtctacacaataaccgagggtagagtccatgattcgacgagcggtagccccagtgactgcgacagcggcagtgagcgcgatattcagcagcccatcagccccaacagtggcaccagcaaaattgtcaaggagcttggcgatcttgccgtgtactgcgccggcatcaagttttctggtttcgaacacccagactccaagacggtcaatcatatcttttccttccacgagggcacgttccaaaggcacgggaggcccggagatgcgaagcgcgccctctaccgacacaacatgcgctacatgatgcgcgtttatcctcaccgtggcagggtttactcgagcaacttcgacccgcttctcatgtggcgccgtggcgtgcaaatggctgcactcaactggcagacgttcgatctgggcatgcagctcaaccatgccatgtatgatggtggtatggatcagtcgggctacgttctcaagcccaaggagttccgcgagatccagcacttcccgtacctgcccgagcacatggtgggcggcaaacggcctcgcaagaacgtcaagttcagcattgatgtcatttctgcccagcagctcatgcgacctcacaatcttcgggatcgtcacacgcttgacccgtacattgaagttgaggcattcctggctgacgacaagcgaaacaccaacaaggagtactctgacgccgggccaagcaagactaagcacaagacccccatcgccaaagacaacggctttaaccccatcttcgaccagagatacaacttcaacttcaacaccaagtaccctgatctcatattcatccgatggaccgtccgtctctcggaaggcgggagccaaagcgaccgtagcacgattcttggtaccgagagtgttaacaagcttcgcagccttgggcggaccgtattcaaccgctccaacaacagtcccaagtccagcgtcgatggcggtagtcaataaaagctatcgtcgccgctccagtggcaggggcgaaacgagaagatcgccgttcgatctgcattgtactaccaaccttaacgatgtccacgtctcattcgttctcaattccctttgtcagagcttgggccatattctgtcatttttgaccaccatgtacacgcctgtctgggtgcagacccacgattgcgtctttgttattgtttttttattattattatctttggctttgatttgtaatgtggttccggtttttattacagcacgaaaataccccctaggttcgtgaccatgctcataagagcggcacggaaagcatcaaaaagcaaccaagaaaagtgttgccattctcataccctacggcgtccaaataaccttgactcgtttttatttttgggggttttctttgccatcccctgctggcttctcttccaggcaaccagtcctgaggatattactgcgcgcaggagacgacattttgtgtacaacttttgattctttttttttcacgtatag

SEQ ID NO: 9796 - protein, 846 aa, Magnaporthe grisea
MTVVAGPTYPLELLQGTKVTKFAKKRGSTTSRKQLMLVLDAQSAKITWDKSKPSKSIYIDDIKDIRTAEDIRQYRLDFGIPESEEPLCFSIIYATHDVKPKTKMMHLVAGDPAIVDMWVSTLHTISMHRQDIMSSLMAFNDKAIRTYWKNELHKQLKNTSNNGEENIDFLGVERVCQNLHIHVSSETLKEKFLEALGTSSVDADASVKNGRLNFSQFQEFVRLMKRRADIRPIFRERASDIERGMTLLDFVSFLTDVQNEDVDADRAYWEAIFARFAKRNKSKDLEGDDVPRISEAALVSFLTSTYNVPIVSAPKNYTLDRPINEYYISSSHNTYLLGRQVMGFSSVEGYISALMRGCRSVEVDCWDGGDGWPLVSHGWTMTTNIAFREVMNVINKYAFVKSEFPLWISLEVHCNPDQQRKMVAIMKEIFGARLVTEPLEGLPADKLPSPSQFKNRILIKAKKPGHEEPNPERTGRRRGNSLTSPYTKPVMLDNSTIPSQSLPHSPLLTPTHSQIRRMGAKTRVYTITEGRVHDSTSGSPSDCDSGSERDIQQPISPNSGTSKIVKELGDLAVYCAGIKFSGFEHPDSKTVNHIFSFHEGTFQRHGRPGDAKRALYRHNMRYMMRVYPHRGRVYSSNFDPLLMWRRGVQMAALNWQTFDLGMQLNHAMYDGGMDQSGYVLKPKEFREIQHFPYLPEHMVGGKRPRKNVKFSIDVISAQQLMRPHNLRDRHTLDPYIEVEAFLADDKRNTNKEYSDAGPSKTKHKTPIAKDNGFNPIFDQRYNFNFNTKYPDLIFIRWTVRLSEGGSQSDRSTILGTESVNKLRSLGRTVFNRSNNSPKSSVDGGSQ

SEQ ID NO: 9797 - DNA, 4330 bp, Ephydatia fluviatilis
  CDS (68)..(4135)
atgctgataatttagtaccgcaagtgttcgcaatatcggatggatacacacggatatagctgataggatggcgggccacgtcagtaagagagttttgaagcagccagacgttcaaagtatacttctaagcggagtcagcttttggaaatgggaagatggggaccaagtggcccagaaggcagagttctttgccgataaagacgcacatttcctctacgccaaacccgaggacaagtcaaagtacaacatcatttgggacgtgacccatatcagtgacgtgcgggcaggcaaagtaccatacaaggactcaaagttgcacgagttcctgcgttcaatgacctccagtgactacctggagccggagcagttcctcaccatggtctatcgcagagagggtatagtcaacctcgaccacgtccagctgatggccccatccatggacgtggctgagaagtggaagagggccgtgaatgccattgtcttcaacatgctgcgcttcaatgcaagcaccctgaccttcttcaagaggaactaccagaggatactgctatcctgcaatggctacggccagattccagtcaagagcatatgcagggccttgctccttagggttagggacaagactgacatggagctgtttggaattttcgatgcccagaagaagaaaatggatgatggcacggagtatattcaggacacagacttcacttgggacaagtatgagcagctggtgaaccagctcaccaagggaaggaccagtgacatggagtgtgtcatcaaggacttagggaagagcaagaaacaccagcagctcacgctccaggagttccacaacttcctaacaaagtgccagcgagacccgcgtctcaacaccatcctgtacccacctccaactaaacaacaggccaaggagctggctgagaagtacgagggaaaggctgttgaagaccgtcttactccgagggccctgctgaacttcctgatgagcgaagacaacaacgtcctgggagtggagaacctggaccagttcatggacatgacccagccgctgtctcactacttcatcaactcctcacacaacacctacctcacagggcatcagctcagatcactgtccactgtggagatgtatcgtcagtgcttgctacttgggtgcaggtgtgtggagctggacttgtggccagagggagaagacatcatcatcacccatggcggtaccctgtgtaccaagatccccttcaaggacgttgtggaggccatcagtgagtacgccttcatcaccagcgagtttcccgtcatcctgagcattgagaaccactgcaggcacaagcccctgctcatccagaagatagccagcacctttgctctggtgtttggagataagctacagaagtcgcctctcgacgattatccactggagcccggactacctcttccatctccggaaagactgaagggaaaaattctcattaaagacaaagtgaagaagtctaaaggtattgaatcttccactggcacactgccacgtggtgcacatctcacgtcagaggacaaagcagagacactcagcaggaaaagtggcactggggacaaagtttcagatggcaatggagggcaggctacacccactagtaaagaatttgtcatgcccagtgtggctcttaccagtctctctgcctcgtcactggtggtcaaggacaagatggacatagccaacctgagagagatagtacccttgcccgaatctcccttggagaccagtcctggacccagaaagaccagccctggcctcacagagacctgccctggatcacctggccctataaagaccagccctggacctgtggacactagcccatccagtccattgcatgtagtacctacatgtacctggagtggactgactacaccttccagtgctaatgcagggggacctcctggcacctcaactgagttgcccttacccgagtctacccctcctcctcctcttcctcccccttctgagaccacacccttcaatttggagacagtgccgatccctggcacgccccctccctcctctggagtcaataggacagaagagatacaggataacgaaagttgcccactcagtcctctcgacacttctactgcacccgatcctaacatccctaccgactcaccgaaggaaactgcaccccaccccgtcactcctgtcaactcattgaaggaaactgcattccaaaacagatccttgaagaaaaccttctctgggatgactgaggactctatggaatccacacctaggaaggaggaggaatttgtttataatatgacgcccgctcgacccagtgaaggggaggcatttgtgactggtcctcttgtagatatcatcaactactgctccgggatcacctttgagggatttgaggcagctgagaagacaaactgcagcttttatcagtcatccttcaatgaggacaaaggtgtgagtcttgtcaaggtgactgcaagggagtttgtcaagtacaacatgagacagatgagcagaatatatccacaagggggcaggattaactccagcaactatatgccccagatcttttggaacgtgggctgtcagcttgtggcactgaacttccagtcaacagacttgccaatacagctaaacaatgccaaatatgagttcaatggagtgacaggttatctcctgaagcctgcagcctacctgaaggagagaacgactggggggctgtttaaccctttcatacagaaccccgtggagaacatagtaccggcgacactcactctcaaggtgatatcggggatatttctgacagagaagagaacaaattgccttgttgaggcacaaatgtttggattgccttcagatactgtcaaccacaagttctatactaccaagaaagaggccccgcatcctgtctgggaccatgaaccattcacatttgcaaagatcttgttgccagaaatggcaatgcttcgagtggctgtgtatgatgaagacagggagttgctaggacaacgctcacttcctgtaaatgccatcagagcgggctatcggcacatccccctcagagacaagtacaaccaacccttgtctctggcatcactgtttgtacacatcatggtggatgactgggttggctcggatatggaggctatcattgctggcctaatggatccaatcgcttttgtgaatagcgcattggcagagcttgctattggtaccgaaaatgaggatcaggatccctccctgctctctgggtcttccacattgccacgcacacgcaagccagaaaatactgatgcacggaaagactccactaccactgttgcctcgcccttccctccgtctgcttcttttgatcagaaagtggatgctgcaaccattccctcgagcccgcctgttggcagcacagcggcagcagcaagctccatggctgcaccagaaactaagtcccttaccttgaactatcccaaggccaaggtagacgatgtgcttccaatagtgcagatggtcacaaagaggcctcctccagtggctgctcaacacgtcgatgattgtatcgctttccatgaaagtattttgaagatagagaagaagatggtgacagataggatgaaggttctgaagaaacatgagaaacacctaagtgaccatggcagcaagcagagcaaggggaagcaggaggaggtggccagtcgcattgctgccttgaaggatgaccactccaaggagcttctggccctggacaagaagcttttgcatgaacgtaacgtcaaattagagaccctgctcaatgaagctcacaagaaagaaatgaaagacttgattgcccagcataggagtgaaatcaattcagttagttctgaacttataatgtttttgaagagacgtgattctgatacaaaaggaaggatggcatttgatgagcgaacgatcgcagtgggcaccaaaaataagggagagcttgaaaagttacaccagaaggagaaggaaaaccttgagaagagtcagaaagaggcaaaggagcgtcttcaaaaggagtatgaagagtcgctgaataaactggagcaccctaaaggaacaagtggatctcctgagcaaactaaagaagaagctaccgcaatgtagcaatcatttttaaaattttatattccacaagactatctccatgctctttcaaatccccccaaaattttgtatgcttttcgtccttccaatcaagcttgtaaattttaagatatataatatgcatgatgttgtaccatttcctgctcttaccgaaccatgcctggtgaattctgataataacttgtattattcttt

SEQ ID NO: 9798 - protein, 1355 aa, Ephydatia fluviatilis
MAGHVSKRVLKQPDVQSILLSGVSFWKWEDGDQVAQKAEFFADKDAHFLYAKPEDKSKYNIIWDVTHISDVRAGKVPYKDSKLHEFLRSMTSSDYLEPEQFLTMVYRREGIVNLDHVQLMAPSMDVAEKWKRAVNAIVFNMLRFNASTLTFFKRNYQRILLSCNGYGQIPVKSICRALLLRVRDKTDMELFGIFDAQKKKMDDGTEYIQDTDFTWDKYEQLVNQLTKGRTSDMECVIKDLGKSKKHQQLTLQEFHNFLTKCQRDPRLNTILYPPPTKQQAKELAEKYEGKAVEDRLTPRALLNFLMSEDNNVLGVENLDQFMDMTQPLSHYFINSSHNTYLTGHQLRSLSTVEMYRQCLLLGCRCVELDLWPEGEDIIITHGGTLCTKIPFKDVVEAISEYAFITSEFPVILSIENHCRHKPLLIQKIASTFALVFGDKLQKSPLDDYPLEPGLPLPSPERLKGKILIKDKVKKSKGIESSTGTLPRGAHLTSEDKAETLSRKSGTGDKVSDGNGGQATPTSKEFVMPSVALTSLSASSLVVKDKMDIANLREIVPLPESPLETSPGPRKTSPGLTETCPGSPGPIKTSPGPVDTSPSSPLHVVPTCTWSGLTTPSSANAGGPPGTSTELPLPESTPPPPLPPPSETTPFNLETVPIPGTPPPSSGVNRTEEIQDNESCPLSPLDTSTAPDPNIPTDSPKETAPHPVTPVNSLKETAFQNRSLKKTFSGMTEDSMESTPRKEEEFVYNMTPARPSEGEAFVTGPLVDIINYCSGITFEGFEAAEKTNCSFYQSSFNEDKGVSLVKVTAREFVKYNMRQMSRIYPQGGRINSSNYMPQIFWNVGCQLVALNFQSTDLPIQLNNAKYEFNGVTGYLLKPAAYLKERTTGGLFNPFIQNPVENIVPATLTLKVISGIFLTEKRTNCLVEAQMFGLPSDTVNHKFYTTKKEAPHPVWDHEPFTFAKILLPEMAMLRVAVYDEDRELLGQRSLPVNAIRAGYRHIPLRDKYNQPLSLASLFVHIMVDDWVGSDMEAIIAGLMDPIAFVNSALAELAIGTENEDQDPSLLSGSSTLPRTRKPENTDARKDSTTTVASPFPPSASFDQKVDAATIPSSPPVGSTAAAASSMAAPETKSLTLNYPKAKVDDVLPIVQMVTKRPPPVAAQHVDDCIAFHESILKIEKKMVTDRMKVLKKHEKHLSDHGSKQSKGKQEEVASRIAALKDDHSKELLALDKKLLHERNVKLETLLNEAHKKEMKDLIAQHRSEINSVSSELIMFLKRRDSDTKGRMAFDERTIAVGTKNKGELEKLHQKEKENLEKSQKEAKERLQKEYEESLNKLEHPKGTSGSPEQTKEEATAM

SEQ ID NO: 9799 - DNA, 4080 bp, Ephydatia fluviatilis
  CDS (119)..(3970)
taagcttgtgaaaccagatttcgtaaacaagcgtgaacgttagtgtgtcttgacacgagccgaagtcgactccaaacccctcttcgctcctcgacggcgcgtcatcggcttgctagccatgtcgcaaatcccaggtgccgtgtcgggagccgacatcggaacgatactaggtgccttggaacggggcaccgtcatggtgaggtttccggcgagaaaaaggaggccggagaagaagctgttctgtctaaaagtagacacctttgaggtcgtgcaatacccattgaccaagggcactcgaactgttgcggaagaatctattgacatccgagagataaaggaagtaagagaaggagtcagctcaaaggactttgagcgacagccggatgagacgaagaaagtggaccagtactgctgcttcgtgatctaccacgggacggagtttagactcacaacgctaagcgtagcagctttgtgtagggacgagtgtgatgcttgggtaaaagcactgaaacacgtcacgctcgctggaaactttgcctcccatctgttgacccatcgatggctgaacaaggagttcctcgccctggaaccatctggtgacaatctcacaattggaccgattgaattgaagaagtacgtattgaggatcagctctaaggcccttctcaacaaagccaggcagctgtttatagactttgactacagccgggcaggccgtatgggagtagaggacttctttaacctctaccacaacaccatacatgtcaagacgattggtgaacgattctatcctttctgcgctgatcgtcagagcctgacgtttagtgaggttcaaatgttcttcagagaggagcagaaggacaaacgtgctgatgacacagtgtacctggcagggctgatacgggagtatgccagagtaccaaatcgtactgtgcgcgacccacgtctcccttctctgcttctccctgagtttgtcaactttctgttctcaaagcaaaattctgtctttgccgaggagtacgcacagatctaccaagacatggatcgtcctatctctcactattggatagccagctcacacaacacgtacctgacgggtaaccagtattccagcgagtcttcgtgcgaatgctactcgagagcgcttcgaatggggtgcagatgcattgaattggactgctgggacggtcctgatggcaatcccatcatttaccacggccgaacactcacctccaagattcggttcattgatgtcatcaagaccatcaaagaccacgcctttgtgacctccgagtaccctattattctctccattgagcagcactgtgacatacagcagcagaggatcatggccaggcagttcaaggaggtgtttggagatgcgttactgactgaacttgtggacctgaatgccacaaggttaccatcacccaatgcccttaaaaggaaaatcatcatcaaacacaagaaacttgatggaacagaagagacctctggtaacaacaaacctgaagaggctggagaggaagaaggtgtgactttcaactcagatctgtgtaattccattctcaacggtctccttttcatgcaagacccaatagacaagaactgggccaaacattactttgtgttgactgaagataagctttatttcacggatcagcaggagaaagatgaggatgaagcggataagaccgagaccaacactgagacacttccatcaacagagcaacacctcaaggaaaaatggttccacggcaagctggcagggggaagagtggctgcagaaaagctgctgacagactacaaagatgtcaatggagccttcctggtgcgtgagagtaccacattcactggtgactactccctgtcctttgttcgcgatggcaagtacaaccactgtcgtatccacaccaagtctgaaggaggaaagaccaggttctatctaattgaccagaccttgtttgactccatctatgagctgattatgcactacaagtccaaccccttgaagagtcctacctttgagcaggtactggctgaaccagtgccccagcaaaacagccacctggggaaggcgtggtttcatgagaacctgtcacggtcagaagcagaagagatgttgaagaaagtgaggatggatggggcctttctgatcaggccaagtgagcaaaacactaaggctggacagaagaactatgcgatctccttcagggcggaggggaaagtgaagcactgtcgtatcgaagtggatgagagtggtcagtactgtatcggctctgccatctttgacagccttacagaactggtccagtactatgaggctaacccgctgtatcgtcgaatgagactgaagtatgccatcaatgaagatctgctgaagagtctcggagaagcggaatcagatgatgtgtactatcatcctatctactacactttcaatgaagagaaggccactcccattacttgcaaggccctctttgattatacggctgtacgacccgatgaactgtccttctgtaaagatgccgtgatcaccaatgtggagaagcatggaggtggttggtggaagggggactgtgggaacaagaaccagaagtggtttcctgccaaccatgtggaagaggtgcaggcggatgaggtcacagaggacaggcagttggggaacctgcagcaaggtgccatcgacatttctgggtgcaccaccgagattcatcatctctcctcgaataacctctacgccctgaagatcgtccctatgttgaaagctgagagcaccgagctagagaaggagaaccacatggggctcatggtggcagcacagtccctcgaagagatccttaggtggcagaaagccatcgatgaggcgcgcaacaaggcaaactcacatgccctggctcagatggagaaggagaaagagaggaagaaggacgagcagaagaagaggatcgccattgagatgtctgatatcattgcctattgtcgccctgtaccttttgatgaaaacaaaatgaacgatatgggcaagtactacaacatgtgctcgtttgttgagaccagggtggagaagattgtccacaataagagtttggctgcccagttcctggtacacgcccacacatacctgaacagggtgtatcccaagggacagcgcttggactcaagtaactatgacccagtccccatgtggaacggaggctgtcagatggtgtccctgaattaccagactggagacaagtccatgcagctaaatgaggggaagttcttgcagaatggaaagtgtggttatgtgctaatgtcagattgcatgttcgagccagggtttaaccctttggacatcagcactcagaaaaccagtcccatcaccctctccgtgcagattattggtgggcgccacctgctgaggcaaggacgtggcatgacatgtccactggtggaagtggaggtgataggtgtggaagtggattacaacaagtacagaacaagcacttgcaaggagaacggatttaaccctgtttggaacgaagggtgtgactttgatatcaacaatccagcccttgctctgttgaggttcaccgtactagatgaagatgcatttggagatgctaacttcctcgggcaggcagtgttccctgtgctatgcctgcggacaggataccgttcagtacctctgaggaacgccttctctgaagagctggagttgtgctcccttctggtgcacctagagatgcgcagtgctgtggaggagggggaggagttgtactgtaccatacgttccctcagagaagacatcactcggatgtccaagcagttccagcacatggtgcgcgaggacccagctactagctgtgatcagttggctgagatcatccaggagaaacagatgcaactgagaaagttgaacagtgccagagcccggaagcccggacaggcaaaacccgccctttctcacatcactatcccgcgataagggagtcgtttctgcaaaccatttgttcctttcctttcgtatttttttgtttgttgaaatctattttttgtagtgtttcgttgtatgggtgaataatagcatataaattg

SEQ ID NO: 9800 - protein, 1283 aa, Ephydatia fluviatilis
MSQIPGAVSGADIGTILGALERGTVMVRFPARKRRPEKKLFCLKVDTFEVVQYPLTKGTRTVAEESIDIREIKEVREGVSSKDFERQPDETKKVDQYCCFVIYHGTEFRLTTLSVAALCRDECDAWVKALKHVTLAGNFASHLLTHRWLNKEFLALEPSGDNLTIGPIELKKYVLRISSKALLNKARQLFIDFDYSRAGRMGVEDFFNLYHNTIHVKTIGERFYPFCADRQSLTFSEVQMFFREEQKDKRADDTVYLAGLIREYARVPNRTVRDPRLPSLLLPEFVNFLFSKQNSVFAEEYAQIYQDMDRPISHYWIASSHNTYLTGNQYSSESSCECYSRALRMGCRCIELDCWDGPDGNPIIYHGRTLTSKIRFIDVIKTIKDHAFVTSEYPIILSIEQHCDIQQQRIMARQFKEVFGDALLTELVDLNATRLPSPNALKRKIIIKHKKLDGTEETSGNNKPEEAGEEEGVTFNSDLCNSILNGLLFMQDPIDKNWAKHYFVLTEDKLYFTDQQEKDEDEADKTETNTETLPSTEQHLKEKWFHGKLAGGRVAAEKLLTDYKDVNGAFLVRESTTFTGDYSLSFVRDGKYNHCRIHTKSEGGKTRFYLIDQTLFDSIYELIMHYKSNPLKSPTFEQVLAEPVPQQNSHLGKAWFHENLSRSEAEEMLKKVRMDGAFLIRPSEQNTKAGQKNYAISFRAEGKVKHCRIEVDESGQYCIGSAIFDSLTELVQYYEANPLYRRMRLKYAINEDLLKSLGEAESDDVYYHPIYYTFNEEKATPITCKALFDYTAVRPDELSFCKDAVITNVEKHGGGWWKGDCGNKNQKWFPANHVEEVQADEVTEDRQLGNLQQGAIDISGCTTEIHHLSSNNLYALKIVPMLKAESTELEKENHMGLMVAAQSLEEILRWQKAIDEARNKANSHALAQMEKEKERKKDEQKKRIAIEMSDIIAYCRPVPFDENKMNDMGKYYNMCSFVETRVEKIVHNKSLAAQFLVHAHTYLNRVYPKGQRLDSSNYDPVPMWNGGCQMVSLNYQTGDKSMQLNEGKFLQNGKCGYVLMSDCMFEPGFNPLDISTQKTSPITLSVQIIGGRHLLRQGRGMTCPLVEVEVIGVEVDYNKYRTSTCKENGFNPVWNEGCDFDINNPALALLRFTVLDEDAFGDANFLGQAVFPVLCLRTGYRSVPLRNAFSEELELCSLLVHLEMRSAVEEGEELYCTIRSLREDITRMSKQFQHMVREDPATSCDQLAEIIQEKQMQLRKLNSARARKPGQAKPALSHITIPR

SEQ ID NO: 9801 - DNA, 3196 bp, Hydra magnipapillata
  CDS (117)..(3155)
acacatactgaaactttttagtccctgtgtaataagaaactggaagtattgataatgtagtaaaaagttcaccaagacttgatttaaaaaaagcagtttaaacaaaaacagcaaatatggcgggcgcaggcccaatttctgaaactcttcctgtaatttcagttccccccatgcttgtaaatggaggtagatttctaaaatgggacgatcaagacctaacctgcgccatttatatactggaagtagacaaacttggtcatgttttgagttggaaaccaaaagatttttctaaggacacggaagtgctggaattggttcttgtaagagatgtaagaactggacagtatgcaaagattccgaaagcacaggatactcgtgctagagatgctattaaaatgtatagtgctgttgagctggagagtaatttaatgcaagaacgtaccataacaatagtttatggaagcaattttgtagatcttacattcattaattttgttgcatctagtgtttcagaagcacaagaatggactgaggcattatttaaatgtactaataatcttcttgagttccattcaagtcctttgaagtgcttggagagattttatacaagaatatgtgtccaaaaaaaccagaatggagaaattccagtaaaaattttagttaaggcatttgttaaccacaaagaagatataaagagagcttatggtactctgcaatctttaggaattgcacatgggaagaaagacatgattgttctcaaagacttttcttttgaaactttttttacattttataatcgacttatatcaaggcatgattttgacaatgtctttacagagttaggagctaaaaataaaccttatttgacaacagatcaacttgtagagtttcttaataaccgccaacgtgatccaagacttaatgaaatactttttccttattataatataaatgctgcagatgccattgttaatacttatgaaccaaacaaatcatttgctgataaaggtttaatttctattgacggtctaatgaaatttttaatgagtaatgatgctaatgttcttttacctggaaagttgaatattcatcaggatctttcattcccaattgcccattatttcataaactcttcgcataacacatatctgcaaggccaccagttaacaggaaaatcttcagttgaaatatacagacaagttttactagctgggtgtcgctgcattgagttagattgctgggatggaaaaacagaagagcaagagccagttattactcatggaatgacattatgtactgaggtcttatttaaggatgtgattgaagcaatcaaagaatctgcattcaaaacttctgagtatcccgtcatattgtcttttgaaaatcattgcagtgctaagcaacaaatgaaaatggccaattattgtcttcaaatatttggagatcttctacttaataaagaattggatgaatacccattattaccaggaactctcctacctagtcctaaagtattaaaaagaaagatcttaataaaaaataaaaaaagggaaataaaagacacaaagaatgcaaacatatctactcaatcagttgatttaaactccagtggaagatttgaacctgaagttctcaatatagaagaaatacctgaagatgcagaagatctctcaaagtctgaagaagaggaagcgcctgaagttgaagcccaacaagagttatctgaacttgtaaattattttcaacctgttcattttagaggatttgaaaaagctgaaaaacgaaaatgttactatgagatgtcatcatttggtgaaaatactgccacgaacctgcttaaggagcaaccagtagaatttgtcaattataacaagtttcagaacagcagaatttatccaaaaggtagtcgtgtgagttctgataattacattccacagttattttggaatgctggctgtcaaatggtagcattgaattttcaaaccttagatgttcctatgcagcttaatcttggtaaatttgaaattaacggacgttgtgggtatttattaaaacctgaacacatgaggcgacacgatcttacatttgatccatttgttgattctacagtagatggcataatagctggtactgtacaagtcaaggttatttctggccagtgtttattagagagaagatctggaacctatgttgaagttgaaatgtatggattacctgctgatactgttcgcagaaaatatcgtactaaagttgtttcaaataatggattaaatccagtttatgatgaagatccttttaagtttaaggtaattttaccacatcttgctgagctgcgaatagcagtatatgaagaaaatggaaaaatgattggtcacagaatattacctgtggatggcttattgccaggttttcgccatattaagttgagaaatgaatcatatcaaccattatgtcttccaacattatttgttgatattgttaccaaagattatgtgcctgaaagtttttcagattttgctgatgctctatcaaatccaatgaaatatttatcagaaaaagagaagcgtactcaacagttagaagcatttgaatttgaagaatctgattcaacagccttacaggttccaacaacaaataaaaatatcttaaaagtaacagtacaagaaccacaaaatttagtaaaacacgggagtaaaatttcattgcaagcagatagttatcaaggtcaaaaagacaaatatgttgctgaacccatgaaacagactaaaagaaaacgctcacaatctcaatcgcttggaagactagaatcacctaaacaaccaatcagaagaacttttagcactccaaaattactaggagaagacacatctagtgactacctgaaaattagtggtttatcaattaatacattaaaggaacacaagctgtacaaaaaatggaaactgaaatttgatagtgattttcttaatttgatgcaaaaacaagcaaaaggacgaattcaatgcaggaaagaaatagaagctaaaacaaagaagttaactttgaatcttgagaaaaaaaatcagctttacaaaagaatcaaaacaaacttcttaaaacagcagaaactaatggaaattataatgaagtatacaataactgttcagctgaaatgaaacaattaaatacttattatgaggaagagattaataatttg

SEQ ID NO: 9802 - protein, 1012 aa, Hydra magnipapillata
MAGAGPISETLPVISVPPMLVNGGRFLKWDDQDLTCAIYILEVDKLGHVLSWKPKDFSKDTEVLELVLVRDVRTGQYAKIPKAQDTRARDAIKMYSAVELESNLMQERTITIVYGSNFVDLTFINFVASSVSEAQEWTEALFKCTNNLLEFHSSPLKCLERFYTRICVQKNQNGEIPVKILVKAFVNHKEDIKRAYGTLQSLGIAHGKKDMIVLKDFSFETFFTFYNRLISRHDFDNVFTELGAKNKPYLTTDQLVEFLNNRQRDPRLNEILFPYYNINAADAIVNTYEPNKSFADKGLISIDGLMKFLMSNDANVLLPGKLNIHQDLSFPIAHYFINSSHNTYLQGHQLTGKSSVEIYRQVLLAGCRCIELDCWDGKTEEQEPVITHGMTLCTEVLFKDVIEAIKESAFKTSEYPVILSFENHCSAKQQMKMANYCLQIFGDLLLNKELDEYPLLPGTLLPSPKVLKRKILIKNKKREIKDTKNANISTQSVDLNSSGRFEPEVLNIEEIPEDAEDLSKSEEEEAPEVEAQQELSELVNYFQPVHFRGFEKAEKRKCYYEMSSFGENTATNLLKEQPVEFVNYNKFQNSRIYPKGSRVSSDNYIPQLFWNAGCQMVALNFQTLDVPMQLNLGKFEINGRCGYLLKPEHMRRHDLTFDPFVDSTVDGIIAGTVQVKVISGQCLLERRSGTYVEVEMYGLPADTVRRKYRTKVVSNNGLNPVYDEDPFKFKVILPHLAELRIAVYEENGKMIGHRILPVDGLLPGFRHIKLRNESYQPLCLPTLFVDIVTKDYVPESFSDFADALSNPMKYLSEKEKRTQQLEAFEFEESDSTALQVPTTNKNILKVTVQEPQNLVKHGSKISLQADSYQGQKDKYVAEPMKQTKRKRSQSQSLGRLESPKQPIRRTFSTPKLLGEDTSSDYLKISGLSINTLKEHKLYKKWKLKFDSDFLNLMQKQAKGRIQCRKEIEAKTKKLTLNLEKKNQLYKRIKTNFLKQQKLMEIIMKYTITVQLK

SEQ ID NO: 9803 - DNA, 4358 bp, Hydra magnipapillata
  CDS (192)..(4286)
cccggttattgtcagatcaagcttgacaagattatgtaaaaagaggaattaagtaattgaatgttattattactattcaagagaatgaagttgtttctaatagtttcttaaactgctatctttgtgttagcatactatgcccaacgaatatcttgagcgtacaaaaatcgatgtcctaagcttaatttgaaatgcaaaataaattcttcaatgcaatagaaattaacgataaagttaaagaagtttttcagaaaggagtctatgttaaaaaactcgaagaggacaaatcttcaataagtacatgtttgctaaaaatcgatgcttttggattttttctttcatatcaagaaaaagataaagatgctttttgtattgacatttgcgacatcagctatgttaaagatggtgcaacaccaaaagctttaaacaaggtttttgagcaatattcagatgaagaaaaaaataatgttgattttttgagcagatttacatatatatgcttcggaacaaacattgtcgaagtgtcttttatcacttttgattttatgacaaaagaattaaaacagatttttttttcatgtattagcacaaatttaaccaatcataaacatgcatttagaaatccaagtgttaagcaaatgctttacaaacaatatgtactttcaaaatcaatggtgaatgcttctggaaaaatttcaatgaaaaatatttttaaatgtctaaatgcagttcgttttgagcaaaccactattgagggtatacaaacagctttatccttaccagttggggaaatagatcctgaaatgttcagctttgaacagttttacaagctatgttgccttgtttgcccaagaccagatattgatgaattgttcatttcattgtttggtactaggttaactgcagaaaagttaatgaagtttttgaatgaagaccaacgtgacccaagattaaatgaacaaatgcatcctcattgtacgatttcaaatgcagtagacctaataatggattatgaaagtaatgaagcatgtagaacaaaagagttgttgactattcaaggatttattcaattattactgagcaaggaaagtgcagttttaaacccagaatgtctgcttcttcgacatgacatgaaccaaccaatcaaccattacttcataaattcatctcataacacatacttattaggaaggcaagtttatgggaaatcaagtgttgaaatttatcgacaagttttaatttctggatgcaggtgtattgagcttgattgctgggatggtcctggagttccaattattactcatggtaaagcgatgtgtactaatgttttattttctgatgttgttcaagctattgctgatactgcttttctcacctccccctatccggttgtactttcatttgaaaatcattgcagccttccacaacaaaaaattcttgctgaaatgtgcattaaaatattcggaccactgctgcttgataaacctttggaatccaatccacttgagcctggtattgagctaccatctccagaacagttaaaatataaaatactcattaaaaacaagaaactagcatccaatgatgaaatgcagttttcaaatggaaaattgaattcttctgctaatatttcttacgatataccagtagaaatgccagaaacaaatacttctagttatagttcttgtgatgtgccagatttggaaagtgaaagtgaaatggaacatgataattgttttaatgaagatgatctaagtagaatggttactgaagataattttgaaacaaagctgaatgaaaaaatggatcaatttgcaaaacaagtttattcagaaagttcttctaataaccagcctgtgatgaggcgtcgatctacacaagaattcaatcttaaaaaatataaattatcaaaaattgctgaaaactgcgtagttgatgattctgaagatgagataatcctcactaagtttggttctaatccctgtattgcatcagctttaaatgaagaagtaaattctaacaccacaacttcagtgttagaatgcgaagataatagttctcatttcccttccaaatggcgatcacacagtgttgcaccattgaatcagtctgagactgaggcagtagatattaaacgaagagcaataagtgacatttcagacattgaaacttcaaaaaaagtttcaagtatgtctacggtaatgagcaatcttccggataacagcattattacaagtgttagtgggaaagttgatcctctcctctcttcattaattaattatgtacaacctcaatctttcaaaggttttgaatatgcagaagagcagaaaaagcattacattatgtcatcgttttcagaattagaaggactaaaacaatgtacagaaaatctcacagattttgttttatataacaagagacagttttccagaatatatccaaaggcaacaagagtagagagtacaaactatgtgcctcaggttttctggaatgctggctgtcaatttgttgcattaaatttgcaaacaccagatctgtctgtgcaattgaaccagcaaaaatttgagtgcaattttaattgtggatatcttttaaaacctgttaaatatcgtgaaactgattcaaattttgacccattaactgaaaatccaatagatgggattattccattaactgttgaaattgaggtaatttctggtcagtatctttcggaaaaaaaatgtatgacatatgtgcaaatagatatgtttggtttatcggcagacacaacaagaaagaagcgaacaaatctaagtgaatcaaatttaatgaatactgtttatcctaagactgtatttaaatttgataagattgtttttcctgagatggttcttgttcgttttactgtgtatgatgagtcagataagttgttaggacaaagagttttaccattggaaggtataaaatcaggctatcggcatatagcgatgcgcacagagacaggtcatttcttgccattaaccactttgtttgttaagtttacatttaaaatatatattcacgaaaagtatgaagatgctgtggaagagctgttcaatccaaacaaatataaattgctggctgaacatcgagcttctcgtatcgcaaaaaagttagaggatatgctgctttcagacgaggatatcattgttcaaaatccaaagttaattcaaatatgtggtgatcaagccaatagcacccctactgaaacaaaacgaaaatcaagcgtgagctcaatgggttctagcttgaatcatccaagcttaattacttcaaatacaattgacaattcatcaataaaaatgaaaagttttagtttaacttttgatgaaagcaacaatgggaatagaatgttagaactttgtgaggatgaattcttgaaagaaagaaaaattgatgattttaagttagataagatgtttttgcgtattgcaaaaaaaaatggtaaagaagtggatattcttaaacaaaatcatcgcaaggaacgcaaattaaccgaaagcttttatgatgaagaaatttcaaaattgcaaatgtattatgataaaacattagaaagcgaattaaaatcatttgaaaaaagtttacaaaaaatcaacaccaaagaagtccaagcaagttaccaaaaaatagtagaagacgtttcaattaaatttgataaaagttccagaaaaattattgacagtcaaatgatggagttaaaagagaagtatctagaaaaaacaaagatttggaaaactgaaaaagtgggaaagatatctgttattgttgaagagcaaaaaaaagcactgaaaataatgattgatgagcatatagaaaaagaagctcgaatcaagtattctcattccatacaacaaatagatttaataggtaaactattaaagactgcacaagacaatgatattaaaaaacttgcagaaataaatgaaaaagaactatcagatttgacaaaggcacaagcccgtgattctatccaaagtattaaagatttggagaaagagtttgaaaacagtaaaatggatcgcattaataaagaaaaaattaaacgtgagagagacaaattaagaattgaggagtttggtatgcagagaagaaagcttgttcaaaatcagcagaaacgacaagaaaagcttattgaaaagcataaaaatgaaaataaacaatttgaagatcatcgtaaagagattattcaactcggctacgagccaattatccgacatattaggcaagcccaaacgttaataagtcttcatcaacagaaattgtaattttttatgactttttataagtatttttttatatttttgtaaattattttttttataacttcaagtaaatat

SEQ ID NO: 9804 - protein, 1364 aa, Hydra magnipapillata
MQNKFFNAIEINDKVKEVFQKGVYVKKLEEDKSSISTCLLKIDAFGFFLSYQEKDKDAFCIDICDISYVKDGATPKALNKVFEQYSDEEKNNVDFLSRFTYICFGTNIVEVSFITFDFMTKELKQIFFSCISTNLTNHKHAFRNPSVKQMLYKQYVLSKSMVNASGKISMKNIFKCLNAVRFEQTTIEGIQTALSLPVGEIDPEMFSFEQFYKLCCLVCPRPDIDELFISLFGTRLTAEKLMKFLNEDQRDPRLNEQMHPHCTISNAVDLIMDYESNEACRTKELLTIQGFIQLLLSKESAVLNPECLLLRHDMNQPINHYFINSSHNTYLLGRQVYGKSSVEIYRQVLISGCRCIELDCWDGPGVPIITHGKAMCTNVLFSDVVQAIADTAFLTSPYPVVLSFENHCSLPQQKILAEMCIKIFGPLLLDKPLESNPLEPGIELPSPEQLKYKILIKNKKLASNDEMQFSNGKLNSSANISYDIPVEMPETNTSSYSSCDVPDLESESEMEHDNCFNEDDLSRMVTEDNFETKLNEKMDQFAKQVYSESSSNNQPVMRRRSTQEFNLKKYKLSKIAENCVVDDSEDEIILTKFGSNPCIASALNEEVNSNTTTSVLECEDNSSHFPSKWRSHSVAPLNQSETEAVDIKRRAISDISDIETSKKVSSMSTVMSNLPDNSIITSVSGKVDPLLSSLINYVQPQSFKGFEYAEEQKKHYIMSSFSELEGLKQCTENLTDFVLYNKRQFSRIYPKATRVESTNYVPQVFWNAGCQFVALNLQTPDLSVQLNQQKFECNFNCGYLLKPVKYRETDSNFDPLTENPIDGIIPLTVEIEVISGQYLSEKKCMTYVQIDMFGLSADTTRKKRTNLSESNLMNTVYPKTVFKFDKIVFPEMVLVRFTVYDESDKLLGQRVLPLEGIKSGYRHIAMRTETGHFLPLTTLFVKFTFKIYIHEKYEDAVEELFNPNKYKLLAEHRASRIAKKLEDMLLSDEDIIVQNPKLIQICGDQANSTPTETKRKSSVSSMGSSLNHPSLITSNTIDNSSIKMKSFSLTFDESNNGNRMLELCEDEFLKERKIDDFKLDKMFLRIAKKNGKEVDILKQNHRKERKLTESFYDEEISKLQMYYDKTLESELKSFEKSLQKINTKEVQASYQKIVEDVSIKFDKSSRKIIDSQMMELKEKYLEKTKIWKTEKVGKISVIVEEQKKALKIMIDEHIEKEARIKYSHSIQQIDLIGKLLKTAQDNDIKKLAEINEKELSDLTKAQARDSIQSIKDLEKEFENSKMDRINKEKIKRERDKLRIEEFGMQRRKLVQNQQKRQEKLIEKHKNENKQFEDHRKEIIQLGYEPIIRHIRQAQTLISLHQQKL

SEQ ID NO: 9805 - DNA, 2587 bp, Hydra magnipapillata
  CDS (157)..(2373)
ttcttagaaaaatttgaaagaaactttattaaaagttgcaaaaaaaaaaaaattctttttttagtggttatagttattggatttattgatgctatttatatcaacataccgagcataaatataaactcgacgacagtttcgtgaatccgcgtagaaatgacacaagaatacgaaaaaacacccaatcccgaaaatattgacgaaatattagtccatttatctagtggctgcaatgtgagaaagataaacttatctaaaaccagaaaagtagttagtaaaaaatatctggtgcttgatgaagataaaactgcatttcgatataagccatcagtaaaaggaagtaattttaaaattttgatcgcagacattactgacataaatgttgctgagtcatttgaaacaaaaatttgttttaagaagaaattgcttcatcagtttattgtgacttataaagatgatgaaaataaaacgcataagttaggattctttgtagaagatcaaaatgaagtgagattttggagctcaggtttacaatatttatcagatgagttaaaaaaaccagaagatcctattgtagacgattggttacgtgaagcatttgatgctgctgatgtcaacaagaatagtttactaggtcttaaagaaatttctcagctattgaactctttaaacatatccaaggaaaattcggatgtaaagttaaaatttcaagaatgctgcaatgaagaaaaaaataatgaaaatggaaaattaacacgtaatggatttgcagaatttttcaagttcttttcttttgataaaaatgaagtttctagcataatcaaggagtatggaagaactatttttggaaaaacttgtttaaatgcagaatctttgcagaaatattttagagaagtacagcagcaaaatttgagtctggaggaatgcaagaaaataatttcaaaacatgatgagaatagaggttcttatctttcagctgaaggagtaataagaatgttaatctctgaggaaaatgacattcttgatccaatacataaaaatattcatcaagatatgacacgacctttaactgattattttattaactcgtctcacaacacgtatctattaaatgatcaagttttaggcatgtctagtacaaaagcatatgagaaagctctaaaaaaaggatgtaaaactttagaattggactgttatgatggagaaaacaatgaaccaattgtctatcatggttttactttaacatctaaaattcttttcaaggatgtaattgatacaattgcaatgggtgcatttgtacagtcagagtatccagttattttatctttcgaaaatcattgttcacccgagcagcaaattgtcatggcgcagcatttaaaagaaaaactaggaaaaatgctatttgatggagatgtggatttaaatcaaactaagcttccctcaccagaaacattaaaaggaaaaatttttataaaggcaaaaaaaattcaaaatacagaagttactgatgatgacactagtgaaacaagtcttaagaatcgtcaatcaaaaactaaacagaaaattaatgtggctaaagaattttctaatattataaattatgtggagtccattacttttaagtcactggatgaaggacttgctactcaaaagtattttcaaaatgtatcgctcggagaaaagaaactattgcagcttggtagagatgaacctaaaaagttaattgagtatagtaataaatttttggtgagaacataccctaaaggctcaagaatagactcaagtaattataacccaacaaaaggttgggtgtatgggtgtcaaatagttgcattgaattttcaaacccctggtgaaatgatggacattaatgatggcatgtttgctttaaatgggaaatgtgggtatgttcttaaacctgagtgtttaagaagtggtaattttgatccacaaaatattgataaatcaataaatggtgtttgtaaagtttttatcaagattataagtggtcatctgcttccaaaagcttcaaaagatgaaactataccagatccttatatcagaataaacatacatggtatccctaaagatgaagttctgggaaaatttatcacaaaaaaagtaaaaagaaatggtttcaatcctcaatggaatgaagattttcaatttgacttgtatgcacctgaactagcgcatattagatttgcactctgtgatagtgacatgggagttgatgattttattggccagtactctatacctttttcagccataagaacaggttatcgaagggtgccactacttaagcgatcaggtcatccaattaaaaatgcttcgtttttggtttttatccaaaaaagtcttgcaaaatagtaatgcgtagcaaagactataaaatgctgtttcacattagatttatttgaagtacatatataaagtatgtatttggagtacgtaaatgaaatatgtatttgacgtatatgtgaagtatgtatttcgcataaggtgtgcttgaagcattaaatttatgaccttttttataaaaaatagtatatatttcaggtttattataaattttattagctag

SEQ ID NO: 9806 - protein, 738 aa, Hydra magnipapillata
MTQEYEKTPNPENIDEILVHLSSGCNVRKINLSKTRKVVSKKYLVLDEDKTAFRYKPSVKGSNFKILIADITDINVAESFETKICFKKKLLHQFIVTYKDDENKTHKLGFFVEDQNEVRFWSSGLQYLSDELKKPEDPIVDDWLREAFDAADVNKNSLLGLKEISQLLNSLNISKENSDVKLKFQECCNEEKNNENGKLTRNGFAEFFKFFSFDKNEVSSIIKEYGRTIFGKTCLNAESLQKYFREVQQQNLSLEECKKIISKHDENRGSYLSAEGVIRMLISEENDILDPIHKNIHQDMTRPLTDYFINSSHNTYLLNDQVLGMSSTKAYEKALKKGCKTLELDCYDGENNEPIVYHGFTLTSKILFKDVIDTIAMGAFVQSEYPVILSFENHCSPEQQIVMAQHLKEKLGKMLFDGDVDLNQTKLPSPETLKGKIFIKAKKIQNTEVTDDDTSETSLKNRQSKTKQKINVAKEFSNIINYVESITFKSLDEGLATQKYFQNVSLGEKKLLQLGRDEPKKLIEYSNKFLVRTYPKGSRIDSSNYNPTKGWVYGCQIVALNFQTPGEMMDINDGMFALNGKCGYVLKPECLRSGNFDPQNIDKSINGVCKVFIKIISGHLLPKASKDETIPDPYIRINIHGIPKDEVLGKFITKKVKRNGFNPQWNEDFQFDLYAPELAHIRFALCDSDMGVDDFIGQYSIPFSAIRTGYRRVPLLKRSGHPIKNASFLVFIQKSLAK

SEQ ID NO: 9807 - DNA, 5312 bp, Botrytis cinerea
  CDS (1483)..(4467)
ctgcaggcctgggattcggggattcttttcttgggcagaccagcacgccagcacgccagcaagccattgcaccctcacgcctcccacgacattccctcaaaaacactacctgcctacctacctacataccagggacagcgtattattcactctgacatccacccgcccactcatgcacctttttttagcatctgcactcataagctagccttgttcccttgttccctctctaccctaccttgcttgcctcccctgcgaccctaccaccctgctcccttgttgccatttgcaccacctgccacacgctccgcacactgtacacctccacccaccgccaaacccacttgcatagtacatacaacgtacatacagcgtacatacatacctgcacacaaccatcctccactcaccctccaccaccgcccaaaaaaataaaccgaaacttaaaaccccccccaccaccaccactaccaccaccactaccaccactaccaccactaccaccactaccaccaccaccaccataaacacacacacccgcgcactcgcaccctcaccctcacacacatacttacataccgcaacccaccaacccaccaaccctacagccctttgtcaatcctggtcgaacacgcacaatttcactcctacacaacagcaagctcgtgaaatcattcccaatctggtcgtctacgtctacgattcaccacgatcaaatgcaagatcatccagattcgacgtctcattgaacaggaaataaaagaaaaaagagcagaagaagagaaaacattgcgtatgattgaaaattgcgcgagaggaaatcaaagttgcatgttttggcgcatccaatccattcccctatcgaaatcctaaaatccatctctgctgcaaaataaacgaacgcatccatcacccatcacccaccactttctccaatttctcaaaagatatgcgctcaattacatttacatggtatagtgttctcaaccccgagttcagctattagttgatcgtacgaactggcgccgctggacaattcattgcaattgcaatctcaatatgaatgacggtgaatctccttccaagatgtcttctcttacgtcgagtcccaacctgactcccaccacctcgagagctcccacacaacaacaacaacaacaacaacagtctcctcacatgcccccgtatccacagaggtcgtcctccttaaatcgaagacgtggtatatcgcgtgtgcgaaccgaattccttcccactattacttccgctcccaccgttccaatgtcggcttcctcggtcaccacctcgagctctgtgcaagcatcgccagtcatgtcacccgaaactagtcaggtcatgaccaacaactcctcattacaagtatcgcccgaaggcccacgaggccgtgaacctgagcatcgcctcccccctttcgaacctctgggcgattcagtcgtctcacggaagcacagtcaaactgccatggccgagacattcacgggcaatcggtcgcaaggcttgatgaggaggttatcgaacaagatctcaagacgtcagtctacaaatacaagtcgggaacaaagtgctggcccagtcatgttgcgacgtcgaagcgacagcaccagtacagccccagattccagacactacctactcaactctgattccgacgaggacgttcacgaggataccattgaatgggtggattcgccattgggtatcgaaggtcttgtcggggactatcccagttccaatgcctcgttcgcttgctcgtcgaccatgactggcggcaacgcaggcctcgcattcggtccggttatccctacggttctgctccaaggcaccacgatgatcaagatcacaaagaagaagagaaaggttcttacatttgttctcgaagatgaagcttgcaaagtatcgtgggacaagacaagacccgcgaaaagcttcctcatcgacaacatcaaggaaattcgtctcggatcggacgcccttaactatcgcgaggaattcaaggttgactctcaggacgaacctcgtttcttctccatcctctacgtggtacctgacaataagtcgaccgggcgctcgacgaaaatcatgcatttgattgccccagatgaacaaacattcgacctttggacgacgacccttgaagctatatctaaacatagatatgaaaacatgtccagcctggttgcatttaatgagaaggctgtccgaaactactggcgcggcgaaatgaccaagcagttttccgacactcctcatgccgaagacgaagaggctctcgatttcgaaggagtcgagcagctttgcaaaaatctccacatcaacacttcgtccagattcttacgcgagagatttcaacaagcagatgctaccaagtcaaagaagttgatcttctccgagtttcaagaattcgtgaagctcatgaagcgaagaggggatgtttccgagatctacagagagctcgcttctgacaatgttaaaggaattacacttgaagagtttattgacttcgtcaacgtcgtgcaaggggaaaatgtggagaaggatcgagcgaaatgggaatctatttttgccaaatttgcccgtcgatcaagatcacgagatcagccattgcaagaaggtgaggctgcacgaatgagtgaagaagctctagccacatttttcacatccgtccataatgttcccctcgagactgttcccgagaccttcactctcgatcgtcccatgcacgaatacttcatctccagctctcacaatacctatctcatggggcgacaagtcgctggggaatcgagtgttgaggcctacatatctgctttgatcaaaggttgccggtgtgtcgaaattgattgttgggatggcaaggatgggcgaccgattgtcaatcatggtcacaccatgaccagacccatcatgttctcggatgtgatgtacactattgcgaaatatgcatttgtcaaatcacactttccattgtggatttctctcgaggttcactgcaacgatgctcagcaggcagccatggctcagattatcaaagaagcttgtggcgatttactcgtcacagagcctcttgatccatcttcccaggtgcttccttcgccctctcaattgatggatcgaatcttgatcaaagtcaagaaacccagaatctccgatgaatcctctcccaaggtcaatggccggtctcgtggcaacagtctcagctcacctcgcgtctatcccgcaggactcgataactcaaccatttccagtggctctctcctacctccacccactgcaaacccgagtggaagccatatcaagcaaaacattcgaaggactggaactgatgagactacgagtagcagcagtagcgacagtgaaggaaacgaagacaggcctaaggataagcccaagacgagcaagattgtcaaagttcttggggagcttggcatttacagtgctggtgttaaattccgtggctttgatgatcccgaaagcaaagcttacaaccacatcttctcattcatggagtctacctttgaccgaaatagcaagacgcaaattgatcgccgagcgatgactagacacaacatgagatatctcatgcgagtatatcctaatgggtggcgtgttgcatctacgaatttcgaccccctcaaatattggcgacgaagtgttcaaatggtggctctcaactggcagactcatgatctaggtatgcaaatgaatgatgctatgtttgcaggaggaaccgatcaatccggttatgttctcaagccaagcgagcttcgagagatcaaaatgcttcctagtgttccagaggaagcgggagcggatcacgtcaagagagaacgcaaaaatgtgaacttctccattgacattatctctgctcaacaactcatgcgcccaaagggtcttccttctaatcgttctgtcgatccatatattgaagtcgaagtttatcatgcggatgataagagcaaggagactaaaggtgtcattggcgaaggtggtcttgacgcttctgctaaggatggctcttctggtttaggagcccctcataaacgtcgcacacacatcgtccaggaaaatggcttcaatcccgtcttcaataagaaattcaatttcgctttgacaaccaagtttccagaactcgttttcgttcgctggactgttcgatgctcatcggatggccacagttacaacgataaaacgttaccactggctacatacactgccaaactcagcagtctcaaacaaggttaccgcactttacctctttacgacacaaacggtgatcaattcctcttctcgacactcttctgtcgtgtcaagattgatccagctacgagcatttatgtcaatgctgaatcaaatgaaagcgttggagtacttaagagtctcggtcgtaccgtcttcaaccgaacccctctttcaccaaaaccttccgtcgacagcaatcatcaatgatcccaacttacttcatactttaaacaatattcgatttatctgtacatactatatcaattgtaatatatatcatgtggggcgtttgtatcaaaaaggcgagataccatattacatttcaatttctttggacagaaatcggcatcgattctttggttcagcaattccgatttcatatggcgcatccagtcgcctcgagagtttaatcgatccacaatcgactttttttttttttctttttcacgcgttttttcttttcagcgaggcgcaactttttatttcgggagatcaacacaagggataccaacttgagcattctgcgatttacaatatcacagcataaggattatgattttattctgcaggggcgcgggcggcactcacatacatagggctgggatattaaaagtggctcgcgctgcctttttgctagcgattgcattttaaggggacaggcatctgcatactccacacagtttggtgtgaatgatttatgtcatttttcaccaaaaaaaaacaactccactcatttaattctagaaattttcctttgtttttcattttcacttttcactttggtaacatggcagttggtgggcatactatatcttgcttgtttttttttttcttccccaatttctcttcatggaatttccctcgcatcaaatatttcgggggtcgagcttttgggatggtatgggattggatgggatggaactggattgcacggaattgagcatcgtggaagcatatacgaatttgctggactggttctatgcgttgtttttgtttctaacacctggagctttatgatgggggcgttactttggcgtttcatatcctaggag

SEQ ID NO: 9808 - protein, 994 aa, Botrytis cinerea
MAETFTGNRSQGLMRRLSNKISRRQSTNTSREQSAGPVMLRRRSDSTSTAPDSRHYLLNSDSDEDVHEDTIEWVDSPLGIEGLVGDYPSSNASFACSSTMTGGNAGLAFGPVIPTVLLQGTTMIKITKKKRKVLTFVLEDEACKVSWDKTRPAKSFLIDNIKEIRLGSDALNYREEFKVDSQDEPRFFSILYVVPDNKSTGRSTKIMHLIAPDEQTFDLWTTTLEAISKHRYENMSSLVAFNEKAVRNYWRGEMTKQFSDTPHAEDEEALDFEGVEQLCKNLHINTSSRFLRERFQQADATKSKKLIFSEFQEFVKLMKRRGDVSEIYRELASDNVKGITLEEFIDFVNVVQGENVEKDRAKWESIFAKFARRSRSRDQPLQEGEAARMSEEALATFFTSVHNVPLETVPETFTLDRPMHEYFISSSHNTYLMGRQVAGESSVEAYISALIKGCRCVEIDCWDGKDGRPIVNHGHTMTRPIMFSDVMYTIAKYAFVKSHFPLWISLEVHCNDAQQAAMAQIIKEACGDLLVTEPLDPSSQVLPSPSQLMDRILIKVKKPRISDESSPKVNGRSRGNSLSSPRVYPAGLDNSTISSGSLLPPPTANPSGSHIKQNIRRTGTDETTSSSSSDSEGNEDRPKDKPKTSKIVKVLGELGIYSAGVKFRGFDDPESKAYNHIFSFMESTFDRNSKTQIDRRAMTRHNMRYLMRVYPNGWRVASTNFDPLKYWRRSVQMVALNWQTHDLGMQMNDAMFAGGTDQSGYVLKPSELREIKMLPSVPEEAGADHVKRERKNVNFSIDIISAQQLMRPKGLPSNRSVDPYIEVEVYHADDKSKETKGVIGEGGLDASAKDGSSGLGAPHKRRTHIVQENGFNPVFNKKFNFALTTKFPELVFVRWTVRCSSDGHSYNDKTLPLATYTAKLSSLKQGYRTLPLYDTNGDQFLFSTLFCRVKIDPATSIYVNAESNESVGVLKSLGRTVFNRTPLSPKPSVDSNHQ

SEQ ID NO: 9809 - DNA, 2066 bp, Nicotiana rustica
  CDS (77)..(1843)
gcacgagttttcttctatattatcaagatttttgggatccaaaaaccccccatttaagtctgaaaaatcttgaaaaatggggagttatagagtatgtgtatgttttacaagaaagttcagagtaacagaagcagagccaccatcagatgtaaaagaagcattcaagaaatatgctgaaaatgggaaccaaatgaattcagaacagttattgaaattcttgattgaagtacaaggagagacccttttcactgttggtgatgctgatgttattgttcgtcaaatccttcagaaaagacatcccattactaagttaactcgtcaaactcttgctcttgaagattttcatcatttcctcttcaatactgaccttaatccaccaattaattataaggttcatcatgatatgaatgctccactctcccattattttatattcacggggcataattcttacttgactgggaatcagctgacgagtgattgcagtgatataccaattataaaggcgctgaaaaaaggtgtaagagtgatagagcttgatatatggccaaattctgacaaggatgacatacacgtacttcacggaaggacagtgacaacccctgtggaattaataagatgtctcaagtcaataaaagaacatgcatttgtggcttctccttatcctgttgttattacattggaagatcacctaacgcctgatcttcaggctaaagtggctcagatgctcactgaaacatttggagaaatgctctttgttcctgaatcagattctctaaaggaatgccctacaccagaagaactaaagcatcgtataattatttcaaccaaacctcctaaagagtaccttgaggccagtgccagtacaactgctagtaaagagagacggaatagctcccagagatcaaattgttccgaggatgatgtatggggcgctgaaccttcaagcttgacagccaatcaagaagaaaatgaaaagagcgacagtgataattttgaagatgacgatgactccagtcacagaccacagttagcatctgcttataaacgcctgatcgccatccatgccgggaagcctaaaggcggattaaaggaggcactgaaagtcgatcctgataaagtaagacgactaagtttaagtgaacaggctctcgaaaaggctgccgaatctcatggaacggaaattgtgaggttcacgcaaagaaacattttaagggtgtaccctaaaggtactaggtttaactcctccaactacaagccactaatcggttggatgcatggagctcagatggttgcatttaacatgcagggatacggaagagcactatggttgatgcatgggatgttcagttcaaatggaggctgtggttatgttaagaagcctgatttcttgctaaatgttggtcctaataatgaagtttttgatcctaaggcaaagttgccagttaagaaaaccttaaaggtgaaagtatatatgggagacggatggcatttagatttcaagcaaacacactttgacttgtattcgcctccggacttctacacaagggttgggatagccggagtgcctgctgatgagataatgaagaaaacaaagactaaagaggataaatggacgccagtttgggatgaagaatttaccttcccactaactgtgcccgaattagctttgcttcgaattgaagtacacgagtatgacatgtcagaaaaggatgattttgcaggccaaacatgtatacctgtttcagagttgaaacctgggattcatgcagttcccctttgcgaccgaaaaggtgagaaatatagttccgcgaggctactcatgcgctttgagttcatataaggttttgttattgcgtgtttttctcgtgctttttttttgtgtgtcatgggatatgttatagcatacatttttagcgctttgagttcgtataatgttgttatgttctccttggagaagcttgtattgtacagaattttctacaagtaaacaagattctaatgcaatgagattggtttttttatatgagtttagaatttgacttgcaaaaaaaaaaaaaaaaaaa

SEQ ID NO: 9810 - protein, 588 aa, Nicotiana rustica
MGSYRVCVCFTRKFRVTEAEPPSDVKEAFKKYAENGNQMNSEQLLKFLIEVQGETLFTVGDADVIVRQILQKRHPITKLTRQTLALEDFHHFLFNTDLNPPINYKVHHDMNAPLSHYFIFTGHNSYLTGNQLTSDCSDIPIIKALKKGVRVIELDIWPNSDKDDIHVLHGRTVTTPVELIRCLKSIKEHAFVASPYPVVITLEDHLTPDLQAKVAQMLTETFGEMLFVPESDSLKECPTPEELKHRIIISTKPPKEYLEASASTTASKERRNSSQRSNCSEDDVWGAEPSSLTANQEENEKSDSDNFEDDDDSSHRPQLASAYKRLIAIHAGKPKGGLKEALKVDPDKVRRLSLSEQALEKAAESHGTEIVRFTQRNILRVYPKGTRFNSSNYKPLIGWMHGAQMVAFNMQGYGRALWLMHGMFSSNGGCGYVKKPDFLLNVGPNNEVFDPKAKLPVKKTLKVKVYMGDGWHLDFKQTHFDLYSPPDFYTRVGIAGVPADEIMKKTKTKEDKWTPVWDEEFTFPLTVPELALLRIEVHEYDMSEKDDFAGQTCIPVSELKPGIHAVPLCDRKGEKYSSARLLMRFEFI

SEQ ID NO: 9811 - DNA, 1841 bp, Arabidopsis thaliana
  CDS (111)..(1712)
ctgagagtttcaaagtgtgcttctgttgcagcagaagctttaaggagaaaacgaggcagccaccagtgagcatcaagagactcttcgaagcttactcaagaaacggcaagatgtctttcgatgagcttctaagatttgtgagtgaagtccaaggagaacggcacgcagggttggactacgtgcaagatatcttccacagcgttaaacaccacaacgtttttcatcaccatggacttgttcatctcaacgccttctatcgctacctcttcagcgataccaactctcctcttcccatgtctggccaggtgcatcatgacatgaaggcgccgttatcgcattactttgtgtacacgggacataactcttacttgactgggaaccaagtgaacagcagaagcagcgtagaaccgatcgtgcaggctctcagaaaaggcgtaaaagtgatcgagctcgacttatggcctaatccttcagggaacgctgctgaagttcgtcatggcaggacgcttacttcgcatgaagatttgcagaaatgtctaaccgccattaaggataacgcgtttcatgtgtctgactatccagtcatcatcactctcgaagatcatttgccacccaagcttcaagcgcaagttgctaagatgttaactaaaacatacagagggatgctgtttcgtcgtgtctcagagagttttaagcattttccatcaccagaagaacttaaggggaagatcctgatctctacgaagcctccaaaggagtatcttgagagcaaaactgtacacaccacaagaactccaacggttaaagagacttcgtggaacagagtagcgaacaagattcttgaagaatataaagatatggagagtgaagctgtaggatatagagacttgatagcaatccacgctgcaaactgcaaagatccttcaaaggattgcttgagtgatgatccagagaagcctatacgggtcagcatggacgagcagtggctagacactatggttaggaccagaggaacggatcttgtcaggtttacacagaggaatctggtgaggatatatccaaagggcacaagagtggactcgtcaaactacgatcctcatgttgggtggacacacggtgctcaaatggttgcttttaacatgcaaggacatgggaagcaactatggataatgcaaggaatgttcagggggaatggtggatgtgggtacgttaaaaagcctcgcatcttgctagacgagcacacactcttcgacccttgcaaaaggtttcccattaagaccactcttaaggttaagatttacactggcgaaggatgggatttggatttccatcatacacactttgatcaatactctcctccagatttcttcgtcaagattggaatagcaggagtaccgagagacacggtctcatacagaacggaaacagctgtcgatcagtggtttcctatatggggcaacgacgagttcctgtttcagctgtctgttccagaactggcgcttctgtggttcaaagtccaagactacgacaatgacacccagaatgatttcgcaggacagacatgtcttcctcggccggaactgaagtccggagttagaccgtccggcttcacgatcgaacagcaaggcctacaagaacacgaggcttctcgtcacgttcgccttggatcctccttatacgtttcgttgaatctcgttttctttccgaaataagccacacagtgtgtatctctgtttgcacgtttataaatttataatgtacaattatttgcgccctagctagaacgggataaagtgtgacaacatataaatactattaaagattcgatatttgatgactgt

SEQ ID NO: 9812 - protein, 533 aa, Arabidopsis thaliana
MSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPRPELKSGVRPSGFTIEQQGLQEHEASRHVRLGSSLYVSLNLVFFPK

SEQ ID NO: 9813 - DNA, 1961 bp, Arabidopsis thaliana
  CDS (50)..(1735)
ctgtttcttgtttttctctctcgcttaactttcacaagaaaaaaaaaagatgaaagaatcattcaaagtgtgtttctgttgtgtaagaaacttcaaggtgaaatcaagtgagccacctgaagaaatcaagaaccttttccatgattactctcaagacgacaggatgtctgctgatgagatgctcagattcgtgatccaagttcaaggagaaacacacgctgatatcaactacgtgaaggatatcttccacagacttaaacatcacggcgtttttcatcctcgtggaattcatcttgaaggattctaccgttatcttcttagtgatttcaactctccattgcctctgacccgcgaggtttggcaagatatgaatcagccattatcgcattacttcttgtacacgggacataactcttacttgactgggaatcagttgaacagtaatagcagcatcgaaccgattgtgaaagctctgagaaatggagttcgtgtcattgagcttgatttatggcctaactcttcaggaaaagaagctgaagttcgtcatggagggacgttaacgagtcgtgaagatctgcagaaatgtcttaacgtggttaaggagaacgcgtttcaggtgtctgcttatcctgttgtgcttactttagaagaccatttaactccaattcttcagaagaaagtcgctaagatggtgagtaagacgtttgggggatcattgtttcaatgtacggacgaaactacagagtgttttccttcaccagaatcactcaagaataagatcttgatctcaacaaagccaccaaaagagtatcttcagacccaaatctcaaaaggttcaacaacggatgaatccactagagctaaaaaaatttcggatgcagaagaacaagttcaagaagaagatgaggagagtgtagcgattgaatacagagacttaatctcgattcacgctgggaaccgcaaaggagggttgaagaattgcttgaatggagatcctaaccgagtcatacggttaagcatgagtgagcagtggcttgagactctggcaaaaacccgtggacccgatttagtaaagttcacgcagcggaatcttttgaggatatttcccaagactacacggtttgactcatctaactatgatcctctcgttgggtggattcatggggctcaaatggttgccttcaatatgcaaagccatgggaggtatctgtggatgatgcaaggaatgtttaaagccaatggtggatgtggctatgtgaaaaagcctgatgttttgctctccaatggtcctgaaggtgaaatctttgacccttgtagtcaaaacctcccgatcaagacaactcttaaggtgaagatctacactggagaaggatggaatatggactttcctttagatcactttgaccgatactctcctcctgatttctacgcaaaggtcggaatcgcaggggttccattggacacagcaagttacagaacagaaatagataaagacgaatggtttccaatttgggacaaggagtttgagttcccattacgtgttcctgagttatctcttctgtgtatcacagtcaaagattacgacagtaacactcagaacgatttcgctggccagacatgttttccgttgtcggaggtaaggccaggtattcgtgccgttcggctccacgatcgtgccggagaggtctacaagcacgtgagactgctcatgcggtttgtcttggagcctcgttagcgcttcgtggataatgttcatttcatcactcgtgtcaatgtcggtacacgttttttatgtttgtaatgttaaggtgtcggtatacattagtcagtcatactaagccatacgataataagagatgtgaaaagaaaaaattaaacgtaattaagatcagcaaaattatgaaacgtatgactttaatataaacaatttgtttgaacagttgataaagataattttgttt

SEQ ID NO: 9814 - protein, 561 aa, Arabidopsis thaliana
MKESFKVCFCCVRNFKVKSSEPPEEIKNLFHDYSQDDRMSADEMLRFVIQVQGETHADINYVKDIFHRLKHHGVFHPRGIHLEGFYRYLLSDFNSPLPLTREVWQDMNQPLSHYFLYTGHNSYLTGNQLNSNSSIEPIVKALRNGVRVIELDLWPNSSGKEAEVRHGGTLTSREDLQKCLNVVKENAFQVSAYPVVLTLEDHLTPILQKKVAKMVSKTFGGSLFQCTDETTECFPSPESLKNKILISTKPPKEYLQTQISKGSTTDESTRAKKISDAEEQVQEEDEESVAIEYRDLISIHAGNRKGGLKNCLNGDPNRVIRLSMSEQWLETLAKTRGPDLVKFTQRNLLRIFPKTTRFDSSNYDPLVGWIHGAQMVAFNMQSHGRYLWMMQGMFKANGGCGYVKKPDVLLSNGPEGEIFDPCSQNLPIKTTLKVKIYTGEGWNMDFPLDHFDRYSPPDFYAKVGIAGVPLDTASYRTEIDKDEWFPIWDKEFEFPLRVPELSLLCITVKDYDSNTQNDFAGQTCFPLSEVRPGIRAVRLHDRAGEVYKHVRLLMRFVLEPR

SEQ ID NO: 9815 - DNA, 2696 bp, Rattus norvegicus
  CDS (143)..(2461)
gaagcagtcaagtgcaaaggagaaaaggagtcttctcattctcagtggagagcattgtggagctcgggagacgacgctcacagacacaggattactatcctacccacggtgactctggcaccagctggtggagcagtgggggatggcatctcagattcaaaagctactgaccactaatcaggacctgctgctgatgcaaaaaggaacgatgatgcgcaaggtgaggaccaaaagctggaagaagctaagatacttcagacttcaggatgacggcatgacggtctggcatgggcggcaccttgaaagcatatccaagcccactttttcaatctctgatgtggagaggatccgtaagggccaggattctgagctgttgcgctatctggtggaagagttccccctggagcaaggcttcaccattgtctttaatgggcgccgccccaacctggacctagtggccaacagtgttgaagaggcccagacttggatgcgaggactccagctgttggtggatctcgtcgccagaatgaactaccaggagcagctggatcaaatgttgagagaatggttccaacaagcagacagaaaccaggacagccggatgagtttcagagaagctcaacggctgctgcttctgatgaatgtggaaatggatgaagaatatgccttcagtctttttcaggaagcagatgtttcccaatctaatactctggattcagaagaatttgtacagttctataaggccctgactaagcgcactgagattgaagaactatttgagaacttttcatctgacaaacagaagctgaccttgctggaatttgtagatttccttagagaggaacagaaagaaagcgaccattcctctgaccttgctctgaaactcattgaccgctatgagccttctgagaatggcagattgctacgtgtgctgagcaaggatggcttcctcagctacctctgctcagcggatggaaacatcttcaaccccgactgcctccctatctatcaggatatgactcagcctctgagtcactactacatcaactcctctcacaacacctacctactgggtgaccagttttgtggccagagcagcgttgaaggatacatacgggccttgaaacgggggtgccgctgtgtggaggtggatacatgggacggacctgacggagagcccgttgtttatcatgggcgtacactgacctctcgtatcctgttcaaagatgttttggcaacattagcacaatatgccttccagtcgtcagactacccactcatcttatctctggataaccactgcacttgggaacagcagaagaccatggcacaccatctgattgcgatcctgggagagcagctgctgagtaccaccctagaggaacaactgattgatataatgccctcgccagagcagcttcgggggaagatcttggtaaaaggaaagaagttgagaacaattgaggttgttgagtctgacaaggaggaagaagagctggagaaagatgaggggtcagatctggacccagcctccgctgagcttgacatgcagtctcagcccgagtcccaggagcaggcctctgggaacaagagcaagaacaagaagaagtttcttctccagagttccacaaccatcctatgcccagacctatctgccctggttgtctacttgaggactgctcccttctgcagcttcactcactccaaagaaaactaccacatctacgacatttcatccttttctgagtccaaggccaagaacctcatcagggaggcaggcaatgagtttgtacagcacaatgccagacagctatgccgtgtataccccagtggtctgaggacagattcatcgaactataacccccaggaacactggaatgttggctgccaaatggtggccatgaacatgcagactgcaggaagtgcaatggacatctgtgatgggctcttccgccagaatgggggctctggctatgtgctgaagccagaattcctgagagatacccagagttccttcaatcccatgaagcccgttagtctttataaagcccagatccttgtagtccaggtgatcagtggtcaaagactccccaaagtggacaaaaccaaagagacaaccgttgtggatccactggtgagagtagagctctatggtgttcctgaagacacaaagcagcaagagaccagctatgtggagaacaatggtattaatccatactggggggagacattctatttccagatccaggtgcctgaacttgctatgctgcgttttgtggtaaaggattatagcaggacatcccgaaataactttataggccaatacaccctgccttggacctgcatgaaacatggctaccgacatgtatccttgctctccaaagacggcactagcctccatccagcctccatctttgtgtacacctgcatgcaagaagacctggatatggatgagccctgagaaacacagggagggtcttgaagcaggacaatctacagatgcactcttttccaacctacaacttcctcagcatccagagccagccaaaggatcagtggcggaccaaggttcccaggtgaaggttgaggaagaatcctgacccagaactatgactctagagaacagtgcacagccgagtccccactggactgctgctccttagctggtctaaatagagcttctctgtccaacttga

SEQ ID NO: 9816 - protein, 772 aa, Rattus norvegicus
MASQIQKLLTTNQDLLLMQKGTMMRKVRTKSWKKLRYFRLQDDGMTVWHGRHLESISKPTFSISDVERIRKGQDSELLRYLVEEFPLEQGFTIVFNGRRPNLDLVANSVEEAQTWMRGLQLLVDLVARMNYQEQLDQMLREWFQQADRNQDSRMSFREAQRLLLLMNVEMDEEYAFSLFQEADVSQSNTLDSEEFVQFYKALTKRTEIEELFENFSSDKQKLTLLEFVDFLREEQKESDHSSDLALKLIDRYEPSENGRLLRVLSKDGFLSYLCSADGNIFNPDCLPIYQDMTQPLSHYYINSSHNTYLLGDQFCGQSSVEGYIRALKRGCRCVEVDTWDGPDGEPVVYHGRTLTSRILFKDVLATLAQYAFQSSDYPLILSLDNHCTWEQQKTMAHHLIAILGEQLLSTTLEEQLIDIMPSPEQLRGKILVKGKKLRTIEVVESDKEEEELEKDEGSDLDPASAELDMQSQPESQEQASGNKSKNKKKFLLQSSTTILCPDLSALVVYLRTAPFCSFTHSKENYHIYDISSFSESKAKNLIREAGNEFVQHNARQLCRVYPSGLRTDSSNYNPQEHWNVGCQMVAMNMQTAGSAMDICDGLFRQNGGSGYVLKPEFLRDTQSSFNPMKPVSLYKAQILVVQVISGQRLPKVDKTKETTVVDPLVRVELYGVPEDTKQQETSYVENNGINPYWGETFYFQIQVPELAMLRFVVKDYSRTSRNNFIGQYTLPWTCMKHGYRHVSLLSKDGTSLHPASIFVYTCMQEDLDMDEP

SEQ ID NO: 9817 - DNA, 2541 bp, Plasmodium yoelii yoelii
  CDS (1)..(2541)
atgaaaacattagatattagtgacaatcaaaatgagcataatttacaatgtaatgctaatatcgaactcaacagttttatggtttctgaccattcaaaacaatatgataaagattatgcaatgattttaaatatattgagagataaatatggagtttattctactactaattataatgataagttttatatgaactcacataacaaatcagaaaaaaaatataaacgtgaaatatatacatatgaagaaaacaacagaaaagaacaaactaatgaaatctctaaagaagataaaaataaagacgatttttattttatacgaaccaatattatatataagtcattaaatacaataaaaaaatataatattccatttgttataatcaatgaaggtaatcattatttgacacaaattggattagtttattttttgttatcaaaagaaaatagtattatgtgcccagaatatgctaaggtatatcaaaatatgaacttgcctttatgtaattattggattaatagtagtcacaatagttacttaggtagaaaacaaatatttagtgcaagtagtatcgaacaatatatatatatattaatagatgggtgtagatgtgttgaatttgattgctattattttaataaaaatattgttgtatatcatggtttatatgggtacaaattaacatcatccatattattttgtgacactttaattgcttgcaaaatgtttggattttcaacatcaccctatccaataatattgtcattagaaattcattgtaaagataaacataaaaatttaatcgcaaaaattttaatatatatattaggtaatcaactttatatacccaaaacaaaagacgaaattaataatataacaccaaataattgcagaaataaattcttagttaaatataaacattttgataataattatacttcaagcttttatagcatatttgaaggcttaaaaaatgtcatgtatgacgaattaggatacttctcagatattattaatgaacaggaagacatagatgttgatgaacccaaagaatatcaaattatagaaaaaaaaaatgaaaaatataataaaattagcattgaaaatcaaaatatggaaccagaagatcgggttaataattatatcgaacaaaataattctaaaaatactagttataaaaataatcaagttcagaaaacaaataaaaatagtgatcaaaataatttgtgtggtaatgaaaatgtctcacaaagggaccgacatgaagtggacagtaattacagtagtagctctagtagtaattgcctatatgaaaataatactattcataaaactcaaattgatgaaaagtatagaaaaaatgataactgctcaaataataattcaggattcaataatagtagcgttcccaataatactaacacttcagattctattacaaattgtggtaaaaatatgtctgaaactgctcatatgtcaaaggaggaatataaaaaaaaacaagataacgaaaaatataaaaataatatattaaacaaatgctcatgcttaaaaggatatgtatttagaaatttccaagaaaatagaacatacaatgaaatatgttctattagtgaaaataaatttataaaattaattaaaaaaaatgaagacgatgttatcaaatataaccaaaaaacattaacacgtgtatatccatctggtactagattagcttcaacaaattttaacccacttattttttggagtgctggaatacaatttgttgcattaaattatcaatataatggattaagcatgttattaaataaagggcgatttttagaaaatggaggaaaacattcaggttatatattaaagcccgaattattacgatttaataaaaaacatgattataatgtcttatcattaaatatacaaatattatcattacaccaaattaatttgctattttcaattaaaaataaatatcaagaaaaaaaattaaaaaaggaactattcaaaatggacatgattcaacgtatacaaactcataaaaaaattagcaataaaaggaaaaaatttaagtatttgcaaaaattggaaagagaaaagaaaagcccacttctttcagatatacaatcagatgatagcaaaaaaaaaaaaaaaattagtaatgaaacattattaaaaaaatttaaagataatgacaacgatgttaattatattcataaaaaattcgcaaatattgaaaaagaatatgaagatatgttgacagaatataaatcatttttgttatgttccacattatcccatagcagtagttttaatagttgtagtagcgttacaacaacatcaaataatactacagattcaaataaaaaagtatcatctaaatccaaaaaaaaaaatttttaccaggcttttctagaattaaaaaaagcaaataatttatttttctatctctacgttactatttctatacatggttataatgagcaaaaatgttattttaaaacagaaatcgccaaagttaacttctatgacataaattattggtaa

SEQ ID NO: 9818 - protein, 846 aa, Plasmodium yoelii yoelii
MKTLDISDNQNEHNLQCNANIELNSFMVSDHSKQYDKDYAMILNILRDKYGVYSTTNYNDKFYMNSHNKSEKKYKREIYTYEENNRKEQTNEISKEDKNKDDFYFIRTNIIYKSLNTIKKYNIPFVIINEGNHYLTQIGLVYFLLSKENSIMCPEYAKVYQNMNLPLCNYWINSSHNSYLGRKQIFSASSIEQYIYILIDGCRCVEFDCYYFNKNIVVYHGLYGYKLTSSILFCDTLIACKMFGFSTSPYPIILSLEIHCKDKHKNLIAKILIYILGNQLYIPKTKDEINNITPNNCRNKFLVKYKHFDNNYTSSFYSIFEGLKNVMYDELGYFSDIINEQEDIDVDEPKEYQIIEKKNEKYNKISIENQNMEPEDRVNNYIEQNNSKNTSYKNNQVQKTNKNSDQNNLCGNENVSQRDRHEVDSNYSSSSSSNCLYENNTIHKTQIDEKYRKNDNCSNNNSGFNNSSVPNNTNTSDSITNCGKNMSETAHMSKEEYKKKQDNEKYKNNILNKCSCLKGYVFRNFQENRTYNEICSISENKFIKLIKKNEDDVIKYNQKTLTRVYPSGTRLASTNFNPLIFWSAGIQFVALNYQYNGLSMLLNKGRFLENGGKHSGYILKPELLRFNKKHDYNVLSLNIQILSLHQINLLFSIKNKYQEKKLKKELFKMDMIQRIQTHKKISNKRKKFKYLQKLEREKKSPLLSDIQSDDSKKKKKISNETLLKKFKDNDNDVNYIHKKFANIEKEYEDMLTEYKSFLLCSTLSHSSSFNSCSSVTTTSNNTTDSNKKVSSKSKKKNFYQAFLELKKANNLFFYLYVTISIHGYNEQKCYFKTEIAKVNFYDINYW

SEQ ID NO: 9819 - DNA, 4929 bp, Anopheles gambiae str
  CDS (1)..(4929)
atggagaacgtgctgttcgaaagtctgtacagcttgatcatgtactaccggcagaatgcgttgcgaagtgcggaattttacatcacactaaaggaaccggtcccccagccgaacaagcacgagacgaaggaatggtaccaccagacgaccacgcgcgaacagtcggaaatcgtgctcaaccagataccgcaggatggcgcctttctggtgcggccgagcgaaaagggaccgaaagcattcgttatatcgtttcgagcgcacggtaagtttaaacactgccggatccgggtggaaggccgcctgtacgagatgggcgggatggagtttgaaagtttggtcgatctggtcaacttctactcgaagcacccactgtaccggaaggtgacgctcacgtacccgataccgcgcgagatgatacgccgcatcaacacgatggatgttccggaggaaagtggcggctacgggtatatggatccggccacggttaccaacgaaaacgtgacggtaaaggcgctgtacgactacaaggcgcagcgggacgacgagctgtcgttctgcaagcacgccatcatcacgaacgtggtgaagcggggcaacgactggtggctgggcgattacggtggcaagcggcagcactacttccccgccaactacgtgcaggagctgagcgcgatggacgacgggacgctggtggaggagggcgccaatgagccgctgatgctgggcagcctgcagaagggctcgctggacgtgcatggggcggtggtggagatggcgtacagcaaccatccggacattgagcgcatcctgcgcatccaaaacccgacgatgcagaacgtgttcgaggtgggcgtgcagacgaaggagctggcgtacgagtggatgtgcgcgatcaaggaggcggcgcagaacgcgagcgcgatggagaacgagcggcgcaagatggagcgcaactcgcgcgtcgccaaggagatgtcggatctgatcatctattgccgcagcgtgccgttcaagcatcatccggcggcgtgggtgttttacgaaatgtccagcttcccggagacgaaggcggaaaagtactttctgcaggcggaaacgcgcgccctgtttgtgcgctaccaccggaaccatctgagccgggtgtacccgaaggggcagcggctcgactcgtccaactaccatccgacggcactgtggaactgtgggtcgcagatgattgcgctcaacttccagacgccggacaaaccgatgcagctgaatcaggccaagtttcgggacaatggcggatgcgggtacttgctgaagccggagtttatgtttcgcgatgagttcgatccgaccgatccgaacacgctggtcggggtgggcgaggtgatcgtgaacgtgcgcatcattggcgggcgcaatctgtgcaagatcatctggtcctcggtgcagacgaacgggcgcagcaactacgaggggtcgctggagctgcgcgaggtgaaggaggtgcggcccggcaaaaagtcgaaagactttgagaagtggccggaagaggccaagaagagcgaaccgcgcaaatgtttcgtcatcctgcacgggaatgattttaagctgcgcaccgtttcgatcgtggcattctccgaaaaggaagcggacatgtggctgaaaggactgaagtatctgatctcggacacggtgagcgccccgtactggctgcagatagagcgctggctgcggcgcgaattctacctgatggaggcgaacggcacggccagcctgaaggacgtgcggtcctttctgccgaagattaactgcaaaatatccaccgccaaactgaacgaagtcttccacgaggtggacacgcggcgccgcaacgagctcgggttcgacgactttacccgcctgtaccagcggctgatactgccgccggcctcgctgccggagtacttcgatggcctgcggatggccacgtacagccagaacggggagacggtgacgctgcaagagtttcgccgctttctcaccaaagagcagcaggaggacgagggaagtcccggtggtgggcacagtgaggaaacggtggcgaagttcatcaacgactacatccaggatccggcacgcgacgtgagcgaaccgtaccttcggctgcatgagtttatcgactttctgttttcccgccaaaacgaaatctgggacaagcggtgcgacacggtgtaccaggacatgagccgcccgctcgcccactactggatctcgtcgtcgcacaacacctacctaaccggggaccagttttccagcgaatcgtcggtcgaagcgtacgcccgggcgctgcgcatgggttgccgctgcatcgaactggactgctgggacgggccggacaatatgccgctcatcttccacggccacacgttcacgacgcgcatcaagtttatggacgtgatacgcacgatcaaggagcacgcgttcatcacgtccgagtacccgctgatactgtcgatcgagcagaactgctcgctgacgcagcagcgccggatggcgcaagcgatgctggaagtgttcggggagatgctgctgacgcaaccgatcgacaaggcggaagcgcagctaccgtcgccgcagcagctgaagcgcaagattatactgaagcacaagaagctgccggagaacgggatgctggtggtggacgaggcgggcaaggagtcggccgtactgatgcgcggcaacgatgagagcgagctggacatacggaacacggtgaagaacgggatcctctacctggaggacccggtggacaagggctggaatgcgcactttttcgtgctgacgcagcacaagctcttctatacggacagtcagcgccccgatcgtgacgcggatggacgggatgatgagcgcgaagagaacggattcgccaccaaccgacagtcccgggacggcgcagtgctgtcgaacgatgagctacactttggcgagaattggttccacggcaagctgtcggggggtcgcgaggaggcggaaaagttgctgcaacagttttcccacctcggcgatgggacgtttctcgtgcgcgaaagtgtcaccttcgtgggggactactgtctgtcgttctggcgccagggcaaaccgaaccactgtcgcatcaagctcaagcaggacaagggtgtgacgaagtactacctgatggagaacgtgctgttcgaaagtctgtacagcttgatcatgtactaccggcagaatgcgttgcgaagtgcggaattttacatcacactaaaggaaccggtcccccagccgaacaagcacgagacgaaggaatggtaccaccagacgaccacgcgcgaacagtcggaaatcgtgctcaaccagataccgcaggatggcgcctttctggtgcggccgagcgaaaagggaacgaaagcattcgttatatcgtttcgcgcgcacggaaagtttaagcactgccggatccgggtggaaggccgcctgtacgagatgggaggaatggagtttgaaagtttggtcgatctggtcaacttctactcgaagcacccactgtaccggaaggtgacgctcacgtacccgataccgcgcgagatgatacgccgcatcaacacgatggacgttccggaggaaagtggcggctacgggtatatggatccggccacggttaccaacgaaaacgtgacggtcaaggcgctgtacgactacaaggcgcagcgggacgacgagctgtcgttctgcaagcacgccatcatcacgaacgtggtgaagcggggcaacgactggtggctgggcgattacggtggcaagcggcagcactacttccccgccaactacgtgcaggagctgagcgcgatggacgacgggacgctggtggaggagggcgccaatgagccgctgatgctgggcagcctgcagaagggctcgctggacgtgcatggggcggtggtggagatggcgtacagcaaccatccggacattgagcgcatcctgcgcatccaaaacccgacgatgcagaacgtgttcgaggtgggcgtgcagacgaaggagctggcgtacgagtggatgtgcgcgatcaaggaggcggcgcagaacgcgagcgcgatggagaacgagcggcgcaagatggagcgcaactcgcgcgtcgccaaggagatgtcggatctgatcatctattgccgcagcgtgccgttcaagcatcatccggcggcgtgggtgttttacgaaatgtccagcttcccggagacgaaggcggaaaagtactttctgcaggcggaaacgcgcgccctgtttgtgcgctaccaccggaaccatctgagccgggtgtacccgaaggggcagcggctcgactcgtccaactaccatccgacggcactgtggaactgtgggtcgcagatgattgcgctcaacttccagacgccggacaaaccgatgcagctgaatcaggccaagtttcgggacaatggcggatgcgggtacttgctgaagccggagtttatgtttcgcgatgagttcgatccgaccgatccgaacacgctggtcggggtgggcgaggtgatcgtgaacgtgcgcatcattggcgggcgcaatctgtgcaaggtgagccgcaacattaccagcccgctggtggaggtggaagtgctgggcgcatcgttcgacggtggcatcaagcatcgtaccagagcgatagcggacaacgggctgaacccgatctggaacgaaatctgcgagtttcggatagcgaatccacactttgcgatgatacggttcgaggtgcaggacgaggacatgttcggcgagccgaactttattggccaggccgtctttccgctcggctcgatccgcaccggctaccggagcgtggtgctgcgcaacaagtacagcgaggagctcgagctggccacactgctggtgcacaccagcatccggccactgcagacggagtga

SEQ ID NO: 9820 - protein, 1642 aa, Anopheles gambiae str
MENVLFESLYSLIMYYRQNALRSAEFYITLKEPVPQPNKHETKEWYHQTTTREQSEIVLNQIPQDGAFLVRPSEKGPKAFVISFRAHGKFKHCRIRVEGRLYEMGGMEFESLVDLVNFYSKHPLYRKVTLTYPIPREMIRRINTMDVPEESGGYGYMDPATVTNENVTVKALYDYKAQRDDELSFCKHAIITNVVKRGNDWWLGDYGGKRQHYFPANYVQELSAMDDGTLVEEGANEPLMLGSLQKGSLDVHGAVVEMAYSNHPDIERILRIQNPTMQNVFEVGVQTKELAYEWMCAIKEAAQNASAMENERRKMERNSRVAKEMSDLIIYCRSVPFKHHPAAWVFYEMSSFPETKAEKYFLQAETRALFVRYHRNHLSRVYPKGQRLDSSNYHPTALWNCGSQMIALNFQTPDKPMQLNQAKFRDNGGCGYLLKPEFMFRDEFDPTDPNTLVGVGEVIVNVRIIGGRNLCKIIWSSVQTNGRSNYEGSLELREVKEVRPGKKSKDFEKWPEEAKKSEPRKCFVILHGNDFKLRTVSIVAFSEKEADMWLKGLKYLISDTVSAPYWLQIERWLRREFYLMEANGTASLKDVRSFLPKINCKISTAKLNEVFHEVDTRRRNELGFDDFTRLYQRLILPPASLPEYFDGLRMATYSQNGETVTLQEFRRFLTKEQQEDEGSPGGGHSEETVAKFINDYIQDPARDVSEPYLRLHEFIDFLFSRQNEIWDKRCDTVYQDMSRPLAHYWISSSHNTYLTGDQFSSESSVEAYARALRMGCRCIELDCWDGPDNMPLIFHGHTFTTRIKFMDVIRTIKEHAFITSEYPLILSIEQNCSLTQQRRMAQAMLEVFGEMLLTQPIDKAEAQLPSPQQLKRKIILKHKKLPENGMLVVDEAGKESAVLMRGNDESELDIRNTVKNGILYLEDPVDKGWNAHFFVLTQHKLFYTDSQRPDRDADGRDDEREENGFATNRQSRDGAVLSNDELHFGENWFHGKLSGGREEAEKLLQQFSHLGDGTFLVRESVTFVGDYCLSFWRQGKPNHCRIKLKQDKGVTKYYLMENVLFESLYSLIMYYRQNALRSAEFYITLKEPVPQPNKHETKEWYHQTTTREQSEIVLNQIPQDGAFLVRPSEKGTKAFVISFRAHGKFKHCRIRVEGRLYEMGGMEFESLVDLVNFYSKHPLYRKVTLTYPIPREMIRRINTMDVPEESGGYGYMDPATVTNENVTVKALYDYKAQRDDELSFCKHAIITNVVKRGNDWWLGDYGGKRQHYFPANYVQELSAMDDGTLVEEGANEPLMLGSLQKGSLDVHGAVVEMAYSNHPDIERILRIQNPTMQNVFEVGVQTKELAYEWMCAIKEAAQNASAMENERRKMERNSRVAKEMSDLIIYCRSVPFKHHPAAWVFYEMSSFPETKAEKYFLQAETRALFVRYHRNHLSRVYPKGQRLDSSNYHPTALWNCGSQMIALNFQTPDKPMQLNQAKFRDNGGCGYLLKPEFMFRDEFDPTDPNTLVGVGEVIVNVRIIGGRNLCKVSRNITSPLVEVEVLGASFDGGIKHRTRAIADNGLNPIWNEICEFRIANPHFAMIRFEVQDEDMFGEPNFIGQAVFPLGSIRTGYRSVVLRNKYSEELELATLLVHTSIRPLQTE

SEQ ID NO: 9821 - DNA, 3456 bp, Neurospora crassa
  CDS (1)..(3456)
atgtcttcaactacagaggctctcttggtttcccaaaactccccttcgactttgcccgaggccatatcccgtaccatggccccaaatacctcaccatcgcggcgggcacgtcctgctcatgttcagacagctctcacgctacagccccaggctttcaccaatgtatctccgctgtccgccataagcacgtcgtctgcgtcgcccacgtcacaacaaccctctccggccttgacaccagacacggccggcgccatattcacagaaagcagctcccttcagggttcccctgcgactttcgtatcttccacgacaaaggggatggactcttacgcttctacgattaagggaatggaggaaccagttacgcctcttaacctccccgagccactagccccagcccctttgtcatcgaagaaaagcagtaactcgctaaaaaggaatggagagaaaagcggcgagaagatccccaggcaacagaatgctatgggcgaggctctgtccaaaagtagctttgcgggtagtctggtccgtcgcgcttcaaacacagtgaacaaagcgcgcgacatacttacacgaagagcatcaatgaacattgtcaatcgggatgctgacccgatggtggcgtctttgcgccgtgggagcaacaccttcccactcggggaacacaactacagaggtcacttgctggaatcagatgatgagtgtgccatagatgacgccggtccgttggacgggttgcgagacgctcaaattcccctgagcattggacccgagattccggttgctttacgccaaggtgtcatgttgaaaaaaatcagcaagaagaaaaaggaaaagagaatcaccctcacccttgatccagacacttccaagatatggtgggacaagagtcgaacagggagaaagtctgtgttcatcgatgacatcaaggaagtaaggacagccgaggacattcgacagtaccgtcttgacgccggggttgaagaatctgaagagcccaggtttttctcgatcctgtatacagtcccagaaaagtcaggaaccaaggtgttgcatctcattgccctgaattccaccgactttcgcaattggaccacgacactcgatgctatacttcaatatcgccaggattttacgacaaacctgatggccttcaacgaaaaggccgtccacgagttctggcaacgacaaatgagaaagaagtacgcagatagggtcattccggctgaaggcgaaaccattgaacttcccgacattgagagaatctgtcgctctcttcacatgcacctatcgccgacagaaattcgcgacaactttaacgctgctaaagctgccaaggctacctccaacggggtctgtgatcccacttccccttccagtttgaacttcaacgagtttaaagagttcgtgcggctattgaaggcgaggtctgagatcagccatgtcttcaagaatcatacgaccaaccctaaagcagggatgacgaggcaagaattcatacaattcttgaaggagattcaatgcgaagacgtggaggaagattctacgcattggaacaatatcttctctcagttcgcgcgtagacgcaggtccaaagatgccgagcagaccatcagcggggatgagtcattgaccatatctgaggctggcttcactggatttctcaattcacatttcaacagtttgctcatccaggagccatccgaatatgttctcgaccgaccaatgaatgagtattatatctcaagctcacataatacatatcttcttggtcgccaagtccgtggaatctccagtgtcgaaggctatatttcggcacttgagcgtggttgcagatgcgttgaagtcgactgctgggacggcccgaatgacgagccttatgtgtcacacggccatacctggaccacaaggatcaagtttgaagaggtgatcaaaaccatcaacaagtatgcctttgtcaagtctcgctttcctctctggatatcgctggaggtccgctgtaacgctgcgactcaagccaacatggcaaagattatgattgacatattcggcgacaagcttgtccgggcacccctcgatccatcctcggatcgacttccctcaccgtctgacttgattgagcgcatcctcatcaaggtcaaaaagtctcagccagtacctaacacaccatctgaggagtcgctgaagactgagcgacctggtcggcggcgcggcaacagcctaccctcaccttatcagaggccgtcacctttaccatctcccatggataacacatccgtcgctgttcctggaagtccctcgttgagtccaagtccgatgttgcgagcgacacggcaaattaacaccatcacggaaggcgaggttcattcccacggggggcctagcaacagccccagcgaatacgagagtgatgctgaaaaggattcggggaagaaggtggtgagcaaaatcaaccctatcctcggtgaactgggcgtttattgcatgggcgttcactttgatgggttcgacagccccgacgctaaaaagttcaaccatatcttttccttcaaagaaaagacctttgctgagagaagccagccgggtgaagcaaagcgtgctttgtaccgtcataacatgcgctatctcatgcgtgtgtatccgaacggaggtcggatatcttctagcaactttgacccgctcctctattggaagcgcggggttcaaatggcagcactgaactggcaaacattcgatctggggatgcagctgaatcaggctatgtttgatagtggcaccgacctgtccggttatgttcttaaacccctcgagggacgtcagattcaagtcgtcccgacggatgctgccgggcagctatcgggtaaaagaccacggaagaggatctcgttcaagattgaggtcatctctgcgcagcagctgatgaggccattgaatcttcccaaggggcggacgcttgatccctacgtcgaagtcgagattttcctggccgatgacaagaggaataagcaagatggtgccacaaatgcaccagctcaggagacgcagctgaaatatcgcaccgacatcgtcaaagacaatggcttcaaccccgttttcaaaggcaataactcttatgagttcattgttaccaccaagtaccctgatctcatctttgtgcgctggagcgtgaagcttggcgacaacaaaggatacaacgaccgcagcccccccttggcgactttcacagctaagcttggcggcctcaagcaaggctaccgcacgataccgctgcttgatcacaacgggtataactacctattctcgaccctcttctgcaaaatcaccaagagccagcctaccgatatcatggttacctactccagtgaagttccaaggaacagtgttagcaggatcaagaacatttttaatcagtccggcatcagccccaaatccagcatggatagtggccgggcctga

SEQ ID NO: 9822 - protein, 1151 aa, Neurospora crassa
MSSTTEALLVSQNSPSTLPEAISRTMAPNTSPSRRARPAHVQTALTLQPQAFTNVSPLSAISTSSASPTSQQPSPALTPDTAGAIFTESSSLQGSPATFVSSTTKGMDSYASTIKGMEEPVTPLNLPEPLAPAPLSSKKSSNSLKRNGEKSGEKIPRQQNAMGEALSKSSFAGSLVRRASNTVNKARDILTRRASMNIVNRDADPMVASLRRGSNTFPLGEHNYRGHLLESDDECAIDDAGPLDGLRDAQIPLSIGPEIPVALRQGVMLKKISKKKKEKRITLTLDPDTSKIWWDKSRTGRKSVFIDDIKEVRTAEDIRQYRLDAGVEESEEPRFFSILYTVPEKSGTKVLHLIALNSTDFRNWTTTLDAILQYRQDFTTNLMAFNEKAVHEFWQRQMRKKYADRVIPAEGETIELPDIERICRSLHMHLSPTEIRDNFNAAKAAKATSNGVCDPTSPSSLNFNEFKEFVRLLKARSEISHVFKNHTTNPKAGMTRQEFIQFLKEIQCEDVEEDSTHWNNIFSQFARRRRSKDAEQTISGDESLTISEAGFTGFLNSHFNSLLIQEPSEYVLDRPMNEYYISSSHNTYLLGRQVRGISSVEGYISALERGCRCVEVDCWDGPNDEPYVSHGHTWTTRIKFEEVIKTINKYAFVKSRFPLWISLEVRCNAATQANMAKIMIDIFGDKLVRAPLDPSSDRLPSPSDLIERILIKVKKSQPVPNTPSEESLKTERPGRRRGNSLPSPYQRPSPLPSPMDNTSVAVPGSPSLSPSPMLRATRQINTITEGEVHSHGGPSNSPSEYESDAEKDSGKKVVSKINPILGELGVYCMGVHFDGFDSPDAKKFNHIFSFKEKTFAERSQPGEAKRALYRHNMRYLMRVYPNGGRISSSNFDPLLYWKRGVQMAALNWQTFDLGMQLNQAMFDSGTDLSGYVLKPLEGRQIQVVPTDAAGQLSGKRPRKRISFKIEVISAQQLMRPLNLPKGRTLDPYVEVEIFLADDKRNKQDGATNAPAQETQLKYRTDIVKDNGFNPVFKGNNSYEFIVTTKYPDLIFVRWSVKLGDNKGYNDRSPPLATFTAKLGGLKQGYRTIPLLDHNGYNYLFSTLFCKITKSQPTDIMVTYSSEVPRNSVSRIKNIFNQSGISPKSSMDSGRA

SEQ ID NO: 9823 - DNA, 2133 bp, Neurospora crassa
  CDS (1)..(2133)
atgccagcagctgtccatggcacgccatatctccccgatggagctcatcaaggaggcggtggcttatctggcgccgaccagaagataaagacactgagccccgccgttgcggctcatttacaacgcatctacagcgcacacgccgacaccgtgactaaggcctggcgccaggaggacgtttccgtctggctcaggtgctgtcaaggtgacgacgaggccgagcttgctcgagacttcccgcttcatcaggactgggattacgagagcttttttcagtatatcacttcttcagccgccaactcgattgcgcctccgcgttcccaggacctcagttacccgctctcaagctacttcatcagttccagccacaacacttatctgacaggtaatcagctctccagcgactcgagcgtcgatgcctataggaacgttttgttgcgcgggtgccgctgcatcgaggtggacgtctgggatggctcggactccgagtcggaggatgacgatggtgacgccgagtctgtgacttcgagcagttccagctccagcgatgatgcctatggcagtggtgaggagggaatagcgagcaagttgaagaggaaagcgaagagaaagctgcctagctttcttggtggaaggaagaagtccaaggacaagaaagttccggagcccaccacaacaacgccgccgccgccgccgcctgcagcagcaacaaccactgaggccgccccagtaggactatcagccgaaacgaaccccttggagaggtgcaagagcggcggctctgcctctttattccaaactctcagtaggaagagcaccaaagagccgcgagtcctgcacgggtacacgctaactaaagacatcaccttccgagacgtgtgcgaggctatcaaggactacggttttgccacaaccgacttgcctctgatcgtcagtctcgaggtgcactgcagcgctgagcagcaggaaatgatggttgacattatgaggcagatctggggagacttgcttcttcctgagccggaggaggatgccaaatatcttcccactcctgaagagctgcgcggcaaaattctcgtgaaggtcaagtacgctccacccaacaatgaagggggctcgacgggctcgacgacccccgaggagctggacaacaccgccgccgcggcttctggaagactatcagaagaagcgggccaaccgaagcagcgggcgaagaaaccgtcgaaggttatctggagtttgagcaagatgggcatctacacgcgcggtgtgtcgttcaaaagtctgatgcagcccgaggccaacatgccgacgcacatcttttcgctgtcggagagtggcgtgatggatgttcacaaggagagtcgtagcgcgctcttcgagcataacaagcactatctgatgcgggcgtacccgtctggtatgcgtatcttgtcatcaaacctggatccggctgtgttttggagaaaggggatccagattgtggcgctgaattggcagaattgggatgagggcatgatgctgaatgagggcatgtttgctgggacgggcggttatgtgctcaaacctgctggctaccgctgcgccaaactcaccgactctaatccgtccccctccccctcacccttggcctccgacacccaagccgacgccgtccagcactacaccatggatcttaccatcaatgttctcgctgctcaatcgctcccccttccccccggagacgacaacatcgactctttccgcccttacctgaaagtcgaactacacgtggaagagcctggagagcggcacggtaccgacgagctgccgcaggacggcaaagaaaaagggggcgagtacaaggccaagaccaaatctataaagggaggatgcgatccggattgggaggggaagttcggtgcccagacagaactgaaatttgagaatatccctggtgtagtcccggagctctcgtttgtgaggttcttggtgctggatgatgagattggaagggattcgttggcggcgtgggcgtgcgtgaggctggatcggttgagggaagggtatcggtttgtgcatcttttggatgcgaaggggatggagagtgatggggctgttttggtgaagataagcaagaagttgaggttgtaa

SEQ ID NO: 9824 - protein, 710 aa, Neurospora crassa
MPAAVHGTPYLPDGAHQGGGGLSGADQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTTTPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGSTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 9825 - DNA, 1797 bp, Neurospora crassa
  CDS (1)..(1797)
atgtcgtgcataccgtttcgtcgcacggcaaagaagaagaaggagaaaccgtcgtttatgcggaggatgacaaccatgaaaattgcttctcccagtcagccgacctccgctttgttcatggcttctctgctatcgtcagcacaagtcttcaacgctatccacaaacccatgtacatccacgatgccttcaagaaacacgccgtgaaggtttggaaagaagctcgcggaagcgacaaactactcacgcacgaaaagctcctccgctttttcgagataacacaaggcgtcacaaccacggctcttccagtcaaggacgtttatacctttgaggaattcttctgggcttggagcagcaacaaggcagcgtggaatgctgtacggcccttggatcctaccgaaatcgacctcacctatccgattagcaattattttattagtagcagtcacaacacttacttggaaggaaaccaactatcatccaagagttccgcagaggcatacaaagccgtgttacggaacggatgcagatgcatcgaaatcgacgtatggaatggtgccccgtcacgaaccccatccaagtctccgaatggggaacatcgccgacacatatcaaatgtttccgccatgtcacgaacgagtgtccgacatggctcaagcctgagcgtcgatcagccaggtctttacacaatgcgaactccccgagacagcggtacgagtctggatccaaaggaactgagcgaccgtatggatcgatccacatcatcatcatccgggtccgtcaagaggggtgaacccatcgtgcaccatcatggaactatgacaaccacagtacctttcagggaggtttgcaaggctgtcagagaagaggcgttcgtaacgaatcatctacccatcattgtcagtttggaggttggtgcggaccgtgagcaacaagagatgatggtggagatcatgaaggaggaatgggccggtttgcttctcgaagagcctttcgagaactgcgatcgcctaacacagcaacctcgactggaacaactgctcgacaagattctgatcaaggtgaagcggctggatgattgcaatggcgagatacaggaagctcagcgtgggcggtctctacatgtcagctccctgcgctccaaaccaccaatttgcgaaatgcttgctgccctagctatttacacgcgcagtgagcattttaacgatgtcaactctttagcctcaacaactcccagccatatcttcagcgtgaacgaggacaagttcatagatatgatatcacaggatgaggccctgtcgaagatcatggaccacaacaggcagtactttatgcgaatatatcccaaaggtcttcgcttcgacagcagcaaccccgaccctactattccgtggcgacgaggtgtgcagatggtggccatgaactggcagaataccgacgaaggcacgatgctcaacgatgccatgtttgcggacacaaatggctggattctcaagcccactggttttctgaaaaatcaagacgagataccgacaaagactgtcgacctacgaatcactgttctcgcaggacagtcgatccccgtacctgagggtcggcaggctaagaagctgcgcacccgagtgaaggtggagttgcacgtcgagaatccagacaaggcgcgtgacttgacgcgaatcactcaaccacagtcaaccgagaatccagactgggaacgaaatccacatccgctcgagttcctgggcaccacaactactggtcgcttgaacctttactgcccacctgtccatttgaattga

SEQ ID NO: 9826 - protein, 598 aa, Neurospora crassa
MSCIPFRRTAKKKKEKPSFMRRMTTMKIASPSQPTSALFMASLLSSAQVFNAIHKPMYIHDAFKKHAVKVWKEARGSDKLLTHEKLLRFFEITQGVTTTALPVKDVYTFEEFFWAWSSNKAAWNAVRPLDPTEIDLTYPISNYFISSSHNTYLEGNQLSSKSSAEAYKAVLRNGCRCIEIDVWNGAPSRTPSKSPNGEHRRHISNVSAMSRTSVRHGSSLSVDQPGLYTMRTPRDSGTSLDPKELSDRMDRSTSSSSGSVKRGEPIVHHHGTMTTTVPFREVCKAVREEAFVTNHLPIIVSLEVGADREQQEMMVEIMKEEWAGLLLEEPFENCDRLTQQPRLEQLLDKILIKVKRLDDCNGEIQEAQRGRSLHVSSLRSKPPICEMLAALAIYTRSEHFNDVNSLASTTPSHIFSVNEDKFIDMISQDEALSKIMDHNRQYFMRIYPKGLRFDSSNPDPTIPWRRGVQMVAMNWQNTDEGTMLNDAMFADTNGWILKPTGFLKNQDEIPTKTVDLRITVLAGQSIPVPEGRQAKKLRTRVKVELHVENPDKARDLTRITQPQSTENPDWERNPHPLEFLGTTTTGRLNLYCPPVHLN

SEQ ID NO: 9827 - DNA, 3015 bp, Misgurnus mizolepis
  CDS (87)..(2411)
gagctatggtgtagtgtgcgagacacaaagtcgtcggggtatgttgtcggctgcctgtttttatttctgtgcgtaaaaatcggaccatgcagtgtgtacgaagacaacatgtacggaccaaatcccaagatctattatacagcgcgcagatcgaggaagctgcgcgcgacaacatgaaacttctaggtttggagggggatacagacctgcagttcttattgaatggcggggatcttttgaaagtgcgttcaggctcgtggaaaaagattcgctacttcaagctgcaggaagactgcaagaccctgtggcatgaatccaaaaaaaccctgaagtccaaacaaacattctctgttgaggacatcgaggcgatacgaacaggccgacagactgaaggtttaaagaagtacacaggagatgcactggagggtcaggcattctctatcttgtttaaggggcggcagaaaagcctggacctgatcgccaactccgaggatgaggccaagaagtggatcaatggtctggaaaaggtcatatcaaacatgaacaatctcagtccgctcaagaagaccgagcactggatctatagctgcatgcgaaaatcagataaagactttgacaagaagatgagtccaaaagagctgaagagctttctgcaaagcatcaacattgaggtggatgatgactacgccaagatcctctttgagaaatgtgacacgtcaaagtctggattcatagagggaaaggagattgagcgtttctataaaatcctgacgcatagggaagagattgatgtcatctatggagaatacgcaaagacaggcagtctcatgagcaccactgacctgctgaacttcctgttgaaggagcagaaagacagtgcatctcagaccgatgctcttcagctgattgacaaatatgagcttgacgaagatgccaaagcaaaacagctcatgacaaaggatggcttcctaatgtatctgcaccagccggaaggcctgatctttaaccaggcccataaaagcgtttaccaggacatgaaccagcctctcaaccattacttcatctcctcttctcacaacacgtacctgatggaggaccagcttaaaggacccagcagcactgagggttacataaaagcacttgttaagggctgccgctgtgtggagatggactgctatgatggatcagatggagagccggtcatttatcatggaaacactctcaccccagagatcttctttaaagatgtgatacaagccgttaaggaatatgcctttaagacgtctgcatatcctgtgatactgtctttggaaaaccactgtggtttggagcagcagaaggtcatggctcagcacatgatctccatcctgggtgacgctctggtgaccaaaccccttggagataagatgccaacatgttttccttcccctgaggagctaaagggccggtttatagtcaaagcaaagagtcggggcaaacttgaggacaaattttcagatgaggaaaaagcagaagatgcaggaagtgtaacagaggaagaagatgatgaaggcgaggaagatgaagaaaagaagactgataaatcaaagtcaatgaaggtggcaaaggagctgtcagatcttgtcgtctactgtaaaagcgttcccttccatgggtttgaggattccagggaaaagcagtcgttttatgagatggcctcttttaaagagagtaaagctgtaaaactggcagaggagaacgcaaatgaatatattcgccataatacagacaaactcagccgcatttatccatctggactaagggcggactcttcaaactatgatcctgtgcctctgtggaatgcaggctgtcagatagtggccctcaactttcaaacccccagcacagagatggatctgaatcatggcctgttccttcaaaacggacagagcggctacattctgaagcctgcttacctgcgagacccagccaccgagtttgaccccatcactctcactagaggaccgtggctaaatcaaaaaaaccttcatgtgatggtgatctcaggccagcagttacccaaaacaaatgaaaaggagtcctccgttgtggatcctcttgttaaagtgcagatctacggtgtgccagcagatacgaatgagaaagaaactgcatacattgcgaacaatgggtttaaccccatgtggaatgaaaatttccagtttgaagtgtgtgtgccagatcttgcactggtgcgctttttgatcgaggaccacgactcaacctctggcaatgacttcattgggcagtgtacaattcccttcaacagcctaaaaaatggatattgccacgtgcctttgttcaaccagaatggagatctcctgtcgtcagctagaatttttgtccacatcatggttgtggattctgaatagattatacattagcacagttcagactgaatcttttgtatcactatgttcaacaatgcaggtataacagaggttaaatgtgtctttttaactggtctgcaacaaatgaggcagctcttaatattgtgaatttaattttttttttaaacatcgtaggaatactgcaactgtgtcaaagctgcaatatgatggtcttgcattcaactactagaattttttacttgtattttatgctatacatttctgtgtgccaagtagactattaacactacaaatttgcatgctgaagattcactttcactggttttaactgctttttgatgttcggattttagcaaagggggtcaatttaggacatttcaatttttattcagtaatatttaaatgcatattcttaagtaaagcctgcatatgtttttattttccttgtcttttatgtagttacattactgtagttgactacaactatgaagtactttgtcattcacctattaaaacatttgatactcaatcttaataattgattctgccaactgtacactaccttaaaaaaaagaaaataaacataagttattttaaaaaaaaaaaaaaaaaaaaaaaaaaaaaa

SEQ ID NO: 9828 - protein, 774 aa, Misgurnus mizolepis
MQCVRRQHVRTKSQDLLYSAQIEEAARDNMKLLGLEGDTDLQFLLNGGDLLKVRSGSWKKIRYFKLQEDCKTLWHESKKTLKSKQTFSVEDIEAIRTGRQTEGLKKYTGDALEGQAFSILFKGRQKSLDLIANSEDEAKKWINGLEKVISNMNNLSPLKKTEHWIYSCMRKSDKDFDKKMSPKELKSFLQSINIEVDDDYAKILFEKCDTSKSGFIEGKEIERFYKILTHREEIDVIYGEYAKTGSLMSTTDLLNFLLKEQKDSASQTDALQLIDKYELDEDAKAKQLMTKDGFLMYLHQPEGLIFNQAHKSVYQDMNQPLNHYFISSSHNTYLMEDQLKGPSSTEGYIKALVKGCRCVEMDCYDGSDGEPVIYHGNTLTPEIFFKDVIQAVKEYAFKTSAYPVILSLENHCGLEQQKVMAQHMISILGDALVTKPLGDKMPTCFPSPEELKGRFIVKAKSRGKLEDKFSDEEKAEDAGSVTEEEDDEGEEDEEKKTDKSKSMKVAKELSDLVVYCKSVPFHGFEDSREKQSFYEMASFKESKAVKLAEENANEYIRHNTDKLSRIYPSGLRADSSNYDPVPLWNAGCQIVALNFQTPSTEMDLNHGLFLQNGQSGYILKPAYLRDPATEFDPITLTRGPWLNQKNLHVMVISGQQLPKTNEKESSVVDPLVKVQIYGVPADTNEKETAYIANNGFNPMWNENFQFEVCVPDLALVRFLIEDHDSTSGNDFIGQCTIPFNSLKNGYCHVPLFNQNGDLLSSARIFVHIMVVDSE

SEQ ID NO: 9829 - DNA, 6299 bp, Mus musculus
  CDS (141)..(5063)
acggaaacattttattgctttggccaataatgtgtagcaatattaaatttaatggcagaccttgaagtgtataaaaacttaagtccagaaaaaggtaagactcatgctactaattttaagttgaaagatgcatgagtgtaatgcagtccgggacacagatgatcaaactgaagcgtggcaccaaagggctcgttcgcctcttttacctggatgagcaccggacccgcctccgatggcgaccctctcggaagagtgagaaggcaaaaatacttattgactccatctacaaagtcaccgagggcaggcagtctgaaatattccacagacaggctgaggggaactttgaccctagctgctgctttaccatctaccatggcaaccacatggagtctctggacctcattacctccaacccagaggaggcacgcacctggatcacgggcctcaagtatctgatggctggcatcagtgatgaagactcccttgccaagaggcagaggacccatgaccaatgggtgaagcagacctttgaggaagctgataagaacggtgatggcttattgaatattgaagagattcaccagctgatgcataaactaaatgtcaatctgccccgcagaaaagtcaggcaaatgtttcaggaagcagatacagatgagaatcagggaaccttgacatttgaagagttctgcgttttttacaaaatgatgtcattgagacgagacctctatttgctgctcttgagctacagtgacaagaaagaccacctgactgtggaggagctggctcagtttttgaaagtggaacaaaagatgagtaatgtgacactggactattgtcttgacatcataatgaagtttgaagtttctgaagaaaacaaagtgaaaaacgtccttggtatagaaggcttcacgaacttcatgcgtagccctgcctgtgacgtatttaacccgttgcaccatgaagtgtaccaagacatggatcagcccctgtgcaactactacattgcttcatctcacaacacatacctgactggggatcagctcctttctcaatctaaagtggatatgtatgcacgggtgctacaagagggttgtagatgcgtggaagttgactgttgggatggcccagatggagagccagtggtccaccatggttatactctcacttcaaaaattctcttcagagatgttgtggagaccatcaacaagcatgcattcgtgaagaatgagttcccggttatcctgtccattgagaaccactgcagcattcagcagcagaggaagattgctcagtacctgaaaggtatattgcaggacaaactggacctgtcttctgtagacaccggagagtgcaggcagcttccaagccctcagagtctgaaaggcaaaatcctagtgaagggcaagaagttgccgtatcaccttggggatgatgcagaggaaggagaagtgtccgatgaggacagtgcagatgagattgaagatgagtgcaagttcaagctgcattacagtaacgggaccactgagcaccaggtagaatctttcatacggaaaaagctggagtcactgttgaaggagtctcagattcgagacaaagaagatccagacagtttcacagtgagggcgttactcaaggctacacatgaaggcttaaatgcacacctgaagcagaacctggatgtaaaggaaagtggaaagaagtcccatgggcgatccctgatggccaactttgggaaacacaagaaagctacgaaatcacgttctaaatcctatagtactgatgatgaggatgatagccttcagaatcctggcaaggagggaggccagctgtacaggctgggccgccgaaggagaaccatgaaactctgcagagagctctcggacttggtggtgtacacaaactccgtggcagcccaggatattgttgatgatggaaccacagggaatgtgttgtccttcagcgaaacaagagcccatcaagtggttcagcagaagtcagagcagttcatgatctacaaccaaaaacagctcacaaggatttacccctctgcctaccgcatcgattccagtaacttcaacccactgccctactggaatgcaggctgccagctcgtggctctgaactaccagtctgaagggcgaatgatgcagatcaatcgagcaaaattcaaggcgaatggcaactgtggctatattctcaagccccagcaaatgtgcaaaggtactttcaaccctttctctggtgacccacttcctgccaaccccaaaaaacagctcatactgaaagtgatcagtggacagcaactccccaaacctcctgactctatgtttggagaccgaggcgagatcattgaccctttcgttgaagttgaaattattgggctgccagtagactgttgcaaggaccaaactcgtgtggtggatgacaacggatttaaccctgtgtgggaagaaaccctaacttttacagttcacatgccagaaatagctttggttcggttccttgtgtgggatcatgatcctattggaagagactttgtcggacaaaggactgtgaccttcagtagcctcgtgcccggctaccggcatgtctacctggaaggactcacagaagcatctattttcgttcacataaccatcaatgagatctttggaaagaacagacagctccaaggcctgaaggggctgttcaataagaatcccaggcacgcttcttcagaaaacaactcgcattatgttcggaagcgatcgattggagataggattctgcgacgtacagctagtgctccagccaaaggcaggaaaaagagcaaagtgggcttccaagaaatggttgagataaaagattctgtctctgaggcttcaagagatcaagatggtgtcctgaggaggaccacccggagtctgcaagtacgccctgtctctatgcctgttgacaagagccttctgggggctttgtcgctgcccatatctgaagcagcaaaagacacggatggaaaagaaaactgtctggcaggagacaaggatgacagaagaaagggagccgcaactagaaaagacccacatttttcaaatttcaacaaaaagttatcctcctcctccagtgcgctcctccacaaagatgccaaccaagggccaactgccagtgtatcaaacccagaacagtgtggaggacgaggtgcaaagagtgagaggatcaaaccaaatatgacaaatgattgccaggaaaaccacaatcccccgaaattcctttctccaaggaagcatttggctctggatcctgcaacgaagggactgcaagagagactgcatggaatgaaaaccaatgagaaggagcatgccgagggcttcttgggagagaaaagcatgctgtccggaagcgttctttctcaaagttctctggaggtagagaacctggaaggcagcagagccaagggcagagctgcaacctccttttctctctcggacgtctccgcgctctgttctgacatccctgatttacattcaactgccattctacaggacactgaaatttccaatctcattgatgacgtgactttaacaaatgagaatcagtcgggaagttccatctcggcactgattggccagtttgaagaaagcaaccacccggctaacgttactgtggtttctcatctcagcaccagtggggcatcaggaagtgctcctttccaaacacccttcaagcatggtctttcccaggggaaccagaaggcctccttcttgtgctcatctcctgagctgaataagctctctagtgttgagaccaccaaactggcaaataacgcagttccttgtggagtgattggttctcccatctctacaccaaagccaggtgatgacccttcagataaggccaagacaagagtcattgaaggcaacctgcctgggttccctgatgcttctcctggtcaatttcccaaaagccccacccatggagaggaccatagtcaagtgatgaacagccctgctctctccacggagttggccatagaagatataattgcagaccctgctctctctataaattctgcagaaagcagtcttgtggaaattgatggagaatctgaaaacctatctctaacaacctgtgactacagggaagaagctccaagtcaacttgtttctccactaaaactgcagcagagccaggagatggtggaacacattcagaggggcttgaggaatggctactgtaaagagactctcctcccttctgaaatattcaacaatattccaggtgtcaaaaatcacagtatttctcatctaacctatcagggtgctggctttgtgtataaccatttctcaagttcagatgcaaaaacgaaccaaatctgtgagccccagcagcctagggctccagatatgcatgcccctacacctacaccatcaacacatgctcctttggctgctttgaaactgccaagcccatgcaaatccaaaagtctgggggacttaacatcagaggacattgcctgcaattttgaaagcaaatatcaatgtattagtaggagctttgtgacaaacggcattagggacaagagcgtgactatgaagacaaagtcattagagcctttagacgccctgactgaacagctccggaagctggtgtcctttgaccaagaagacagctgtcaagtgctctactcaaagcaggatgtcaatcagtgtcccagggcattagtcagaaagttgtcgtctagaagtcagagcagagtgcgcaacattgctagccgtgccaaggagaagcaggaagctggcaagcaaaaagctatggcccagagcaccagaggaggagtggtccttagaagtaaaccgcccgctcctgctctggccgtgaaccgtcactccacgggctcatacattgcaagctacctgaggaacatgaaagctggtggcctagagggtcgaggcatcccagagggagcgtgcacggcccttcgctatggctacatggaccagttttgttcagataattcagttctgcagactgagccaagcagcgaagataaacccgaaatttattttcttttgaggctttgaattatataaagttgcattttcattgtttacatgatactctagaagatgttagatttttttccattgtcaggaaatatgatactgggctttgaaatgatttccaaatgtatttttaaacttgtattttggtctccctttgcctcatgcatttgtatatagattctgtggcctttcccaggaatccatgatctttcccccaaggtgttgtaaactatgttagtatgaaatgtgtgcatgcccttatgtgaaacttctcagcagcttgggtcatagagtgcatatgttgcacacaaaaaaatgtgtttccccatgtcctccgatcacagtcccagaggctgtcaccgttactcactaagtgttgagctcattaagattaaactttgaaaaccataaagggatggattctttatgtgaagttacattttccttctgaattgagagactcagattcagttttataatccatttaaaagagatgttttaagtggttacattgccctttatgatttccacatgccacccaaagtaggaattccatgaagatggatagcagctcaccaaccccaagtcccttttagaatggactatgaggaagaaagcgaacttctgtatataagggcaaattagtttgttttgcatgaaattttgttacatatttttgctaatggccttgtatgtaacaagaatccagttgccaagctatctgtcattcttttggatgatgtaatattatagattgaaaataatggctttccgaatgagagacgttcagctggggatggtggttcccgactttaatcccagtagaagcagatgagtttgaggccagcctgatctacatagtaagctccaggccaatcaaagctatgtactcagtccctgtcttaaaacagcaacaacgaaaagatagtgagagacttacattaaacttaaaacccaaagtaggacaaacagacacttccccaaagcaatcaagaaaaaaagtattttctcataatccaagtgaatagataattaaaagaagccttttccctttagggaaccaagtaactctattttagtaccgacatatattattttcattgtggatccattttttattgcatgttcagatgtcatttgctttttgtaccatgaattacaatgatgttcttcctggacctcataaaaatataattaaagcagatttttgaacaaaaaaaaaaaaaaaaaaaaaaaaaaaaaaaaaaaaaaaaa

SEQ ID NO: 9830 - protein, 1640 aa, Mus musculus
MQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMSNVTLDYCLDIIMKFEVSEENKVKNVLGIEGFTNFMRSPACDVFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGILQDKLDLSSVDTGECRQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQNLDVKESGKKSHGRSLMANFGKHKKATKSRSKSYSTDDEDDSLQNPGKEGGQLYRLGRRRRTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQINRAKFKANGNCGYILKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIFGKNRQLQGLKGLFNKNPRHASSENNSHYVRKRSIGDRILRRTASAPAKGRKKSKVGFQEMVEIKDSVSEASRDQDGVLRRTTRSLQVRPVSMPVDKSLLGALSLPISEAAKDTDGKENCLAGDKDDRRKGAATRKDPHFSNFNKKLSSSSSALLHKDANQGPTASVSNPEQCGGRGAKSERIKPNMTNDCQENHNPPKFLSPRKHLALDPATKGLQERLHGMKTNEKEHAEGFLGEKSMLSGSVLSQSSLEVENLEGSRAKGRAATSFSLSDVSALCSDIPDLHSTAILQDTEISNLIDDVTLTNENQSGSSISALIGQFEESNHPANVTVVSHLSTSGASGSAPFQTPFKHGLSQGNQKASFLCSSPELNKLSSVETTKLANNAVPCGVIGSPISTPKPGDDPSDKAKTRVIEGNLPGFPDASPGQFPKSPTHGEDHSQVMNSPALSTELAIEDIIADPALSINSAESSLVEIDGESENLSLTTCDYREEAPSQLVSPLKLQQSQEMVEHIQRGLRNGYCKETLLPSEIFNNIPGVKNHSISHLTYQGAGFVYNHFSSSDAKTNQICEPQQPRAPDMHAPTPTPSTHAPLAALKLPSPCKSKSLGDLTSEDIACNFESKYQCISRSFVTNGIRDKSVTMKTKSLEPLDALTEQLRKLVSFDQEDSCQVLYSKQDVNQCPRALVRKLSSRSQSRVRNIASRAKEKQEAGKQKAMAQSTRGGVVLRSKPPAPALAVNRHSTGSYIASYLRNMKAGGLEGRGIPEGACTALRYGYMDQFCSDNSVLQTEPSSEDKPEIYFLLRL
